United States Patent 9,487,797 (GENOMIC PLANT SEQUENCES AND USES THEREOF) - sequence listing, part 67

SEQ ID NO: 73075 - DNA, 30603 bp, Oryza sativa
ccaattttgcggaccattcgacgcgtacgtcgtgcacgtgcgccgcctgccctgccctgccaggccaggccaggccaggcgagcgagtgtgttccccctcttctctccaccacacatgcttcaagtggctaggagggcatcctcccttttaaggagatccccctcttctagaataagcaaggtggtactaaactccacatgcatgccatcccatgaggtgcgcttttgtgattttccaaagaattaatcttcgaatgggccttagcccatctatcaattccaacaatcccccaccaaatctcaaaatcccactgagatttgccttttccaatgtacttttatataccaacggttcgatggagactgatcaaggttgaacatccacctagaactccaagctacacttactcacaacttgaacaatggactacgccttgaattgcatgtcttgtgcaagcaagtttcactcaaagtcttatctggtactagaccgtctgtagactacccctcgggtggagcatataagtcatactcctaggtctttagtaagcttcctagaagattcacccaaaatcttcatagactgcgaccaacagtcaagcttacaaaggtgagttctttcatgaatgctttgcaggacagcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacggaatctccgatcacatagactgggttaccaccatagtataactcacatgggtctcaaacacatctccttcgatgcattatctatcacatttcgtgatagtcccttcgtgaaaggatctgccaggtttctaactgtttggatttaatccaacgttataactccagagtttctcagtttcctgacagacttcaatcgtcttttcacatgtctagacgatttcatattattcttagaactattcactttgacaattaccgtttgattgtcacagttcataaggatagccggcaccggtttttcaacaataggcagatccattaatagatcacgcagccattctgcctcaacagtagcagtatccagtgccgtcagttctgcttccatggttgacctcgtcaaaatagtctgtttgcaagacctccacgaaacagcaccaccacccagtgtaaagacatatccactagtggctttgatctcatccacatcagagatccagttagaatcactatatccctccaataccgcaggatacccagaatagtgaagccccaattccatagtacctttcagatagcgcattactcgctcaagcgcacgcagtgatcatctcccggattagaggtaaaccggctcaacttgctcacagcaaaggagatatcaggcctagttgcactagccagatatatcagcgagccaatgatttgggagtattctagttgattcctagtaattctcttattcttgcgaagcaacaagttaggatcataaggtgttggagaaggcttactatcaatgtagccaaagcgattcaagatcttctccacataatgggactgcaagagtgtaatcccattctcacctctaattagcttaatgtttaagataacattagctactcccaaatccttcatatcaaaattttgagacaataatgatttaacctcatttatcacctcaaggtttgtcccaaatatcagtatgtcatcaacatataagcacagaataactccctcacccccaccatggcgatagtatacacatttatttgtctcattgactgcaaagcctgcaaatgtcaatgttttgtcaaatttctcatgccattgcttaggagcttgtttcagaccatacaaagacttcaacaatttgcacactttgccttcttgaccttcaactacaaaccaatcaggttgatccatatagatctcctcatccagctctccattaagaaaagctatcttaacgtccatttgataaacgagaagaccatgtgaggctgctagggaaagtagcacatgaattgtggtcaatctagcaacaggtgagtaagtgtcaaataaatcttcgccttctttctgagtatagcccttagcaacaagccgagccttgtacttttcaatagtaccgtcaggccagagcttcttcttgaacacccacttgcaccccacaggttttcacctcccaagtcccgttagcgataatggaatccatttcactacggacagcctccttccagtagtctgcatcaggagatgcgtatgcttctgaaattgacttaggagtgtcatccacaaggtacacagtgaaatcatcaccaaaagacttagccgtcctttgtcttttgctccttcgaggagcttcactgtcatcctcctctgtaacatgttcatgtgtatgttcagtttgttctggtggtgtgattgaactgggtattatttcagagggtcgactagaactactatgtgtatccttcattgggaaaaagctctcaaagaaggtagcatcacgagactccataattgtaccaacatgcatgtcaggtacctcagattaactattaaaaatctataggcaatgctgtggtgagcatatcccagaaagacacagtccacagtcttaggtccaagtttgcacttcttcgttattggtacattgactttcgccaagcacccccatgtgcgcaagtaagaaagtgatggttttctcccaatccatatctcatatggtgttttgtccttatttctgttaggaactctgtttaacacatgattcgaggtcaacaatgcctccccccaccatgccttaggtaatcccgcggtgtccaacatggcattcaccaagtcgatcagtgtacggttcttcctttcagcaatcccattagactcgggagaatagggaggcgtcctctcatgtataatgccatgttcctcacagaataagtcaaactcgtttgagaaaaactctccaccacgattagacctaagtctttttatctttctgtgaagttgattttcaacttctgccttataaattttaaaatagtctagagcctcgtctttcgttttcaacaagtacacatagcaaaatctagtagcatcgtcaatcaacgtcatgaaatatcattttccacccttcgtcaacaccccattcatttcacagagatctgagtgtaggagttctagaggtgccaagttattgtcctcagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgtcatacattagcctcatcatccacactgccaaaaatatggttcacagacttattgcagaaatcagaaagggaaaagcggaacaggcctctgtactcatgaccttgacaaataaaatatccatgtttagacacgactactttattagactcaaaaaccaacttaaatccgtctctagtcagacgggagccactaacaagattcctgtcgatagaagggacatgttgcacgttcttcagctgcacgatctttcccgaagtaaacttcagatctaccgtgccaacaccatgaacagaagcatgtgacccattccccattagtacggtggaaccccgtgcgacctgataagaagaaaacaatgagatgtcagcacaaacatgtacattggcccctgtattaacccaccaattagtagactgattaactgaaaaaacagtaggtaaattaccatacccgcttccatctccagtgttgccaatggtcacattagcagacttagaggtctgccctgcaggtgccttcatccccttgcgttgtggacacttcctggccagatggccaggttgaccacacacaaaacaagtcctctcatcctgattagaattgttgttgttgtttttcttcttgaagttggtggtctgctgagctttgtatttccccttgctcttgttctgggccttgtgcacaacattggcagtggactgcccaccatcgcccttagacgcgacatctttttcccgagctttctcctcaacatcaagagacgctatcaacccctcaacggatcgtattcctgtctcttgtgtttgagtgcagtaccgaaacctctccaagatagaggtagtttcgcaataatgcacccggccacaaatttatcgggtaagacacacttaaggagttcgagttccttagccatggtttgtatctcatgagcatgttcgactacagaacggttgtcagccatcttgtagtcatgaaactgctccatgatatacagatcattgctagcatcagtagcaccgaatttagtattcagtgcatcccacaactccttagcatcggtgatatgcatatacacctcgaccagacgatcgccaagcacgctaagaatgcatcccacaaagagagtagtggcctcatcgaattctttctgctgatcagcattaagaacgcccataggcttgccagtactcacccagaagcatttcatagctatcagccacagagtgatcttgatctgccatctcttaaagtgcacaccggtaaatttatccggcctcagtgcatcggcaaaaccagccatagtaaaatcacagcgcctataataaggtttttggattgttgagaatataggcatataatgatttaatatattccataaataaatcatgacattacagatgtataatagcattaacgcatcattagatctacacatgtaaactaagcagtaaaacatgaacagatcaaatatgcgcaacatgtcgaacacgtaccgaggtgacggaaagaccggttgctcggcaggaactactcgcggttgcgagcagcgacaaaggcgcgcagcacgtgagcggagaggaaggcgagccgtcgcggatgaacagggagcagtcgcgcgaagcgcttcccaaaaaccttattgccgccttctcccagtgtaggacgtcgaaggcagaggttccggagacctgctctcccgatcgcaggtgcacgccgacgagcgggatggagtagtctacgagcgacggcgcagcacagaggaggaggcaaaccctagattgattttgtgtgttttgcgtgaaggcggcggctcggtttatatagagataggtcgcttaatcagggcgcccgcacgatctccactccgtgtaaccgaaccggataagtcgcgcgtaacttatccggactccatgtcgttttcacgcaccgaatttttcggaatgtttccaaaacaaaacaaatccgaattttcctgcagcaaaacaaaactgcaaaaggaggctgcatctgcagcaagggtgaggagccaattttgcggaccattcgacgcgtacgtcgtgcacgcgcgccgccacctgccctgctagacgaggcgaggcgagtgagcgagcgagcgcgtgttccccctcttctctccaccacacatgcttcaagtggctaggagggcatcctcccttttaaggaggtccccctcttctagaataagtaaggtggtactaaactcgacatgcatgccatctcatgagataggcttttgtgattttccaaagaattaatctttaaataggccttaccccatctattaattccaacatgcaccaaaccaaataaccaatacacctacaccatgcggccctatgtatgaaagaaacagtactatatatatcctctgctttttctcggggtatatattccggctaaattattggcatcgcaatacacgcgcagtttcggatgacactgccagtacgtatacatatctagctagccggtgcagtagtgcagcatcgatcgccaacacacatgacaacgagttctcggcacgagatcgatcgcgatcgatcagcagcaaaccaaagtacacctatacaaaagcacgttaattatatgctctcgtactggatgccgctagcagctagcgttacatttgacaggacaagtagctatctagctaggccggttggaaactacctgtagaaagaaatacgtttttccgttccggtacatggcctcgtcgatcgtagctgcagggtaataattagcgagcatctggctggcccgcggccactgatctgtactgccgctgcacctcaatgatcaaatcaaccatggaccggaagatgacatgcactcgatcgagatcgcgcgaggctggcaccggcatctgcaggttgatctacactacgcaccagcacagtagcacagtagggagtgcaaccgcccgctcggcgagagcgagaaggcagtagcagatactagattaattgctttttcagcatgcgtacgtttcggctttgcaacggcatcggaatcggttagcttttccccatcgaccggccatacggagggggccgggagagagagaggtcgaccgagagagatgggtgagagggtgatgatgagtgcacgcacacggaaccagccgagccgagccgagccgcgccgtgccgtattgccgtgtagtgcgatctatcctatgctagtcgctgcgatcgcgatatatgcagctcgtacgtaatatttctagctcgttcctgtgtgttcgtgctcgatcgctcgcagtgacgtgccgcggtataccgatgtactccatggacgaagagatggaattaatgaggtggtcagcgacagtcgacagacgacaaaaacccccagctctcgccggagcgagcgtatgctgccgttggtgccaaatcgtgccaaaggaccgttgtagtagatttcgtgcgggctgtagaaattgctgtgcatgagaacacgcagaaatctatctatctatatatttatatttactagtaaaatacccatgatttattgtgggcaaaataaaatacacaataatatataacataaacaagttctttaaaaaatatgctagtgttatttatttgcttattagagtgtccttgatattatgcatcagcatctttagtgtcttttatactactatagatatgtatatacgaacacttcttacgagttgacacattaaccaatcaatattgtaattagatagatcatattattgtgatcgaatatttatatttaatagtgtgctatatcaaaaagtcatttgttctagatggtgttgccacgtcaaaattcacctaaattttgataattagatatacattaattattaatttaggaattaataaatctctactattatacaaattgaagatgtcactactagaaaaacgatttttcatggcgtttggaaaatagtttttatggcggctaagtggaaaaaccgccagcacaaaaaatcgtgggggtcacgggctgccagcggaaacacatcttcgctagcggtcatcttaagccggccgccagcgaagataggatatcttctctggcggccctcttaagttgacgacagcgaagataccatatcttcgctggtggtgtggtgacgtggaccgccagtgtcggagaatgaactcctccaccaaggaaccgtgaggcccccctttgtgagttcggccgggagcagcgggtgagattcgagggcttggtgagcggagctgtgtgatctaagggcgttaggccccaccaagacgatgagacaaaagaggtttatacaggttcgggccgctgagaagcgtaataccctactcctgtgtatgattgattgaatgtagaacacaagtgcttggggttgcgagacccaagcgccagttcgctccgaagtcccccctccaccactaggcctagaccttcttttatacctcaaggggttaccacatgggcccaacaacctaacctagctctggtggagaagtattataatctttgcattaaattcatgtcttgtctcttgacttgggaagccaagcacacgtcatcttgatgatggggcctgtcaaatcttgccgcttgacacggggggtgcccctgtcagtcaccatttaatgggtgaagacttctgggctcctattacaccgggaaacgggagccttgctttgaccagagcgggaggacctactccggttgggataaaaggatgagaacctctcaccatcactatttgatgggacatgtcaggctgcacgccgcctgacacacgagcagcgcacaggcgcactagccagtcccatcggtcattcgaccggtcacagaccggttgagtgtactgcacgccgcatagcgtggcgcgaccgctcgggacgccataaatgcgggtagatgggcacctggaagcggacacctaacccaccgtacgtggtgacctagagagggggtcgggggtgcccgacccctagtcacgggagggggcagccgccgcccgacctcgggcccgatcccccctcgggggggagccatgtggcgcctggggcggccttctccctctagtcttggctagggagtggccgccgccctacctcgggcccgacccctctcgggggagggccacgtggcattggaggacagcctcctccatccagtctctaggaaggagtggccgtcgtcctacctcgggcctgactgccctcgggggagggccacgtggcatcggggggcagcctcctccctctaaacctgatactatcgggctcatatcaccgacagtagcccctggcgttagccctgaccaaaaccttccccaggtggtcagggttgacgccactttcctagtctgatgatatgtgggcccgatctcttattctttctttgctggcactaggacccatgcgcctttttcgccccagcctgagggcgactcgctagcccgtaccttaggctatgaacttattttctgtatatatttagcaaacgttgttatattctctcgggcccgtgaccttacgccacgtacctcgcttgcccctgccatttgttaacctctgttcatgttctacttcatctactcaaatgattattttcgtgagtgtgaggattgaactttccatagccagcaatcttcacccgcgatcaagctaagctgggcgccgtagccagccagcggggccaaagccagccgctacagaagagctagcacagggggccccgggcgtcgacggtacccagagctcgacgcagggctaggatagagctaggaatcgtagcccccgcactttaagcaaagaatcgtttgaatggatgaagcgaatacaaactttttgttaccaagggagtcaagccggcgcgcgacacataggtaccgcaggaccgcgaggaagagatgggcgagagataaatataagcaataataattttatgcaaacgattatcttcgcgtgagtgtgaggactgaactttctatagccggcaatcttcgcctgcgatcaagcgaagctgagcgtcgtaaccagccgacggggccaaagccagccgctacggaagagctagcacagggggccccgggcgtcgacggtacccagagctcgacgcagggctaggatagagcttggaatcataacccccacacttatagcaaagaattgcatgtatgaatgaagcaaacacaaacctttagctcgaagagggcctcccaccatgggttccgaaccatcttgggaaacatgtgaccacttagcaaacgaggtcaggttcccacgagcctgtgtccccacgctacacattctgtttgctctttcctttcagtggcctccttccaatctcttttccttctacatggacgattactttcgcacgagtgtgagagccgaaaactctagagccagcaatccctgtccacagttgagccaggccgagtaccgtagccagccggtgggaccaaagccagccgctacggaagagccagcacatggggtcccgggcgtcgatggcacccggggctcaacttaaggctaggataaggctagaaaatttagcccccacacttagcaaagaatcgttcatgtagatgggagagaggttgtgctcttaccaccgagggagcaaacaaatgcgcaatacgcgggcgtttcagggccatgagaatagaatggggggaaataaatataagatttcaagctaatgaattgaaaatttgaaaatacttgaagcttgaaaggacgatcagttgagccgggccgggcatcgtagccagccggcgggaccaaagccagccgctacagaagagccagcacaggtggtcccgggcttcgacgacacccggagctcaaaactgcaagagtcctcccaggagtgaactgaggcggcagcaggttcatgggccaacctcgcgcttggccactgagggccatggggaagacgttcgccatgacccggtcgccaccccccgccgcctctatgatcaccgtgcagatctggagggactcggaggggtcggcgccatcgtcgtacttctcggtgaggcagggctggagctttgggggccctcggacattccgaagactcgccacaaagacctggtagccaagcttacctggtggagatgtggggggccttgccccctgcctggggtggcgcgacactcatgaggatgctgcgccttcccccgtagcggcggcgcgacactcaccatgccggcgctcgaaagaacctcaaaaatcacgaacgcgccccctacctggcgcgccagatgtcggagaaagaactcctccaccagggaaccgtgaggcccccctttgtgagttcggcctggggcagcgggtgagattcgagggcttggtgagcggagctgtgtgatcttgagggggttagaccctcccaagacgatgaaacaaaagaggtttatacaggttcgggccgctgagaagcgtaataccctactcctgtgcgtgattgattgaatatagaacacaagtgcttggggttgtgagacccaagcgccagttcgctccgaagtcccccctccaccactaggcctggacctccatttatacctcaaggggttaccacatgggcccaacaacctaacctagctccggtggagaagtattataatctttgcattaaatgcatgtcttgtctcttgacttgggaagccaagcacacgtcgtcttgatgatgaggcctgtaaatcttgccgcctgacacggggggtgccactgtcagtcaccatttaatgggtgaagacttctctgctcctattataccgggaaacggaagccttgctttgaccagagcagcaggaccgactccggctgggataagaggatgagaacctctcaccatcactatttgatgggacatgtcaggctgcacgccgcctgacacacgagcagcgcacaggcgcactagccagtcccatcggtcattcgaccgatcacagaccagttgagtgcactgcacgctgcattaaatgcggcatggcgcgaccgctcgggacgccataaatgcgggtaggtggacacctgaaggcggacacctaacccaccatatgtggtgacctagagagggggtcgggggtgcccgacccctagtcacgggagggggcggccgccgcccgacctcgggtctgatcccccctcaggggggagccacgtggcacctggggcggccttctccctctagtctcggccagggagtggccgccgccctacctcgggcccgacccttctcgggggagagccacgtggcattggaggacagcctcctccatccagtctctgggaaggagtggccaccgtcctacctcgggcctgactcccctcgggggagggccacgtggcatcggggggcagcctcctccctctaaacctgatacccccgggcccatatcaccgacagccagcgaagatacctacatcttcgctggcggccatcttaaccctccaccacctcaaatcattttctatggcggttcaaacgaaccgacatatgacgaccgccattgaaaatgcgttgaactatatcacccagctacagtaacttcgagcactattaggagcacgattttctctctcttaagaacacatacacaggggataaggttttgatctcgaatcttttgatgattgtttggtatgtcgtccgattcgagtacggatacgatagtccgacttcaaatccgtatcctatttaatcgccataaaaaaaagtctcaaatacatgtacatgtatgtctcgaatttgttgctcgcatgtatagaagaagagaacaggtcatcagatcgattcgtactagaatatactgcacagacgtaaatttctctttattagtttagaaagaagcgcagctagcatcggctgcatgctcttcctgatccgattgtgatatggatgagatgatacagcttggctatttttcaaaggttgctgcataaacacccatgtagacatatcttcatgttatttctatcatttatgaatttggaatattcctattatgtttttttttgtgagattttcataatcaggatgaagccatcgcaatgcaataaccagccacgtgagacaatttcacaattcataatgctcaaatactgcataaaaaatatgccacgatttagtttttccgtagcaacgcacgggtactttttctagtcattaaaaatagtaaagtccatacaaccttgataatattaactccgaattttataatactgataaacatgaaaatggctacaattcagaccccgaatcgagtacaactcgatactagtacatatttggaatcatgctaaatctataattaggacttcaaaattttagacttaccaaacatggaatagctcactactagaaaaacgatttttcatggtgttggtctattattttcgttggcggccatacacgaaaaccactagcaaaaacatatcgaggggtggggggccatggaccgccagcgaaaaccgattttcgctggcggccacgctcagaggtccgccataaaaaaaactctattttttttaggcggacttcttaagtgtccgctagcgaaagtcacgttttcgctggtggtaggtaagaaataccactacaaaacttttttgaggcgaacaaaatccacccaccgcccaccgccaagtccgtccttatcccttttcccttctcccttcccatcgcccagtccgcctctctcccttctccgtctctcctcccttccttctccaccgccgcgcctcgtcgcctccccaccaccgccggctgccgtcgccgcagctccaccgccgcatacgaccgccgatccggccccattctcttcctcttctaactccctctctccctccacggagtgggcggcgaaggcggcggtgagctcgggcgcgggcagcggctctcaggcgcgggcgcgggtgctggcggagctcgggcgcgagcgcggcggtgactctcgggcgtgggggcagcggctctcgggagcggggggaggagctcaggtgcgcggggacggtggatccgccgccgccgggcctcggggaggccggatccgccgccgctcggccacgggaaggctggatcagccgtcgccggaccacggggagggcggcaccgacctcgatgccgtcgaccgtgctcccgcggctcccccctccgaccatgctgctatatttgatttttttttccttcttttttttgcatgttgttccatatgatgcacatgttttgatctgtgtaaatgatgtttgatctgtgctgatgatgattttgtatttcatgtttgaatttggaaatgagcagcgaatctagatgtggatttgaattttgaaattaatgaatcaataggcggctgcatgggtattttcgctggcggctgtatagctgcatgggtatttctttttgggctcaaaatagattttcactggcggccgatttaacacagccaccgatttaacacagccgccagcgaatcgctggcggccgtcttaagccaatgctagcgaaaatggttttttgctggcggctagctcaaagacgaccgcccgaaattggatttttgctggcggtcaataaccgctagcgaagatcttgattttcactggcctttgctttgtggcggttgcaaattctgccatcaaaaatccaaaatggccgccacgaaaaatggttttcgtagtagtggctgtcactaagaatacaaactataatgtatttcatccggtactaagtcccatatgtagtaattatgaattttagaattattaatttgtgaaaatcatatatcaatactaaaagccgtccgacttatgttgctcttaactaactacttgctaaatcgtatgccctccatgattttcacatgttcaaatacgagagtggattttaaactctcgaagggacatcccctcattgcttacataccactcaaatagttatgaatttattttttttaaaaaaaatattaacatgtgatatatcactctacaaacatagaacttaaattcaacttcaatacatcacaacagagaaaaaattgaccgtgaatatatgttaactagctgtagtttatttgttttttgttgcgatatgtagaagtcgaatttttaagttatatgtttgtgaaataatatattacatattaatatatcttcttattttttttataactatttgagtgagatgtaaacaacaaggagacattccctcgagagtttataatagtttcccatacaagtataggtattctgctcagttttattctatttgcttattacaggcacccgtaacgatcaagttggaataagatggtaaatttcaccgaaaagctagaccaaccagtggagtgcatgtatgtacttactttattatattcctgccaaggcaagcaatattggaatatttgataaataatgctatattcccctgctctttagttcgtctcagtacaccacagacttgcaatctctacactttaattataccatagcaaacgtagaagtactgtaccatcatatggtgcctgtctgattctcgtcagctcattcctgcaaattttgcacaaatttaaaaggcgcttttaagatcactttgccgtcgtccagccttagcttatgtttgctttgcatcatgaacagtcgttagcctttaagcgacaaacctctcatagaagctacacaaagtacgcatgaacctcacttttgctttttcagaggtcatttataaaccatatctgcttgggcaaggtcgttgcctaattgggcaactgcagatttgtaggcatcaattatatggccttttagatttttgttaaacaaatttgtttttaaaaggttttacacaaagctgttgctttgtttctagacctattttatttttcagtcaggtacaatgaagggttatgcacattgtatgcgacgatgcaattttttttcgcgaacacgtatgcgatgcaatctacggaataagttctcttaccaaggataatttatcatgaaaaagttgaaatgataatccagagactagttttaggccaatctacaaaggtgtgatgagaaaaaggaatccatttttcttgcatgccaaaatttagagactatggttatatggattttcgtcaactttgaatcaagatttactaatagggttcatgtctaaataagttgtatctcttatttttgttgacggagtgattatttgtctttcttttcattcgatgttagttactttttgttgagcttttaagtcaacaattaggcaactgggccgcatgttatccaccatcaaaattgatatagaagatatgatttttttttatggttgtcattaccctcttccacgcttatcagttacttatcaaggaattatagtagcaacattggtatgagtttgctatgagggctgctatacgtatgatatgttttttacgatagttgtacgatgaaacattctccgatgttccgttccggctataagtttggtctcgcatggatggatatatcttgaatcgctcagcccatatgcatatttaaataaaggatacggctagatcgcgcgctagcggcatattgctaaccagcgacgcccttctattccaaaaaacagttactagtacactcaacagtacatgtctttttttttcttcctagagaattttctcctaaattacttatccgatctataatccgattacaccattatggttgttgcaattaaatctttacaataagatcttacacgattatattctgataaaaatatctatattgtaaattacttttattatatatgtaagttacttttgtcctatacataaattactttcagatttaagctctttaataacttatatcttttaaatcacgtataattttcatgatctatttacatcattatactctacgtaaaatatgagacaaaacaagatccatgttgaatatatttaaacatttcattaatttaaaagtaatttatttaaattgtagtagtaacttagctatgcaatagaagtaagttagcacaaaatagaagtaagttgttacaacattaaaagtaaattcgagagaaaaatattttgtatctaaaaattaaatttaaagtccataaattatagaattgactaaaaactataataaacataatcaacttaaagcattatgaatatataaatagtaatttagtcaaatctcaaagtaatttatatatatgataaaagtaacttaagtatataataaaagtaatttacaaatataaatattttttcattgcagtataatcatgtaagatctagttttgaagatttaattgcaacgaacacatgtaatcggattatagatcgaataagtaatttgagagaaaactttgtaagaagaggaaaaaaaatacatgtatgtgtaatagaaaaaaaagacatgtatgtgcgctggcttctccacggcttctatggttggcgttgcgcgataagacaatatcgaaaggcctcgccgattagtttttgcgttaaataaattgcaaaccaaagtttatgatgacatgttttgcaaagcaaactttagattgaaacaatataaaaaaagtatacaagcgttaatttacatggtcctactcttagacaatgcacaggaaaaaaaaaagagggactagcgtaacaaagaatatgtttctgaggccaaataaaattaagctaataggatggactttcctctttatatgcaatctagattagtattgttgtagattagatcagaccgtaagttcagatattaacttaattaggtttatagcataaataaaaaaaaggtaaaagactgcgatgagtttgtaaactttgtatatggacttcggggccatgagcaactcttgcatgtattctcatcacgtatctgtttctgtgccgtctgtttggtccgcgtttgatcgtactaatttcttactatgatgttttccgattgctatggtgtttcaatgcacggatctatcatacttcctccgtattcgtaaagaaaatcattgatgacaatgtttaaatcaaaccttagaaatataaatcataaataactctcaagttattaagtttaaaaatgtaaaaattatatgaatagatttgtcttgaaaaatactttcataaaagtatacatatatcactttttaataaatatttttatagaaacaagaagttaaagttgtgttttggagaccgtgtcgctattctaaatgacttctttacgagtacggagggagtatttatgaatgaagatagtaggtagtactatcactaataatcagatgtagccataattgtttcttttattacccttgaccccgggaaaacaaaaattctttaggtaatgattgttccgaagagctgtggctttattatacctcatgagagatataaagagattttaatgaacactaccagattgggaccataagttgatatgaaggcccacatataatcctcatttttcaatattctccattcatagtatgatgatagtacaatcttgccgatagtcactacagggggccaagatttctctgctcaattaacgcattctttcaacagtctgatatgtctggaccgtaccccatatggccatatactgccatacacagccaatcgcataaaagtcacacctctgggtctgaggttctcttgtgaaactaaaaccgttacatctgcccatcttattagggcatggccaacgcagagtatagtctcataaaaaagggtgatgctaaataggataaaatcacaccagtgatatccctcgcacagtgtaagccatacccccatcttaatttttaattcagtacatgttagtcggtcatatttttgcttttaaacccttggattattttaatttgcatatacgtccaatatttacagtataccctctaaaaatcacaaacatatataaacgtcaacccctcctctcatcaccatatctcccacccaatctctccctgcgtctcctttctctccgcttctcccctcgccggcaccgccggggagtctctccccagcgcgtcgcctctcccctccccggccctctctccccggcgctcccctctccggcggtgccacctgtctccccggcgctggatcgaggcggcggcggtagggcggatggaggctgcggtggcgccggatcgaggcgcggcagcgccggatagatgcggcggcagcggcggtgccccatcttcttctcccccgcctacttcctcgccatttttggccttggcgcgggaggtagttggctacaacgttccagggttacggtacggagcgacgcctctcccccaacacggctgctcgcccgttcctcgccaaaagctaatgaaactatgcgatgctatgcggggggtcagggagctctacgagagcgcggtcccggccgagctggcgcgaatattcgcgtcgggaggggtgagaccacgcgacgcgaatattcgcgggtgagaccacgctctagcatggagcgttggccatggccttagtgctctctaactttccagtagagtaacataaggttctctctatcataagaacgatgcatatgaatttatctctgctactttttcttcgttactccctgcgtctcataatataaggaatttgtcacatccctctaaaatctcttatattatggaggcggagagagtaccgatgaagaatatgagcacaacgtcatcattcctgatcaaaaatggctggcactatttacccaacgctcccgccggtagatcgaattcttatcgtggcttctcagttttgctcgcggaacctgcttgtctgctcgcccatcgaccatcggcaacttgggtttcatgtgagtcgaacagcgtgcagcgtgcacgcacagtacttgcccagcaaacagccgctgtctcgggaggggaaaaaaaagggcgccggcgcgatcgttcgtgctctcgctttgcgcggatggctgggaatcgccggcacgaggcgacgtgacggctgattcgtgtccgcccgcgcgagcgcacggtggtgtgatgccgctttttttttttttttgcgtgtgtgtgcgccttttgctgccgcggggagcacggggcccgcggccgcggaaaagaccggcgctggatcgctcacggggaaaagagaggctccggcgcaatcattcgcgtgcaatttcccaaggggatggacggggccgcggggtcggtgttggcttctcgaggtaacggaatggaaaaggatgaaagtttaaaggtgcggaaaattgttctatggtctatggacggagtgcgtatttaagattaaagcctggtttagttttcaactttttttttattaaacttttaattttgacatgaactaaacacacctttgtaaaatttatgtgaagttcttgcattctgagttagggtggcaaggcgtggcaagatattccagttcattagtactaccggagtagcatgttctttcgggattttgtggttcaacgtactcagtaataccaaagttaaggcgatcctaaactagttagagcaagtacaatagcacactattaaccagctaaaaatatattttaatgagataaaatataagaaagaagagtagcgagctacagatctatagctagctacagtatagactttaagacgcaatgtatgtatgacaggtgagaccatatattaatagtatagtaagcaactattatatgaattaactattagatcggctataaatgaattggagttagtagtggactattctattatacttgctcttagaactaggatagtaggatgatgcatgatgcatcggtagccaagaagataaaacgtttggcttcctctgcagctctgctcgatcttgcggaaacgcggttgtcgctcatacgtgcggcccgtaacttgtgggctgctagaacgtgttacgtgaggcccatccatcatgggctggaaaggtattacagcgaacgtgtggcccatactggatggaccggaccggtcactcttgtatttatggaccagaacgggattgggacatgttaaggccttgtttgtttaacgaaaaagtacgtatgaggtccctgtcatcggattacaaaatcgtccctcaaccaaccggatataagtcatccctcaactatcaaaaccggataactctgggtccctaggtggttttggctctggttttatccgacgtgacagctgagtcagcgtaggacccatatatcggtgtaaccacatcatcaccctctatttcccctcctctcccttcctcctctctaactcagtcttctctgtgtaggctggcggcaggtggggaggaggctggcggggtgggccgaggcaggagaagaggagggcgtcggcagccggcaacgcagcggcggcggccggagtggcggcaacgacgacgccggagaaggtggtgacatcgccgcgtgtgcgagctcggggttggagcggcccgagaggcggaagaaggaaaagggcatcgtctgcggtcggtgacaggcggggaaaacctggggtttcgtgggcaacgtcgtcccccgctcgccgtcgtccctccccttcgtcggctgtgatggggtgcgcggcgtcaacgacggacatcgctgagcggcggaggccggggccgttgcctggccaccacgagacgtccaccgccactggcatcctggcagcgcgccacgacgaccagcagtaggatgggaggaggcgaccgcggtggtgccaccagctcaaccggccgtcgccattttctcgacgacggcacacggggaaaaggcccggcaggccggtgtgcatgggcgcgcgggcgcaggcgtcaccgagctagaccagccgtccccatcttctctacaacggcgcatggggagaagggccggcagatctaggtgaggaacacgaagagggggagcaggaaggggagcgacgtcggccgctttaggaagcgcaacagcgacgacaacagcgatgacgacgacacaacagcgggggccatagcgcgatggctatccttgggttcgccatggatgggtgggtggcgagctggtggtggtggtggctcccggactcgagttacatcgaaggtcgccgcccacgcccaccgcacctgcctgccgtgcccagctactcccccgtcccgcccatggagaggagagagaggagaggagagaggaagagaggaggagaggctgacgtatggagcccacgtgggccccacgctgagtcaactgccacgttggataaaaccggagtcaaaacagccaaaggacctagtttgcactggttttgtaagttggggaatatgttatatccggtttttcagttcaagaacaattttgtaactaggtgacaagttgagagacctttggtgtactttttcctttgtttaatccccaggagaaagaaattggagggtattgatagggaataattctatacgtgtgaaataaatccctttaaattttccttaatcccccgtgagtgtctgcgaggattgtggtgagaaattattgtccttcaatcccattcaattcctctattgaacaaggtcgaagggcataatttatgggccggaatgagattgtggcctactgttaacgaccaaatttggtaatatcatcatcggaaaggaggattggatcaaagtggagtcgaaggcgaagatcgatctgagaacagagcaagaatcggctggagtccagatcggctacagtcaggatcggctgtgtccgagttaaactaggtgagccgatacagctgattccgacaatacgacttggtgtacaacatcgggttgggttgatatgcttcaagatgattgccgtgcatggatagagtcctgagaaggcaattgtatctattaattaggatattttatgtaaattccttagagatatgtttgggtaaaagtctgccgcaaaggcttgtggtatcttagagattgttagagataataatcgtgtccgatatgaatatagtttgtaattttcgggtataaatagaccccgaacctcatgtaatcaattaacacacacgttcaatacaatttcggcgcatcgccacccttttgctttagttttatttcgacgagttcttgctttcgggttgagctgcatcggtttcgatcttcaacaagaggtaaaaattgtcatgacggtttgcgttctcgggattagcgcttccatctttatgatactctaatcttgtttatgtaattcgtcgagttatcatatatcttacataatctttggcaatatcgctatctaacctacaatcggctaacatctatcggtagagggcagccgatcttatctgatttaactatatttgctctatgcgcttcattgacccgttaaatatgccctttatgttaagatattattgcatctaagtatattcagcttctgttttaacatcgtaatatagagttgtatcggagtattagccgatacatgctagatctatctgatcggctatgctatgaacatatataatcatgttattaatatatatttcgatctaagtgatttatactgtctcggcatggcgaccgatctatctcaatcacttgatttaagtatatatcgatataagaattatatattgccaatatctacaaccgatcgagtagatttagttctttattatctatttacaaccgccgatcgatttacatatgacatcggctcaaagataaatgatatgtcatcggcacctagccgatttgctatcgtttataggtttaaccgcggtttatttgtttttatttcttgttaattacggaatcaaatcaactggcacgctagcatacccgaaggcgagttttggacctgtactggagttaagcagatctctcatgcctcgtgttttacgtctacacctacaggcatccaacatttatatggcccagaaatgaattgtggtagacgtgcactccaccgctgcggcccgtcaacttaaccggccaccgctgcaggctgcagccacatcccacgagttccctgctggcctctgctgtgttctacttctacgccggctgcagctttacatccggtttgcttatatatggctgaaaatttgtgcaaaattttcgcacatatacctgagattcattcctctgtacaatttgatttgctgttcggatgttcaaatcccaatattactggcgtttgtggttcttttcattcaaatttcagagaaaaagagcatgctggtatagtttctgtacactagagctcgagcgaagtaatctgttgccaacaaacaagatcaagagtagtggttaataaaatatcccttcttctgaaagattgttctgtaacgaagatcagaaacattagtgaacttcagtatcctaccgtcgatgtacatgcttgcctgctgatctcctgtctccaccactaactgaggagaagatgggctcattcagagcctaattacgaaccaaaacctctacttgcagaagacgaaaaaaaaaaccattcacgaacatcgcagggtaaaaattattggcaccacgtcacaatcatgggatcacatttccgacagtcatactcaacacaaccaaaactatacatatattgtacttcggtctcatcctttgagtcagacgacagcaaaatacatcacgaggttttcacggttatatagatcgctgttcaaaatagtacttaatagagcaggacacactgacgtcactgagcaagttgacaatacgtctggttggtgctgatggactggctagttatcactttgcatgctcctgatcatgttcaggatataaaggaacaagttgaggatgtcaaggtagagctcaacagaggcccaaatgtagtcgtcataagtgtggcgctttatcaagttctctgtgtcgtagatgatgaaacctgagaaaactaaagctccaaggccaccaaacaatgcaactggtccagagcccaatgggaagaacacctgcaacacagcatatcacggcaaagtgcttattacaattggtggtttcgtaatggtaagatcgctatttgaattaagtatattgtatcaaaatgagtgtacacttgcctgaataaagcttatcacaacaagtaaaacaagagcagaaaacagaattggtccaagataaccaaattctttccccttctttgaagcccagaaagtatacgcagtcaaagaggcaaccacagctgaggtcaatattaatgcctcaagcacaattttccctgcagcacacaaatgattgttatgtaaaaagtacagttggcagttgaagaaactaactaaaacttgcaaaggaaagaaaaccaaccttgagtgttagcacatgccacaccaatactgaaactcaagcacaacgtgaacagacccaggtaaacaaagttgtgtgggtgtttgtgctgataatgatacaatgggaccatcactgcaagaaataacacaaaattagctgagagcaccaaaaccattccatcctaccaaacaattaacaatgtcatctactcaggcttttctcaaaattcagatgaagaagtttagttactcgcaacactaacatgaacaaaaagcagggagtaaaaaaaaacagccccactgatccaagatttgagactttccttgatatttttccatatactattaaaatataactcataccggactaaatacattgactatctcttacacagttatgtgtgctgcctacttgatccaactaggggataaaacaatcttgtctatggcaaacacaaagcagaaatttcagaattgaaagaaaaaaaaataatctggatacacaagtgttcagaagagttctacacttctaaagacagccccaccatgcccatatcatcacactccgcacttgactaacacaaacgcatcatatgatgtcaagggaaacaaataaggccaaaccaaaatgcatatgaatcatatcatttaaggtctcataacatttgtaacaaaattttccgacagcgtttgcattaactagtttgtcataaactcgtcgctgaacatgatctatagaaatgctattcacaatttataggaaaagcaattgcagcattagtttataatataacacaaacatttacttcacatcccaattcagaatgcgagtgggcaaatccatgatgcagaacttactacgtctaattctaagtattaattcgtgaactaattagatcctagatctagaggccaaagttttgattccaacagcaaggcatatagtaacgcaccgatctatctagattcaactatgtagcctacaaatcaaaccagctgctaatcagcgggacgcggatgaatctacgaccgatcacagaataaaaccattctcaatttctcatcaagcacaagaaatctaagatagaggtcaaccgaagcatcatcagatggggaggagggcacacgtacggacgaaggggaggacggcgagcacgagggcgagggtcggggaggaggagagcgtggcgttgagggtggggtggaggacggtgagcgcggagacggcggtggtgaggagcagctgcgcggcgaggatgccgtacaccttgcggacgaacccccaccggagggcgctctccccgcgcgagatccccgggtacagcgtctccccggtgccggcctccaggtccaccgcggaggcgtccaccttctccttcatctccggcgcccggcggtagcccgccggggccagcggctgcatctccgccgccgacgccatcgcttccgacgcgcttggtgggtgggtggggggaatcggggagagaggaggaaggaggtcaggaggggatttcggttgctggtggcctcgtgggaaggagacccgtatgtatcggggaggttgggatttgtgaatttgctaagcgtacacgtgggatctgaccgaacttttcttcccctggtcactgcgaggtggggccaaattgggcggatcggtgggcgcagcactcagtcagaagtcagaagaacgcgtgacacacacacactgacagttggacccacgtggataggctgttatgttaataaatctctatattttttttgcggggaaatctctataattacgtgtgcttaactcatctttactgcacctgcgtgaagaatttgttcgtagcaaaaaagaattactgttaacgattgcgctcgattgaattacttcatggtctggaatactagataatttacaccataaactattaatattggacaaataaactccttgagcattgttttgggtggtttttgctcgagcttacacacgtgacgccaaacgtgacaatccaattaacaaataaaaaaaatctctagacccacccgcccctaagccaatctatccctagtttcccctcttctctctctacacctatggctagagaaggagggcaaaggcggagaccgcttgggcaaggcggatcgaggaggcagcaacccgaggcagagtggaggcacatggatgtagagctcgaaaccaacttggggtcgagaatcccgtcctcactaggaactcgtccccggtggcgaccaccaccatacgtcgcaccgtcgcttgctgcgtccacgccacgtttggccactggtctccatgggagagggaggatacacgggggaggaagaggaggatgggaatatgacagtgatagcgagggagacaacgaagatgccgcacatccggataaaagcacaagtctcatatatggaccccgacggtcgcatcatctccaccaccactcacacggacgcagctgcacatctcgccaagctccgcaaccaaaatactcttcgaacatcttcgccaccacgtgcactgatgctcgccaccgcctgtggccttttccaccaaatcgagctctaggagataatgcctagagagctcgagctcagctgcccttcgcacaaagagctcgactccgccgccgcctgcggccttttccacccaatcgagctccaggagataatgcctagagagcttgagctcagctatccttcccacaaagagcttgactccgccgccaacacctccccaatgaagtttgagctccgttgcaggctctcctctaaccttgctgtcaagctagagcagtggagcacgcgaccataggtctggaggccactcgctctacgacgaggatggtgttgcccaaccaagctgaagccatgcggaggctcgcaagttcgccatcgccgtgagctttgcatcaatatcttccaccattgtccaccttctccaatctccagcatgagagagatagagagagagagagagcaggggactagggatgtgattggacataggaagagaaaattctttgttggttggattgccacactgatgtcatgtgtgcaagctcaatttaaaaccgactaaaacaatgctaagaggattatttgtctagtatgaatagttcatgttgtaaaatgtttggtattttagtttaaggagataatttggttgacctaaccacgatagttcgtggattaaagggactatttggattaaactaaatatttggtagagttttagcaccaacaaaattttagtatgctatagttgaaaatattgatttggattgaagtcaaactatgcttataagacacaagtttacaggcaaagctaaatctatctattatattattaaaacagctctgaaaggaggcaccatgttcactgtttgggctagaaatttccacattaatcggagaaaaagaaaaagaaaagaaaaggagagtcgaagtagaagtacaatttaaattagctaaaattcggaattaaaataagagatattgaaagaagtttccatgtatgaacccaatacgagattaatcaaaactcgaaataaaataaaatccaaaattagaaaagaaaaggagagtccaagtagaagtacaatttaaaaatagctgaaactaggaattaaaaataagcaatattgaaagaagtttccatataagaaccaaatacaagattaatcaaattttgaaataaaataaaataaaatccaaaattagaaaaggaaaggagagtccaagtaggaatacaatttaaaaatagctgaaattcggaattaaaaataagaaatattaaaagaagagtccatataagaacccaatataagattaattaaaaatcagaataaaaataaaaataaatccgaaattagcaaaagaaaataaagaagagttcaaagtaggaatacaatttaaaaatagctaaaattcataattaaaaataagcaatattgaaacaagaatctatataagaacccaatacgagattaattaaaattttgaataaaaaatataataatatccaaaattagaaaaattaaaagagagttcaagtaggaatacaattttgaaacaactgaagttgaaaataaaaaaataaaaacattaaaagaacacaatacggtattaactaattttttttaaaaaaaataaattctgaaattagaaaaaaaagatttcaattaggaataaaatttataaataactaattttttgataaaaataaagactattgaaagaaaagaccatctaaaacacgtgacgagataaattaagtaacatgcctataaaggagtagagttggtggcggttgatacgtcatataaaaattgttaataaaacaccaaatagaatcctaatgacgattaaaaggagggacgtcgggcatgccgtgaagcaaacaagtaaggcggttgccgggacttctagaaagtaaaaaaaaaacacattgataatcatattcaaattttaaaatctcaatgacaataaaaaggagaagcagcgggcagggtgtataagagtatagttgcaaagccgccgatggttgacgggacttctagaaaataaaaaatgaattacaacaatagttatgtttgatttttagaatcacaatgataataaagaataggcggcggacggtctgtagaggggcatagtggcatcgtttgctaggacttctaaaaattataaaaaatgaaactacaagtctaatttttgaaggttcgaaaattctaaaaagtaaaaaaaaaaccaatgataatcatgtccgattttaaagtctcaatgacaataaagaagggaggcagcgagcgagccgtagaggagtacaatggcaaaaccgctgacagtttggcgggacttctagaaagtaaaaatgaacccaaacgataattatgtttgacttattaaaatctcaatgacaataaagagaagagatagtggatgggcatagaggagcataatggcaatgtttgacgggacatctagaaattataaaaacgaaacccaatgtgataataaactctaaaaactagaaaatccaatttttaaatgttccaagaagaatgaatagaaatagtgatagatcgagcaagcaaataaaaaaggagatgacataagggatagcaaatttttaaaaactatataattagaaacatgaggatgataaggtttggtttttcaaaatcttaacaatgagatagctatttaattaattctaagtaaaatcatacttaaaaaatatatgatttttttgctagccgcgcaattgcgcgggccacccagctagttcatgttaaagttgtgttctactccctccgtttcgaaatgtttgacgccgtgactttttaacacatgtttgaccgttcgtcttattaaaaaaaatttaagtaattattaattctttttctatcatttgattcattgttaaatatatttttatgtaggcatataattttacatatttcacaaaagtttttgaataagacgaatggtcaaatatgtacttaaaaagttaacggtgtcaaacatttcaaaacggagggagtaatagagatgtttggttggttaggcaaattttgataagggcaatcccaggcccaaagatttcgccgaacatacacgtcgtcaaatcgaacttttttcgtttttagattttttttaatatttacagaaataatctatggaccaaaaaaattgcagaaatagcccctgtcgccctaatggtgggcggcaatctgacgtggtagacggtgggtcgaccgcgccgtctgccgccgtcggccaaaattgcgattaggcccttgccgcccgtacagagggcggcaaggggctaattgcaattttggccgcccataaagagcttgcggccgtactttttt

SEQ ID NO: 73076 - DNA, 9528 bp, Oryza sativa
  unsure (1)..(9528): unsure at all n locations
cgggagatgataagagataatcgttgagagaagttacagacataagtcatcgatagagtatatagatagagtgataaaagaatgagactatagtatatagtaatttaatatatataaagtgagagatagatagtgtactatcatgcgagaatatacaaatgtaatacgattntgttatacnccgcgcgcgcagactaacaaagaagaattgtgtgtggcgcggcggcgtatatattttatatagaaagaaaaatatttctcttcgtgcgggagagaaaataatcatattattgtggacgagagagaatataataatttttgtgtcgccgcgttcctaattagaagaggggtgtatgttttgttttaggccccaacacaaatatgtgctctcttccgcgggtgtaggaggcagggaaaaatttatgaggcgcgggtttgtttaatatatccggtttgtacccagggattatcctttaaattaaagcaaaaaatataaaattttgtgaaaaataacacttaacaaaaactgttgttgttaaaacaaaggaattaaaagtttttttttaaaaaaaaactttttttcgaagtgtatagcaaataacccggtgaataaaatacagtatatctgatatatactccgttttgtcttaacatttatcatcaggacaaacaactcaaaagcaaaaaggcaaactatatattccatttgtttgttcaaaacagcgactagaggtagtatatatattgtgaatatcattcgatcgatcaaagtgtacgttagtttcttcgggttgttgtcattcaattacatcccgatcgatgaatcgatctcgctcatcggttcatgacctgggacgaacatatgcatgcacgggggacaggccagctgaggaggactagtttgaatctcaaagagaagaaccagactttggccttcattttccctatttctgtcttgcaagcaacgctcttagttgcaaggagtaccactgtcgatctgccagtgtgcgcaaatacaggcagtagcagcttgctattaatataataatctggtctggtttggtctggtcaacttactaatgattaactccaattgattgtgcccgtactccaattcagcttactatgacagtaaggccttgtttacttccaaaagaaaaacttttcacccatcacatggaatgtttagatacatgtatggagtattaaatgtgaaaaaaaaaattaattacacagtttgcgtttaaattgcaagacgaatcttttaagcctaattgtgccatgatttgacaatgtggtgctacagtaaacatttgctaatgacagattaattagacttaataaattcgtctcgcagtttcctggcggaatctataatttggtttgttattagattaccgttaatacttcaaataggtgtccgtatatccgatttgactaccaaacctaattttttttctcaactaaacaaggcctaagtactgacatatatagtagtaaatatgtaggcccgttttgagttggagtacaaaacataccctaccataatttaggtaatttgaatagcaaatgtgctagtttagattgaaaccaaatactaattagtagtgcccatgcttaatattcatgaagacactactataaaaaaggcgggccaaatccatctttttaggtggaccggcgttccgcctataagcaaacgactgtgaaaatagataattttcgcaggcacctacgaaaatcaatttttgcaggcggacggcatcttcgcaggcggcagattcacctgcctgcaaagcaaatttcagcgaataaaaaaaagacgccccaccgcctccgccggcctctccctccggccgacgattgctctcctcctccgtccgctgccgtccccacaggggttgccgccgtcgtcgcatcatcgtcgtcgtcgtcgtcgtcgtcatctcaacgtcgttggcgccgccgtcgtcgtcgtcgaggaggaggaagccggcgatggaggcggagccgacggcgaggaggggaaccggcggcggaaccagggaggaggggagccggtggatccgccgcttcacggtgccgcgaaggtcgtcgtcgtcgcggccgaggggagccgacggctcgcggaggcggcgtcgtggtcatcatcgtaatcgaggagggctaccagcggcggaggcggggaggagttgagccggtagatccgccgcttcacggcgccgcgaaggttgttgtcgtcacggccgaggggagccgacggctcgtagagacggcgtcgcggtcgtcgtcgttcatcgaggagggagctggcggcaaaggcggggaggagggcagccgatgacggaggcggaaagaaggggagccggtggatccgccgcttcacggtgccgcgaaggttatcgtctcgcggccgaggggagccgacggcgaacgaaggcggcgtcccggtcgtcgtcgtcgaggagggcagccgccggcgtaggcggggagaagggcacccgccgccgaaggtggggaggaggtgagccaatgggggatattttttttgctaagtgtgtgagggagaaggagagagagagagaaggggagggaaattagtggtggagaggagaagataaggatggtggaggagaggataacgatgactgatttttttttggaggcatgatttttataggcggaccacataaggttccgcctgcaaaaatcatatttttccaggcggaccacttaagaggtccgcctgcgaaaataaaggtatttttgcagaggtccgcctggaaaaaatgattttcgcaggtggatggtgagctccaccccgatttacatttttctaggcggccatttagctctgagggtcatacccgcctggaaaaataaaaggccaacgttgctaaaaaccatttttcctagtagtgagatgaagctagatatgaatttttttaggtaaatctgtatatgaatcttgatagaactgaatacactttcttaatgttcttcccagttaaatgcagaaaatatatggatacatacacacgtttgttgacgttttgataatagagataaactgaccggtgtgaaaaccagtatcattctatagattaccataggactttggggaacataatattgtcagatgtacatgtccccttctccttttccacaacggcttcatgcatgcatatggtccctagctatctacctgcagtgcaatgttctgcgtgttgctgcatatttggatgcgtacgtggaccaatatatgcagacagtgtgcacacatatattgtacgttcagcacttcagctagctatatagacaccaattcgattgatcactgtgatctgatgagccaatttgccactgtgcatgcagctcaaggcgcagaagatcccattaatctctgatgacttaagcttgacgattgcatgacgtggttacagccattcccgctaataataagcaccaaggtttggagctaaaatttgactttgttagagtgttcgtcatcataagcgccgacgaccagtgattagtagattcttgggaacaaaatgataaggcttgcagctagctatgcattactagctgttaagctacaacaacgcaagtagtagggtacaatctctagcttaattcgataataaattaggcattcactattcataagctagctatccatgtactcctacaccttttacaaattatgtctagtttagttttgtccataacggaagccatgtagcatgtcaactgcagaagggccagcatatgatctaggggttgcagtgacctgagtagcatcccaaggttcttaattcaaatctttataggaacgaattttagactaggttatttgagggagtaagttctcaatttaaaaggctgcatatatccgtatggtaacatggaaaatattatctccatcttaaaatgtagctatttctaatacaatatcttgtcccaaaataaaattatttctctacctacctccttctctcaactaatcacaatcattctccttcacctactttctttttaaccaatcacacactttctctaatcattcttacatattttcttaatacccgtaccaacctagcttgaaaatgtttatattttgggacgacgtaagtatattgaaagtttctaagttcacattttgcagtatttttcctaaaaaaacttatggaataactaacattttttctctaattttgagatagctatcccaaaattaagcaggggccttagaacctgggcatgcttaactaagtactatataattaattagttaacagccggattattatatacagtctacatactgtaatattcaaattagataattatttgtttggtgaatagcccacatgaatcacatggactacagctaatttctccttgaacaattatttttgtactttaggtgggtactatatctttgtgcggtcactctccggccctaacgcaacatcacataggacagaaaataatttggtgatctccgaaaaccccatcagagacaaaactataaatgcatcctcctgtatgtctgacagactaacaggacaaaataactgcattgcgatgtgttcatgaacacaatataatcatagaaaacgaaagttaggaagtatatattgagaggtttgacaaattaactcacaaacatgaggagctagtagctataagcctataaatatgtatgcattgtccgtagctgttttttttccttaataacctttacatagacttttaataatctcctacatttatctgatgtgagacacacacctatacatatgccatctttaatttgattgatgactcatgcacactagtagcactttacacatatgattctttccatgctagggcaaggacagtactggtagtactatactactatgctacacctatccagaagagtttgtaatatgaaggacaaggcaggctagacaaagatttggtactgtctcgatctcattcatcatcatcatcaacaacaaagatatgtgttaattccatccctaaaatccgcaagaaattggctcggtgtttgaggcctttagtttatgcatccctaagctgcagaaaagagaggaatgctaggaagaaagcacaaagccatataaagaacagttgtgcatgaaagacgagaaaagatgataagttcaggccgtctgaactctgtagagctagctagttagctaggaatggacatgtcagccaggttaaacttagccttaaagaaacttcggagtaatttaatcacaaggggaacttcagagtactacaatttagacatgggttaaacgggtgccgatcgaactgccgatttcagagtaatacatatagaatatagtagtagtacgtatatcgagtgtgattctagctaggatttaggtcaattttgttcccatgcatggacatatatactgcccagattaattttaaaaaccatacaaaaatgctggaattcttaaagcttcattattagatgtgttgtaaagcttgagtaatatatttatttttatgagcagaaaaatctgaggcatatattaaggtgtgttaggtatagtccacatcaatagctaattttttagagcacaacttaaaaggtaagaatgtccctccctagctagtctttttttttttgaatcgttggtccgtggactaaacatgaggctttttagatacactaacataatttcacaagaagatatatcataagaacaagatgaggaccgaactttgtgtgtcaaaagaaattgatatcaaattttatgtttttctctactatcttaaaaacacattcgttctcctctttccatcctaatcccacatataaaaaacccgctccaaaaaatggtgtaaaaaaactgaccaaccaaggcctgtgtctagttttaagaaatcacaaactttatgttagatgcagtactcatacagtaaggccctgtttagatcctccaaaatggtaaaagttttgctattttgtagcactttttgccattttggatctaaacactagtagcaaaagctggcaatttggcatttggcatttgctagtccatagtagcaaattgtgtcaaaaagtgttttgggaccactccctctcactttagtgctagaatggcaaaattttaacatgcatctaaataccaactagtacttttgcaatgccaaaacttttgccatttgccatttaccattccaaatggatctaaacaggccctaacttatgagcaagaattcctctatcaatcagaccttgttggcccatccatgtatatatattgcttattagtgcagcctttgttatagtactctctccaatcaaaaaccaaaagcttaaaccctccatatcttcctttagttaaggctattctttaaagcctggatgcaattccacacctttcactgacccatttcttcacaaaagcaaaagtaggcccaaaaaaacaaaagggatgccagggagagcagcagaaaaaaaaagggcagccaaggaaaagataactagtaaaggtggagatggagagggagggaggcaaaataaaacacatgacttctttcaagcttcttccactcctccactaataagttcttatgcccatgagagattcccttccctccaaaggctcatatgctttctccctcccccccctctctctctctctctctaaaggttgacctcaaggtgtaaaaggagatcactagctagctgagagagagagcctgtggagagagtgagcaaaagctatagagagagagtgagtgagagaaagagagatcaagtgagtgctaccttgttgcttggttgctagtatagctagcttgcttgggtggaagatcatatcagcatatcaagggagagggaatatggataggggagtcctccacaaatcatcagctctagtgggggagatgggggaaggccatggatggtggagtgtgaataatttgaggcccccctttgttgagcagcttcacaatccggcttctcttttcttgccatcctccaccaccacctccactactccctcttcttcctcctctcccctccattccttctcctccctgctgctctcgaatcactatcctcttccttctactgcgacgacaagcaccgccgccgcgccttggcacgacaccggcagccgccacggccaacatctccaggactcatggaaccatatcttactgtaattcacacacacacattctctctttttttatttatatgtttgtaattgattaacttgatattattcttggaaatggtctgtttctagaattcttctgaacagctacatgaaataatattgtgctaaaaacctcatctctccctctttacatggtcatatatattgtgatcatccagtggtggattggctagtggtgaagaggggtacaacaagaactgggaaggccaggtgctgttcccaactacaccagctgcagctgctgcagaagctgatcatgggagcaacagctacaacaacatttacagaccaccacgactagccatgggagcagcacgagtgatgatgcttcccaattggcagtggctgcaaggccgtcgtcttctccatggggtggcatccatggccatcacccccaccacaacgccttgcagcagcaagcttcctcccctaggtcttcttgcatcacctctaccacctcccttggaagcaacggcgtgctggagttctcaaacaacactttaccacgtgaggtagggacaatcatcattcaagataatcagtctggtaatttttgtttgtgtgtagattattttaggtgcttatcatttactgaggagtgagggtgggtgaaaaagtctttctttgaggaagctcatcatcaccttttggatggttagaaagagagattcaatactaatagctttgtgtgggtagataaccatgcatgaaagtttcactcctcctggaagcagttaagatagggagccatgttgataattaattagttatgtatgaaagttttgtaactttgctctccatccttttgtgtttctcctagtgcatcagcacagcatctggagcagctttcaagaaggccaggacccaagaaccctctccggctcaagctacagttaaggaactctctctctctctctctctctctctctctctctctctctctctctctctagatctctcaatgagcatggcccaatcaatcagagcaatctaagctagcactgaagcaatagtttgcttgctgaaacggacaggcatggaatcattgtaggttaagagataaggtgagatggggttggagatggaaatgatggcgttcttaattagtatgttttgcttgtgctttttcttcaggtgaggaaggagaagctaggtgatagaataactgcccttcaccagcttgtctccccatttgggaaggtacatatatatcactacatgcatgttattagtctttagcttttagatttcaacaatgggaagagaataattgtcactaggctagtagaatataacaactgagttcgttgatctggtaaagtttcttaattatacaaatgctaagtgttcaacgaacagatggttatttctgtaaggaatatatacaagaaaaaccagttggaaagacaatggataagacaatattataaggtgctatgaccacatatatacaatgtcaagtagttcctcatttagcctcttctgagatgagctgtaattttccggagaatgattagaccttgtacctaatggatatgaaaacggaaagagtacgtatgtgcccatgagtatggcacaccggcttaattattactatagtccaatacatcaatgtatatataaatttagattaatgtaaattattcttatttctaagtagtaagatctgttcctacatatataattaagtctcatttattttgttcataaaattacaaatatatatttcagtgaaacaaaaggaaaagacaaaatagaagttaatgaaatttgaggggaaactctacttgagattatctgatgcggtgatgatcatatatactccctaataaggtatctttagctactctaccggaggaagaaagtatatatattcatatatatagggggatgaatgaaactctcctagaaaaaggagaatcttgtggtgaaagaagtacttttggatccttggttttaaaccctgatgggggtgaaccgtcctgttttttaaaaaaggatccattttcacagaaaatcccaaaaaagacccggcaggggtacacccttttttatccaacgaactggggttggtctcttgaagcctggggccacaaattctcacgggcaatgggggccaccttttttccctcaattnttcaaaaaattttttcttcaaggagggggcctaccgcgaaggaaggcttataaagaggctcccttttcacagagggggattccctcccccttacgggtgagaatcgcacatatttttttggttccacctcttggggggagagcacactccttgggaggg

SEQ ID NO: 73077 - DNA, 16103 bp, Oryza sativa
atgtggggcccacgtgggtcccacgctgagtcagccgccacataggataaaaccagggttaaaaccgccgagggacctattatgaccggtttggttagttgggggacgccagatatccggttttgtggttgagggacgattttgtaattcgatgacaagttgagggaccttgggtgcactttttccttctttctatggatgggcagtttgtagggcttttctagctttcggcccataaccggccgaaactatagacccaaactgttattcacactgggccaagaaagtttgctttagtgggccacttgtattaaaattcctttggttgggctcaatgtactcggaaaaatagaaagggtgatatatggctcactagttgctaccttttaatgatgatgacaataataatataaggtctaaactaagtgtgtaatcgactattattgtgcgtttcagtatctacaatgggagcagagttgccaccaggaaaaaatatatcatattttacacttagttctatcatatttagactccattcggtactatttgctgaaaattttcctcgtttaccgtagagttttccaaaatgctaatcaatgtgttcaacttatacaaaatgagtctagcctttatatttttctggttgtattcaagatagaaatgcttaattaagttaagcaaggagtataatttaaattagttcaaatgggggcccatatgtgtggatgggccaaaactgaagcccatccaaacaaggtccaagagcatgaataatagtttagactgtatttctatataattcttatttttctatttaagtagtagatttattatatagtagtttgtctatctagttgatttatttatttgaccaatgatttgattctacatgcattaatcctacaaagttatgaaatttttatggtgggaattgcttgtttcctccccctcccccaaaagtagtaacaatttgaacctttatgttcataagagtgttttagatatttttgaaaaagaatgcccaactcgtattatagaacgattgataaattaagtcgttggtatattacagaaaaagataatattgataacaaatcgttgaactcgaacaaactcagtgatataaaatatattatctcacaagtataaccaaaaccgccctgtcacctcttcaacgcttagtcaaaagactcaaaacaagagagaaacaattaatcgaatgagccatcttataatacgaattccatgcaaaaaatccaaagaagaatggtgccacgtggcatcaccggcttcgcggaagtggctagacggaatgctcttgcgcatgcgcgtgcagcagtccagaaacgctcttgcgtgtgtgcaccaatcctcctgtagccgtacgattagaaatcaatgatgctggtgcaacggaccaatgtgtaaaattttatattcaaaaggagttttaaggaaaaaaaatgtcagatccagaaagtttgttgcccctcctaaaatgaatcaagatctgccgttcctcatatgcgtgggaaaaaaaatcctaacaaagtaaataaaaaaaatgaacaacatacatctccatatacatcgacttcccaagtatctgttcccttggaaactaaaaaaatttccattgctccatcctttcttatcaaatattattattctcaagccggcagttttacaggattgtgattggtccacatggcactataaaaactgagataaatcaagcaattactaatagaatgaaatagaagtctagaactttctcaaatctgaactagaatgaaatagaagtctgctctcttattcttcattggttgtttcaatacccaactagctcagtgatctgattatgcactaaatatatctttatgtattttccatcttactcctttacagggtcactaatagaaaaataaatatatgagaaaaagtagcattagaaaaaaggaaatattgtgttttgttttcaaaatacaacatacttcactacaatattataagatactgattacattgaaagctaaaacacagtaagaggttctttgaagctcctgtagcaaattcaaaaaaaaattcaacttatttcactaaaatatatgtatgtgccattgactaatggtcatataagataaacacatgatggtcatatagtaagcgcgtcaacaggcgcgctgattttctagtgatatctgttttataacatatagtactagtattagatttgttgcatcaatacatagaaattatacccttttttttttaaaaaaatatacatatggatagaaaaccaaggagccatttctaaaaaaaaaacagcaaaaaaaagatttaagcaccatatatagatagacctccacactctgctacatttactagtcacaaatcccaacatattttttttaaattacatggcagacacagacgcacatacaccactacagacgcaaaaccacacctacacccccatgaatgcgtcatctaacacatactttaatagatggaaaccaacggcacatccctaacacatactctaagagatggaaatcaacggcacatccctgatctcactaaaatcctgttgaaagcccacctacatatgtgtaatattcatggcactaggatttaaatcctggtagatagagtcatgcacccacaccgtaaaattttggcattaaagaaaacatcaggtgacttttatttcccttaaaattgtaacattacaatagggtagttaattgaaccaacggaaaatatttattggtgaagaaaggggctactcatcgaagaaaaaaccaaatcaaatgaccatacaaaagaaattaaattgcaaatcaacatataaagtcactttttatataattttgatagatgatggtgtgctctattagctttggcattattaggtattggtatatatattggtatgcagataattgaaccaaccgaaaagatttgtcgatacaaaattgttactagaataaataatgaaaaaaatccaaatggcaatacaaacgaaatttaattacaagtcaatatagaaatcgaaatagaatgatagtcttgcaatttacacagacggttgtgtgttctatgagctgatccatgcctttgcatgttctcaaatttctatcatggcctaaacaatttgacaaaaacaatggatttataattatctactagggtttaaatatttaattttctcagttacacaaacgggttaactagaaggcgtgctacatggcacacgccaattttctagtatagtactatattgcagctagcagcgcctagtagttgctcacgagcctctgtcttggtttgcacctgcaaatggaccgacgacgacgaccacggacgcctcttctgaccgcactgttgctcgtctcgctggctgcggcggcggcggcgagcggcgcgccctgctccggtctatcaagccgctcttcgtcggcggcgagttcggctacggcgatgcctggaacgagagcaccgactgctgcggctgggaaggcgtggtctgcggcggcggcggcggcggccaccacgtggtgtcgctgtctctggtccaggccggcatcgccggcgccgtcgacggcgcggcgttcgcggcgttcacggcgctgcaggagctggacctgtcgtggaatcgaatctctgccttctctcttccatctgcaggaggtatgtacgcatgcatccatcttcgtcagaatcgaaccaagcataacttaatttgaagttccaaaatggacaatttgatttagaattgcaaagtttttcagatttgattttatcttctgcgaggatgatgatggaattgattttattttaatctcaaccagcatgattgtgtgcatgcctatatggattctgcgggcttaatcttattttaatcatattaattacagtttttttatcagcgaaacactaaactgtacattatgaaaataatagttactattaaaatatttaaaagatatataggacagtatgttgaatattttgtctcgtgcatatataaaacaacaaatctaattttaatggttaaaatataattattattatcgtcaaacttcatgtgagattttatggatacgaattcaatgatataattggattattaaataagtgattgtgatgatcattagaggccgagagaaagaaaaaggagagaagagctgttgagctagtgggcttgggctgctttggttcgccgagctttgctagcgttaagtgcttgctggcagcaagcagcaggcctttggacattgtgcccacgttagggttgtatgataccattctttaactaaaacttgccatgttgtaggtagcaaaaaaattatgaaatttgatcaaaatttagttaaattagttcatgaaaagttggtaaaacgtagaaattttttgaaagaacccatttcaccctggttggtccgttgtcacaacccatggggaatgcccttcgaattgaaagaacacacatgttgctcttcatatttaattgattcaattcgatctaatcatacaaattacagaaacactggaaagcctttcaccaagagagcagctaagcatgtatatccgtatctattgtcactcaaacagttcaaggttattttagtgtgtacggctaggacttatcttaaaagtagtagaatttaatttgtagctcaatgattttgcattttagtttggataaatttgaaccaagtaacactggtcgaaggatcagatattcaaaggaaataagttatagaagggtaaaagactactatttcagatattcaaggctccaggccattggtgccggcgtaacatggtctgtgttggtctcagcctcgccgtggtcggccgccacaatatactgtatggccattgtttccgctactttgtttgcaccaccaactgaccaacataaatgcccaagacaactagacagcgagagttgccagaccaagtaggtcatttggtcttccgtttgcctaggaacaagggcatctatttaagccacaaatgaataatacatcctatattttctctgaaatatttgggtatgccggtgcatacccggcaccacccctaggtccacccctgatggtcccatctcgcgagcagcattagcagtagcgtggccgaatttaaaattttctatgtaaagtgaggacataaacgtaaacggttatatcagaggtgtggttcaaccaattggtttggatataattatttttggtggatgcactaaattacaagaaaaaaaaattgatacccacatgttattaatcttttacttatcgttgtatgtctacgtgctcccacatagtattggcccaatgtctgtttttttcctcgagttgggtacacaaggaaaagcattttccttgttaaaaaagagctaattgcaggttgggcaatgtatttttctagcaaagattcaatttgatcatcttttgtccaatatttttgcttaaaaccatatatatctttggataggggtgggcatttagtcagaccgaacaatttggtctcggccttcagtctttagtgaaatttcggtcatcagattcttgagacagattaatcctgaacaaaatcgaagatcgactactttggtcagtctggttcagccttggtcacaactgaactaagcgctttgtgttcacagccaaaataaaaatcactggtgaagaaacaattacaccatcgaactgactgcaaaatatgtaattacagacaaaaagatcacagaaaacaattacacatatacatgctgtattgctgtatagggctattgggctgcacagtgaaattcggccattttcagttaaccgagccatataaccagactaaatttggttagtacactttgatgactgaatttctcagtctcgttttttttccctcaatctgttcggctcggtctattttgtctacctctatatctttggcttggaggaaactatcggggtctagtggctagcagcatggttggtgagttagtcatcccaggttcggttcctcccttctacaaaatatttgggggatgtctctccctccaaatattgtttttttatatctttggctaggctatctcacactttttgctactgtctctccaatctcttctccacctccaattcctgacctccaccatggccatcgtcagctcaacccttgacctcaagctcatgatctagctctgtccacctagagctccaacgattactttctctagatgacaatagagagctgaagctcggtagcaggcctctctaatgcactcagatcctagcaactggcagggttggcaacggggtggatcagggctgggttggacaagattagccttagccttgactttctcccccaacctctggcctaaaggagaaaacagtgccaaataaagccccgcccctggtcttgctagggacctaacctcccatcaaggcctcattagttgctggcaggcaacaaagacacataaaggtggtgtggaggtgaggttggtgggcatgtggtgggtggtggtgggaggcatgtagtcaagggagccgagggaggcggcggagcagcagctgcacgtttcgtgcgatgaaaatgagggtggcgtcactcgggactgggagagggagttgttgtgcatggacatacacatcgatccttgagctagtaaggtatgtggggattagtttagatccattttatactccaagtatttgggccagcctgatattgtgggtttttctcttgtaacttgaggagatatcctcctccattgagattagtttcttggccctaggccctcatgatgtcggggcgccatgctgatggattcgcaggtgcagattttgctctcgtcccttagatgcgggtctctacacccattagggaaactgtcacccatagcagccagatttgagaaagacgaactcagcccttggttgtgcttatctgagagtccaccctctgctaagcttgatctatgcttgcatcacccaaaactagaagattgaacttgtgcaccctaccccaatgatagagctccatttcctacaaccgtgccatgctgcccaagctcgaggtccatcttggcctatgtcctcatggcccgtggattttacctctacatctgagtgccgatttgagtagtgggaacttaaggatatagtatatcgattcatgtctaactctacatttttttaaaaaaagaaagagttttgcttgccagtatgttttaacaatatgcacaataaaatagaataactcagattgttatgtaccaatttaggtgagcgtgcatttcagaagcttagcaagctctcgctttcgcacaacagtctaacaaatgaaggcgttgctgctctagttatcaaccgaactacactttcagagctgtaccttggcggaaaccagttacttacaacaagttggatatccaatttgacgtctcttagggtggttgatttatcccagaacttcttacacggatacaacggtatatctccgctctttttgttagtatccagggcaatttatccaatatttgtgttttagttttgcaggtatatgtaacctccatcaactagagtacctacaccttggtgtcaacatgctacatggaaccataaattcatgcttgggaaaactacaacaattgaagtacctgaacatgaaaaacaagggggaaaaaaaactttctcatgggggagattgcaccgaacttacttatcaacttgaccaaactggagactatacacctgggggtgaacaatcttaccggcacattcatgctctcctggctagcaaacagctcaaacctcgttgatgttgtcctctcacacaactacaatctgaaaatcgaaaccgagcttgtgagatggacaccgttgttccagctggtatacttgaatttaagcaactgtgttatcaataggcgaagcaatggagttgtgccgacttttctgtcaacccagcttagcctatccgggatcgatctctcgcattgttcgctccaaggcaggattccaccctggctgttctacaatctatctgattttgtcttgctcaatggcaatagaatggatgtcattgatatggatgggcttggtggtaacatacctcaccggtgcaggtgcttgatttgtcagagaacaaaatatcgatgtcgatcccgaccaactttggaagcatttttcagtttttggactactgtgacatgtcctccaacaggttgtacggtgggattccatcattggcagaggcaacatcattggaggtgcttgacttgtcatctaacaacctcaatgaggaaatattgccaacattaatagggaatttgtcaattctaacatctcttctactctccaataatgacctgacagggcctatgccacctttccattggaatttgggtagtttgaagcacctcagccttgagaacaaccgattctcgggatggctatctccattgctgtcgaacagcagtaatctcaagacactcaatgtgagaaacaaccatctatcaggaatcatcccggatggcctcctgagcttccaacagcttggtgtgatcctccttggagggaatgattttcatggtccaataccattggacctttgcttcaacaactatctccactttgttgatctctccaacaatcaattctctggggagataccaaattgcttctacaatgatttctggacagatttgccaatgtacttcaacgatgacccattctcaggcaatatcacagagcgcatgtctgtcgacttcacgacgaaaggcgagaaccttacctacatgggagagcctctagtgctcatgacgggcattgatctgtccatgaatcaattgtcaggcgccatccctccgccattaggtttcctgaggcagctcaagtctctaaacttatcacataaccaacttgttggcccgataccagagacattcatgtatatgcaggatatggagagccttgacctctcatacaaccacctcaatggcagcctgcctatgcagctggcaaatctctccttcctgtgctcgttcaatgtcgcctacaacaacctctctggtgagatacccttccaacaacagcttgggacattcgatgaatcggcattcgaggggaatgacaatctctgtggtgaaatcatcaacaaaaactgctcatcagtgctgcatcagaatcaaggagtgttcgacgccattgacacgtcacttgttttctggtcctacgtttttgggtgttttgcacttggattttggggcaccgtggcattgctgatatgggatgaagtgtgcaggaggagactgtgtgacttgatggatgctctaatgtttaagctgggttgggaatttgtgccttgaatcctgatatgtctagctaagagtctaggagacatggaaagacagagcaatcccttctttttttttgcacgagatgcacatgctgtcacatcctgattttcgtttcaggatttataaattatttaataaattaataatagaatttatattaaatgttctttaatttacaagtgaagttaaatgtgggaaataaaatttcttaaatctaaagcatggatggatttaatttttttattaaattctccatgattaagtcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagcaatgattttaaaagcctaaaagagaagatctaattttaatttgttaaatctcaatataaaattgggctagataaaattttgttaaatacttttcttaattctataattcctagatttttttgggatttatttgagctaaggaagtatttttaataaatggaattgcatttaagaaataatttaaattgaaaaaggtttttaaaagtcttcttttggctttgggccgaaagtcggcccaaaacccttttctctccctcctcggcccagccggcctagtccgcagccgcgcgcgcgcgttcggtcactgacaggtggggcccgcttgtcggatccatcgtcttcgtcaagccgccgccgcccgaaaccctagccgagccgcgccgccgccgctttccaatttcggccgcgtctttcccgatccagtgaaatcttttgaggggaaacgatcttctcgatctcctcttccttttctcttatggaatcatcgcctaattcggtttggaaactcgtggattcgaggtcgaatcggatcggtttctttcctccgaaccctaacctttccttcccatctccggtcgccgtgggcctccgtcgcagctcgctagcccctttaaaaggatccccggtgtctcctctacccgccgccaccctcgccttcgtctctcgccgtcggaagcgccctagcgccgtctaacctcgagccgccgtcgtcgccgtcgctccagccgtgcgccgccgccgttccggtcgtcgtcgtcgctcggggaggtcgccatcgtggtcgccaagtcgccgccgtcctcgtccgcctcttcgtcgccgccgtagaccgccggagcaccgccgtcaccgtcgacccgaaaaccgccgccgtttcttcctcgtcgccggcgccatccgttgctcctccgctgttgctttggtcaccggtgagttcgccgcgtcgcgctctacccgttggtgccctccgtttgcgtcctcgcgccgtcgttcgccggcgagcttgcgctcccgagccgccgccggtgctgacgtcatcgctgacgtcgttgctgacgtcatcgttgccgttccccgtggcccggtcgtggaccaatcgatctcgaccgtccgttttggatagggttgatctcggccgttcgtttccgtgaaccgctgccgtgcacccggttcaccgcaaaccttagccgctgacgcaataatcctcttttccttttcaaaaataattcattattgcgtcataattcaattaaaatccatataagtgttttaatccgatttaatctttgaaaattcataactaattcatttgaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaagggtcgcgagtgcgccggaagtattcaagaagattaattgaagaccgattattgcaaggcaagtcacacagatcctaaacacaatcctttgagcatgttgatcctatatttaaattctctatttatttcaactgtgcatttatttttgaatgtcaccgggtggtgtgaacctattcctttgttatggcctgtttgcattgattactctattccttgataccttgggatattataacttgactagttgacctttatatattggttcagctagatattagatatgattgcttagccatgcttagaaacattagcacattattgggataacttatgactcattattatttaatgatggtttaaagatagttcacgatggtcaatcgtgattggtcaattaattacttgcaaactaaaacttgataatggtgggttgtgagcacatggttttgagagtcgtgctcatggcaattaaggaccggttcgcgagctactgttgtgaaacattaaccgtgccaaccacaagccagcgtgggaaacggctttaccttttgtataacatgattcattgcggagcaccagactgagaagtggcggagataagcccacgggggtcgctggggagtccatgcctctggtttttgaggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtcccacacctcccataataattatggatgttatacctggtaataatttgcttagctcctggtttggagttagatctgttcagccgggtatggtgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttgttgaggactaagtgcctcataagtaagtatttatcgttttagttaatttgatgaatctgtatattaaattgtcagtttgtgtacctcggctgattcttggacgaggattttatacacaaataagttcggaaattacttgtgaatttccgggcgtgacacatgccttgcataatgcattgacagacaaggagaaaaccagagttcatagtgagaaaggcccaaaacttattggaattgtaagtgaaatacttgtctaaggacaagaatttcctttctcctatgaaatacaagacccaaagttctaaggtgcagctctattttgggggtcaatagaggctattatcacccttgtaaatttgagattttgaggtgcagagctactttgggttaatagaggctattatcacccctgtaaatttgagattttgaggtatagttctacatgtaactatgtaattattaacttatagttgtgctagaataatctgcactagtttggccaactcttcctgttttgaccttcaagttcaaagcttaattttgcgatgtgcttaggggtggatatcaatcgagctagctggcttggctcgttatcttaacgagctagaagcatggcgcactcggcttggcttgtttgtcagctcgagctggctcattaagctcgtgaagcaacacttaaaatcaatatcatctcaagtttacaaattagtaacatataaattagcaaatgcattattaattccatactttatataatcaaccaaagcatagcaagatcagtcaaaatgttgatacctatgattgagtggagctgcacaagaagatgagtggatggaggggatgagttgtgttgaaacttaaagaatgccacataccatgggtgaggataataagcactgggttggagttttagggttcgagatgggcttgggttgctagcccgctgcttgctggtttgtttggcttgcgagtagcatacgagccagttcgagctagctcattatatctaataagctaaaagcttatctcaactcgttaacaaattgaaataagttgagctgagccaatcacaagctgagaaagatagatatgcttgtagcaactgctcttaattaccaatttttaagtttcaaggtgtagttttatgatattaattgatgctttgccgctataagtagcccccttttcaatttctattcatgctcaggctgcctgagattcttttgatcttggctagaaattgggcagggaccacacttaatttgtttgaaatttctgaaattaggtagtcttcccttgatattttatcagtttcatgtgtattcattctgttcaagagtgtcactctgttcaaagttatatcttgtgtggaaaaattctgtaccatcatcaattctgatgaactgatcgatggcctcaccttgtctagttagtcctggtttcatgagcagattaatctgtgtacacggtgcctaggaaattacaagtccaaaatacttttatacttgtatgtagagttctaatatgtacactacataggaatactatcagaagggcttaagtaacaatttaaagaaacatggacttataatataatactagtacagaaacgtctaaattacatgttcatctcaaaagtggtctattaattaaccccccccccccccccccccaaaaatcgggttcttcttagagggacaaaactagtggggtggtataaaggctactcactgcagaaaggactcaacagagaacattttgctagaatctatggcaatctcagagaggatttgctgcagtgagtgcctatgtgagtgggaactaaagcagttacatctttgcaagctggtagtacaatcatgaacagtgacagcagagaaccactaattcaccttctattttctatattgatttttggttttgccttcctgcacttgggtttgttatgcttttattggaatccagagttgatggctccttacatatttatcttcactaatctaaataacttagcatgttaattcactacaatgaagaatcctgatcatacatctagatggatgaagggcgcccttaactaatcctttatctagggctgcagttgccctaaaattaatgctgcaacccaattagcatcataaaagagatcatcatatattccctatatgtcgtcaagatcagggtttacaattctgacgaaaaccggtcgaattccgcgaaatttcgagaatgtatatatatatatatatatatgtatgtatgtatgtatgtatgtatgtatgttttgatgattctaattgcatgctcactcttgttggattggttacattgatatattctagggttgtcagatgtggtctgtcacgtcctgataaatccatcccgaattaaaaatcattcgctaaaaggaataatagaattaattaaaatgcgaaaagaaattggcaaacgctaaaaatacgtacaagaaaaattcaaatgtggcccggagaatttttgttaaattctccttggtctaaaaaggagccctcaaattttacttgaattttcagagcaccggaaatatttattaaacaacaacaacaattaacaaagtttattaaaaagaaaaacctaaaaataatcctcttcctcctttgggccaagcccagcccaaagtctccctttcctccctctctttctctccctctccttctctccctcctcctcttgggcctctccccctctcggcccagctccctcctccctctctcccgggctgcctttttcccccccctcttccctcccggcctgctcggcccaggccgccttcccctcctctcttcctgggccggccgcccggcccaagccgccctgccctagccgcgccccgcccgtgcagcgcgcgtgcgcgcgctgacgccgccgcctgaccggtgggtcccacgcgccaggccgggcgtcgtccccttcctcccgaccggccgtcctctctccctctcccgtgaaccctagcgccaatcctccctcaaatccgcttgattcactcggttaattccaaaattgattagggggttttaatccccattgaatcctcttcaattcccccgttttccccccttgaatgccgcccccaatcgtcgggaacggccgcgccaagtccggccgccttcctttgccgccggccaccattcccgtcgccgttcccgcgcctcccgtggccggctccctcccccatcctataaaatgggatcctcatcccccgttctctcgttttagccccatcccgagcctccccgtggtccctagctccctccccaccgtcgccctttctctctccggtgccggccggcctccagccgcctttcccgcctcgccggagcgtcgtccggccgcgccgtcaccttctcca

SEQ ID NO: 73078 - DNA, 1742 bp, Oryza sativa
  unsure (1)..(1742): unsure at all n locations
ggcttccgtgccaccgagccaagcgccgagcgccgccgcaccgccccagcctcctcctccccaccgatgccgcccctttctcctctctccttcccccaccgccgccntgcgcaaggccgccatctccggcgcctctctcctctcgggcgcgcgtgaaggagccaaaggcagagaagagaacgagagagaaaacagagaagaaatcgagagagcagaaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctaatctcgatgactcgttatctaaaaaaatcttgtgtttgatttgattgaagtgcttgattaaccttggtagtaatgagggtttataattaggattgtgcatttcttaattatttaatgatttttttcttgaaaattcatgtgtgaccactacgatcgaaccaagtacaaatagttacgttagtcctctttgaaaagatgtagaaaatataactccaatgtagtccctcctctttttttttattacgtccaacataaagataaaacaaaggaagtaatttaataaataataatttgacaatttgttgtattgggttgggtgtgcatgaatgaattcatataaaggaggtcactaaaagtctacagcactactccctccggtttcattttaattggcgttttggacaatgacacggtctacaaaatatacatttgactttattttctattataatatatacaataaataaatgcatgtttatttttattatagtgttttgaaatacaaatctatatatgttgttctagtttctttaaagtaaatatttttaaagttattgatggtcaaagttacaaaagtttaacctcaatcttgtctaaaacatcaattattataaaactggagggagtacctatttgaaacaaaaatttgctggaattgttgaggttgattgtttaattgattaacgtaacaatacattagtattttgagaaataaaattcacaaaaaccttgaacaagtgacctacacaatgcaa

SEQ ID NO: 73079 - DNA, 3533 bp, Oryza sativa
  unsure (1)..(3533): unsure at all n locations
agtttgttgttctctagagagaagaaagtgagttataataatccccctcaacggtttcccccttgtggaggtaatatacccccagagcgtaattattttcatctttgtattacacaaggaagagaaaatgtcgccgcacataaaaaatacaacatggcgtcgtgacgagaagattttttaaaaacaacgactagttgtctacgacagaaggtgtttttctctagagtaaacacatgaacaccatgtggaaacgccatggtatccccatattataaggtctagtgacacataaataacaaggcaaatgtgtcccctcataacctctttttaaaataaagagatatattcacgagaagaaattaaacccttatccacttgtggtttttaaacaggaaaaatgtctgtttgtgtcccattaataatggccccccgttctattttttttatatggcacatccgccaaggatatataaatttaaattaatgtgaattattcctatctataagaagaaaatttggtccccaaacaaaaaatagagttcaatttatgtggtcaaaaaattcacaatatatatttacgttaacccaaaggaaaagcccaaaatagaggttaattaaatttgaggaaaacctctcttgaaaatattttaatgcgttatgatcataaaaactcccaatttagttatccgtaagctactttaccaagaaaggaggttatataattcaatataattagaggaatgaatgaaactctctatagaataggagtatcttgtggtgatagtagaacttttgtatctttgtttttaacccctgatgggtgatgaccagtcatgtagtagtaaaagaagatccaatattccagagaaaaatacaaaaaagagatcctgacatgggctaacctctcttttatgccagactgacactgcgtctgtactccttgaagccattgggtacatcagattcctacacggtcaaattgaggtccagctctttctctccctctcatttctctccatcatctctctctctcctccatgcatgcgtgcccatacctgcagagcagctagctctatcaaataatgctactccctctctttcacaatgtaagtcattctaccatttcccacatttatactgatgttaatgaatctagacatatatatttatttagattcattaacattattatgaatgtagaaaatgctagaataacttacattgtgaaacggaggaagcagaatccatgaatcataaagtgtttgtttcttggttattgtcattcgtacatgcggcaggtcgttgttcacttttgacacaacatatatacatactttctggagacagctccattaattgcaagtatacatactttgacataataacatcttaattgaaacatttcatagctagggttacaagcatgcagagattagcttagcttagcttagctccatgaaatgatgcatagtagattgatagagtaaataatattatacagtgatttgatgtgccaaagaaggagctagacaggttgaaacaaaaagaggcagggctctactatgcaccaatgcatgctctctcttgcatattacagatactaaagctgcatatgtagtatatgtgcctgcgttgccatagctagacctatataatcccggtcgatccgtgcatgtgtgtttatgtttatactggcttgtcgatctgatcgatgcagcagcatatgcatgcatgcagatggtcagagagagagagagagagagagagagagagagagagagagagagagagccaggatgcaatctttttagcctgcctgctgctcatctcatgtaaacagtgcttgctctcgcttgctttgccttttcgcaaaagcagccacacgttgtcctcccctgtgctgccacaagccatcacacaccttttcttttcttttttttcttttttttgcccctcttaattagcttcagtacgatactccctccgtcttaaaaaaaaatcaacctagtactaaaatctttatgtctagattcgttgtattagtagaatgcgtcacatcgtaatacgaggtcaagttttttttagaacggaggaggggagtaccacctaatactactaccatataactacacacttacattaaacctaattaacgaaatttctcactctagttaatatatataatctccgacgacccatctcatggtcatggatctccaggctctgagctcgccgtaccttggcaatggcggcagcagcagcaatggtggaggtggtggtggaggtggctccaacagcaagctccagcatcagccagaagccagcagggtgagtatatagctatacaatatctactgtagcttatatccactgtgcatgcatgcctgcactgcaaacgcccccccacgcgcgagagatcgatgtgcacaattcccgacgttggctgcagcagcaggggttttttttttctctcatcatcaccgtgcgtgccatatccatctgcacgccttccatccgcggttcgcatcgcatcacatcgcatcgcatctgtatccttttgcgtttggaatggctttgaattggcagctagctgggtcaacaagggtgaaagggagcgtaagtattggcagaaaatatccaggcttaatttgcattgggtcgtcgttgcatctgctgctgctgctgcaaatctgcaatagcagcagcctggtcttttttaccgtgggcaaggcatgcagatgcagatgcaggcagcttcattattgggtggcggctgatagataggagtaagtagatcatcggaatgaatggtcgttggtcgttgttgttactttgttggcgtggtccaaacgtaaccacggtccatatatataggaaaaccgttttcgtccttacttagttgttgtagcattattttctggctcatatatatatcgatatatatggttgttggtacgttggggggtcgtcgatcgaactcagatcgatcacgcttcaaattaagcccaaacacattattttaccatatggtgcaatctatcgtttgtttcttgttgtttttaaatcatatcatttcaatggtttttaaataattatcgtgtgaaaaatagacacattcaaattaagccggcacacatacaatgcatggggagtagggaatgcataatgatgggggggggggggggtaaaacacataaaatgtcattggagactactatagtagaatattgagttgcatgcacccttacgcgaggcctcctcaagccctttagcatgaaatagagcgctaaccaagatttgatctcgagatctttggatctgattgcatattaagttgtgccccaatcaattcaaactaaaagccccaactgattagaaaaagcagacaattcactttatattcgaaaaaaaaacacactctctatatatattggttattaacactagccactttgtagaggattaacaaaaacattggggatcctctagagtcgncctgcggcnatgcaagagtgagttcctaccgtgcacgc

SEQ ID NO: 73080 - DNA, 673 bp, Oryza sativa
aacccgaattgggccacatatcaactaggctaaaccctacatggcaccaatgacacgtcagcttcaaccttggcgaacacatggcacatacgtggcgaagcaaatccgtgacagaaaattatcctacgtggcagccatccatgacggataattccgtcacagctcaccgggctcagcccggcccagagtgagctgattggtccaactgtatgagttagacccaataccgtttctggccatgggcatcacagacggtatcagagccgactcttgcaacccttgtagctatacatgtatatgtgcacgtacatgggcatacggtgtatatgggatgatcccgaagtgattgtatggcatgatggatgtgcgccgaaatcgtacatatatacgtgatgctaacagaggaccattcttggtcagtttgaaaagcccaggtatagatggagttcgacggggacgtcgaatcttcgagtgtgggtgtatgtagcgccccgcaataattagagaaaaagagaaagaagagagagagagagagaaaaaaaaagaaaaagagcaaagctagatagcagcccagcccatgcagcccagtagctagccggcccaatagcaaaaaccagcccaagcatgcaagcagcagtgcagctagaagtgcagagagagagagagagagaga

SEQ ID NO: 73081 - DNA, 1498 bp, Oryza sativa
  unsure (1)..(1498): unsure at all n locations
ccatttacccaatagaactttattcataatatctaaatccaggaacacccaaaccctaacttgatctatagaagagcaaacaagaggccattaaaccaggtggtattttttaataccttggtcttcttgccacaaaagtcttctcctgaaatagtccatcctatccctaacaccctgtggcagtctatagaaatagatcatgtacaaaggaacattggtcagacttgaattgatcagcactaatctccctccaatagactgaagtcttccttgccaacaccccagtttatgctccattttattttcagctttcttccagtctttatttaagattctctttttgtcaatagggatacctaagtaagtcatgggtaactccccaatcttgcaagtgaaaatctagctatatagaagctgattctccttagcctctccaaaacaaaacacctcacttttgtcaaagtttattttaagtccagaaatttttgcatctgacaggatgtttatgttcaggttgcaaaggttgcagtgtagtgcaaggtggtttgtcaggtcacaatgcccacctcagactacaaaactttttcaaggtttgtttgacacgctagtattttttttcctgatgcaagaagcgagtggtcagtgtgcaatgcctacatagcaggacatggtcttttttcaaagaaataccggatgccgttcgtgctgtcatggatcagaaacacggaaagaatggacgttgggcagctcagaaagaacgggtggaaaacaccctggcttttctggcctgacctatccatgttactgctgggaaagaatggatgagaggtatataggtataagagcatccccagcagcttctctatctggtcctccatccctaatttgacgcataggagcgaaaaaaccacctccagcaaatgcgccatccagtcatccaaaactagcgcatgcgccaaaaccggagagagaaagggtaaatatagcgtgtctctctcctcacgccatatcacaatggccgcgctcccgcccctatccggagttccgcgacctcccctccatcatcgtcgtcgctggcccctttttgattttttttttacacacgtcacctggcacttcatttgatcagctgccttgattcccaccaacactatgccattcactcgttcatccatccttgttagattggttgtgtgatgtttttcattattgcaatttgcaaactgatctttcccaaatttcccgttttagtacgaagattcgccaaggcttttgtgtattccctaataaaagaaaaggatgaaagaaaatctcagttgtaatattctaatgctcttttgttnnnntngtggtcgacatgcattcaaccggnnnggggggggntttaatnagaattctcaaattacgtaaattgcaagtaaccaanntnaagagtatatgtgtancgtaatgtacgtttagtataataatctgctcgaagttgcacgttgtgcggtgt

SEQ ID NO: 73082 - DNA, 1358 bp, Oryza sativa
  unsure (1)..(1358): unsure at all n locations
gcgtccanatangactnactcggtcngcacgcccgcaggtcgactctagaggatccccgtcctcacaatctggcgccgctgctggagagcagcagcccgcacggctgggagccgctgaactgcacgtcgaaagggtccctcgcgtcgacgaagccgcccgctccgaacgacgacgctatccatggcagctcgccgctaccaccctggtgttggtggtggctgccgccggctgtctggaggacgtcttccagcgcctcgttgagcggctggtactggagcggattcagcaagcagtcctgtgaagagctcggcagctcacctgtacaccaaacagtggcgagttctttctctgtcagtgttggatgatctatgagggctttgacctagctaagacacctgatggaaagcaatgggcaccttgaggtaggttcagaatctgtgcgttctctgaagccggcatctgcacggactgggactggatggtggttggtgatgactggctggtgcactgggactgcaccttgaattccactatgcggttggggaacttgtaggcgtcttgctgcaacttcaccaccagcgcctgcaaattaattagcaatattaattgggtgacaagacaattatactgccatgcatctgaatcaattagtaactacttttggacgctgtccaggtgctgctcataatgaggatgtcctttcatctgtgcatcaggcatctttcgatgccattgatggcaacttgcaagtctttctcagaatttcaggtgtttaccttctgtgttggagtaagagcattcagagtgaagcagtggcttccaacgatcacaccgacaacctcatggatgcagttgaagagaaggattatcccatgcccgctgcagtaggagtaaagcttgtcgtccagaacgcactcccgtgcatgctcaagggtggtttccacaatcttggttggcacttccactggccaagttaacactgggaaaaaaaaagggggggacactgtggcgcgcggttttctcccggaggggatttgtgggggggagaaaaatattatttttttttttttttgtttgtgcgcccccacacctcctgtggtggggggggctgactcattaagtggacagagaaggttttttaaaaaatagaagatttatttgggaaaagggaggaataatattcttacaacctacggagtccaaatgggcgcactcacccaaattctccgggggaggttgtaccagggtgaattctcaaaactgaaaagcttttggtncccccccccnnnnncncccccttnnnnnnnaaggggccaggggncatangcnccnnnttnnnnccnnccaggnnnccccc

SEQ ID NO: 73083 - DNA, 1427 bp, Oryza sativa
taatcatagcttgcaactgcatatgtagggcttgggatcggttccgtcaattggtccgcggaacttggaaagaaaaacttggacggaggtttcattttccagtgagtacatgcatgatccaaaattatattgaattgaatctctaattacagttaatataaagagtatattaaatctttcatcgtttctcatgtagtgtgcaaagcaggaccagggaactaacttatgcggctactacgtatgcgagtatgcctactgcctatcaaaccaaatatgcacaacacgagagctcgatgtacgtatacataaaccattcaaaagttcattgcgtatcgatttgttaagttgtttattaatttcatatattgatacgtcattatttttcgaatgatagcgtattcacatgagtgataatctcccacacaaggattttatcacggcttttcaagaataactgatgggattcatcaacgaaggagtctttaatcccgacggtgaattctactacgacggatcgacaattcataacgtcggtccttcctcttctgacataatgccggcgtcgaagtcgtagctatatatagctaccgagcaaaagaattgtactatatacgcatgtatatatatatttatatatgtacacatttacttttgtgttaatatatattttggtaacatatatatatgcacataaaatgttaagtgatttaaattatacatatgtgtgtgtaatatttgatttacacacacacacacacacacacacacacatatatatatatatatatatatataaaaccaaccatgcagcaaacagggccatgcaaaaaaaaatggtgcaccgatctttagtcccgattggtaacacaaaccgggactaaagatggtttggccggccacgtggctgatcgatctttagtcccggttatttcacccgggactaaagatagctatctttagtcccggattcgtagtcccggttggataaccgggactaaaggggggttaccaaccgggactacaaacggtttctccaccagtgatagttggagaaatagagatatgaaggggttgtgattagttgagaagtggagctaggtgggaaaagtgaatgacggagggttgtgattggttgatggagaaattgttatattttggaacaaattctaagtgctaaaagttattatattttgggatggagggagtattagctaaacttttttttgaaaatagatcaatatgatctttttaagtaacttttgtatagggaagtgagttgggcactcttgctaccgaactcagcctaaatgcggtgataatggctttatcctcaaccggtcagtactcaactaattccgcgtgaacaaagtcggtgatcgtcatgtttataagaattatcttcaacaacgtgaacaaaatgaggtagc

SEQ ID NO: 73084 - DNA, 22742 bp, Oryza sativa
  unsure (1)..(22742): unsure at all n locations
cactcctcggtttcgccggaacgccatcgccgcgaacctctacatccgcctcgccggagttgttcggccgcctgtccctcctcgccgtgcaccggtcgaccacacctccaccacctccggcatcgcagcggcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgtcgtcgtcgtcatcctctcgtcgttcccggtcgtcgtggcgttcgtccctccgtcaagccgttctcgttcgtcgtcctcgcttcgtcaagatcgctgcagccccgtcctcgtgttcgtcctcggttccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgctgccccgttctcgtcctttcggtgtcgcccgtgcccgttgtgcggttgacgaccccggtacccgtgtaccggtgtcggtagtcgttcacgcgcgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccgtggaccgtctctgtgtactcggtctaccgtggtcctttaggttgacatgtggggtccgcatgtcaacagcgcagccttcctgtctcttccaggctagcgcttacacctgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatctttgaacatattgaatcccagtttgtaaaattatgttgatttaaattattgcattaccgctttatttaaattcccgcgttatcactgttttatttagccatgcctatttacctttgttatgaccttaatattgttattgctattatttccttgttcaccctagaataaataaaaccccaactagtgggtactctattcctggttccactagtatgaatttaggtagatgcttcgctgattaataggacaacattaggtggttttataactttagactttgggtattctcatatcatttggacaccatggaatggttggcttatgttggaattggacacacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccggataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgataaactctgaattgtatcaacttttggtgtaccttgcctcctgggacaaggaataatacacgcacgtcaggaacgcctgttgggtgatttccggtcgtgacatggtcagcgtgaaagagaaccaaatccaccaaatgcataccagtcgaagctgggattttcttggaatggactacaggcaaccaaatggcctgcttgctaaagctaaatatggggatggcactataattggtgtcattgacacaggtaattatttgggaaggcaattaattagtagtaccttatttgaaaaggcaattgataattatttcctgcatggttatatagccgttccaatttcattgttttgttgattatatataccacgcgaattgaaaaaatatagagtgtttgtttggttatccgcaccactctaaccaatgtaggagtcaatcgaccatttcggcggcctgggtaggtacaaatggggttatttcattggttagattggttggtcctagatatggtgagatatcgtttggatgagtgtatgagaagcttctgtacatataagaggttttgtttgattggcttataagtattgagttcagccatacaatatactgctagtatatactgcaagtatatatgatctaacggtgtagattgatttaattttttatttaattagattgcagtataaactttgaaagggtaattttatcttttcttcgttattctatcatcaaatcgtgctatcgtcatgtgccttgtcatcaaatggcgctcaggatgctcctcccctaatgcacgataagatccaggaacgggtactctcaattagattcaatttgaaccaaaaattactaaagtgttgttttaattttctatcaaattcctaatatatatgcccttttatatactgccagtatatactggttattgtaccgtaaaaattctctatttttaagggtggcaacaataattgtaacgtcccgccttcccccaggctgggctcgcttacatctgatagctttcataggtcaattagattcaatttgaaccaaaaattactaaagtgttgttttaattttctatcaaattcctaatatatatgcccttttatatactgccagtatatactggttattgtaccgtaaaaattctctatttttaatggttattgtaccgtaaaaattctctatttttaagggtggcaacaataattgtaacgtcccgccttccgggcaggcctatttttaagggtggcaacaataattgtaacgtcccgccttcccccaggccgggctcgcttacatctgatagctttcataggtcatagactgccctcacagaccaacacatgtcttttctacacactttgtcctcactcgtatgcacccgggaagaattttccggtcggtcacccatcccaaattgctcacatgtcttttctacacactttgtcctcactcgtatgcacccgggaagaattttccggtcggtcacccatcccaaattgctccaggccaagcacgcttaaccctgaagttctttggagattggcttccggaaaagaagttgcaatttgttgatatgagtattctattaatcctattaagccctaggccaggatgttacaataatcttagttcaagataatttagggtgaggaggcagatttataactcatggagataataataaaatataagtctcagattcagcctattaactttttaataaaatttatccaatgcttaacaagttgcttggtgaattagtgaaacaaaccggttggatggtagagttgtctgttcatgactaggatttttagtacacacgtatttatgcaaacacaaatatttcttggtaaaaaataaatttaatttatccccaactgctgctagtttatactccgtccattgcacattataatacgtttggccactccattctagattcactaacatctatataaatttggatacatatataaagcagttatatgaatctattaaaaaaacccaaaacatcttataatatgaaacatagaatgtatttgcaagtctatgtcgctaggacacatctgccgtccataggatttctacagaagagagagtcgtgctaaagtatatataattaaattctacgcactccactactacaaaaatcgtttttctgtacgagggggtcggtaggttccatgcgggccgcttgtggcggcgcctgcaaaaaccgccccccccggggcgggttgattagccgcatgcgatgatccgccatatatgctcctccaggcccgagcttgaccatttgaaaacgaagctttctctctctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacacaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacatcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagttttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgcaggctgccaaaatttcccaagtcgccatcgccgtcgtccccgccaccgccggctcctccccaaagtcgccccgccccacgccgccgccgacgccgccgtcaggacctctcccccctcgccgttgccgtcgccgccgccaggacctctcccccctcgccgtcgccgtcgctgccgccaggacctctcccccctcgccgtcgccgtcgccgccggcaggtcgccgtcgccactgcacggaactctcccccctcgccgttgccatccccgcccgccaggtcgttcccgccgccaagtcgtccccgctaccgccggctccttcccgaagtcgccccgcccctcgccgtcgccgacgccactgccaggacctctcccccctcgccgtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtataattttgagaatgtttaattgtggattgttaaatggagatttatgtttaaattgggacttatgtttaaattgggacttatgttaaattgggatttatgtataattgggactttgttaaattgagatttatgtataatttggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaaatgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaaatatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggttagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccggctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaactaaaccaaatctcatttcttctttattcattgtacagtatgcaattccacgaagctgatagaactggagcaaaggttggatacgtcgatccaacaagaatatgcaaaacacaacacaccatagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacaattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacggccgcatgcgcaaatggtgatctttgcagaccatttcgcgcatgcgggccggccaaccgcatgtgaagatcgattccgcccgtatgaaaaacgctttctgtagtagtgctctatcatcaccttaattaattgtacttttgaatgaaatagtcggtacatgcaacttgataactgtgatttatcaaataatatttagaattttaattaatttgctattttcttataggtgtcacgcctgagtcagcaagctttgccgatactggatatgaccccccgccaaaaaaatggaaagggatttgccaggttggcccatcgtttgaggccataagttgcaaccggaagtttatcggtgcacggtggtacatcgatgacgagattctaagtagcatatccgataacgaggttctttctcctagggatgtcgaaggccacggcacgcacacagcctcaacggctggcggcaacatcatccacaatgttagctttctggggctagctgcagggacagttcggggtggagcgccccgtgcacgattagccatatacaaggcctgttggtccggttatggctgctccggtgccaccgtgttgaaagccatggacgacgctgtctatgatggtgttgatgtcttatcactttctataggtggtacaaaagaagatgtgggaaccctacatgtcgtcgctaatggtatctcggttgtctacgctggtggaaacgatggtcccattgctcagacggtggagaaccaatcaccatggctagtaacggtcgctgcaaccaccattgatcggtccttgcctgtggttatcaccttgggaaacggcgaaaagttggtggtatgtttgtattaattagataaataatatatatgtgtccgacgatataatgccagctgtttgcaatttgtttatcgatcatgcattaatttgattatctccatctcatctctgacgacacttcgcaggcgcaatcctttgtcctcctggaaactgcaagtcagttcagtgagatacagaagtacacagacgaggagtaagtgtagtagctaggaaatcaatactaattaccatatgattcaatacatatacatttttttcaattaagataatagaaaaattctggcctttacctagaagtaagctcaagtcaaattgttatttcgtacccctccgttttataatttcatattataagttgtttctaatcaaagttttataagtttataaccaaatttacaaaaattgatatagtaatattttaaatataaaacaaacatattattaaaatatattcaatgttaaatttaatgaaactaatttagagttgtagatgttgctaatttttttataaatttggtcaaacttaaagatgtttgaataagaaaaaaaagttaaacgacttataatacgaaatggaggtagcgagtagcacatatatatgtcataatttggatggcaagatattgctaagagcaaatcctattgcgaaatcttcatccataattgacaaagagctatgtaaccatcatctctatataaagacatgcgtacttcatcttatcgtttgtccttctcaagtagtaaactttagtggaatcagccatatacaaaataatactacctccgttttataaatagatgatgccgttgactttttctcacatgtttgaccattcgtcttatttaaaaaatttacgtaattataatttattttgttatgagttgttttatcactcatagtactttaagtgtgatttatatcttatacatttgcataaaatttttgaataagacgaatggcctaacatgtgagaaaaagttaacggcgttatctatttaaaaaacagagatagtatatcatatataaaaacatcatgtactagctaggtagtgtataaaatgatttgctgctgctgctgctgctgcagatgcaatgccaacaatattatgaacagcacggtgaaggggaaaatagccttctgcttcatgggagagatgttgaataataagcagcagacatcataccctgatgtcaccacggcagtggcagccaaaggaggcagagcagtcatcttgccgctgttctacaccgaaacaattctccaagatgatcccatcatcactgatttggatattccgtttttttatatctttttttttgcaattttatggaacttaaatggtattcatacacacaattatcaaggagttaaggattggtattgtcattttacagttttattttctttaaggtgggaattcctagatttttctaattagtgtataatttctctcttctaccttctagaaataaataaggtggtaacttaattttagaaggatctgcaactagtacaaataaataaagaaaggcaatttcctaatagatggagtactctatttcagatgcattaatttttttcttttgcaagaaaatttaattaacaatttcttcaatcaacaagaatgttttcacctgttttctcatcagacaatgttctgttaacataacacggcattctcccaaatttgcagccggacattgctgcaccaggggtttcgattttagccgctgctcagattccatattacaaaggtgtttcctaccatttcgattctggaacatctatggcttgcccccatgtagctgggatcattgcggtgctcaagtccattcatccaaaatggtcacctgcggctctcaaatccgcaatcatgacaacaggtaattaattatctcttttttttttataacaaaaggctttgtttggaacgtagagatttgcgattatatatatttcgttcaacaatcggctcacttgattgaccttattggatttaaagaactagccaacaacttgtgattctagtttttgtgctaatacttcattcaaatggaccatatcggccataactttctttttgcggggaaggggactttgattaatcaatacaggccagtaaattcagacttaatgtgctctatttcaaatggactttctgttggaattaatgaataggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaagcatgtgtggtggagagaagagggaaaacacacgcgctcgcctcgcctcgcctggcctggcagggcaggtggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgtaggatatgcgaaaatcaatctaaggtttgcctcctactctgtactgcgccgtcgctcgtagactactccatcccgctcgctggcgtgcaccagcgatcgggagagcaggtctccggaacctctgcctttgacgtcctgcaccgggagaaggcggcaataaggtttttgggaagcgcttcgcgcgactgctccttgttcgttcgcgacggctcgccttcctcttcgctcgcgtgtttcgtgccttcgtagacacctgcgaaaagtttcgaccacgcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctgattttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctatttgtgggatgcattcttagcgttcttggcgatcgtctggtcgaggtgtatatgcatatgaccgatgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaagtaactcgaactccttaagtgtgtcttacccgacaaatttgtggctgggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagcgccaatgttgtgcacaaggcccagaacaagagtaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttatgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaaagaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaactgcacactgactgacttggtgaatgccatgttggacaccgcgggactgcctaaggcatggtggggggaggtattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtctttctgggatatgctcatcatagcattgcctatagatttttaatagttaaatccgaggtactggacatgcatgttggtataattatggagtctcgtgatgctaccttctttgagagctttttcccaatgaaggatacacatagtggttcgaaccaaccctctgaaataattcccagttcaatcataccaccagaacaaactgaacatacacatgaacttgtctctgaggaggatgtcagtgaagctcctcgaaggagtaagagacaaaggacggctaagtcttttggtgatgattttactgtgtacctcgtggatgacactcctaagtcaatttcagaagcatatgcatctcctgatgcagactactggaaggaggctgtccgtagtgaaatggattccattatcgctaacgggacttgggaggtgacagagcaaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacgagctcctaagcaatggcatgagaaatttgctanacattgacctctccaggctttggagtcaattatgcgtatccatgtgtgtattatcgccatggtgggggtcagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggaaaagatcttgaatcgctttggctacattgatagtaagccttttccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctggaaagaacaaaccattaataaactataggagagtaccaatatatataccctctccaagtgaagatgcatatactctcgtgagctgcaaggcaggttggctatgccttaatgagttatgttggctttaattagaaaagatgttatcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttacaattcaaggcgtagtccattgttcaagttgtgagtaagtgtagcttggagttctaggtggatgttcaaccttaattggtctccatcgaa

SEQ ID NO: 73085 - DNA, 692 bp, Oryza sativa
  unsure (1)..(692): unsure at all n locations
cgcgtcacnttanagacaactcagtcngcacgcctgcaggtcgactctagaggatccccgtactagtgtactgctacatgacgggtcataccagcgtactactaccacagtccacagctcagctcttagcaagatgctgctatccatccaggacaaaaggcaggcgctgtagcacacgtagaccacgccgggtttcagggttgcacatgtgtagagtaggtttgacccccggactcgccgtttcaccatgagctactcctccagcactgtagcgcaggacattgttcaagcttggggattgaacgcggacaggcatcacaggccaggagaacaatcaaaaccttaaaccaaggcttaatagcgcgcattgaagaaacacacctaatgcaagaatagcattgaaagggcaacaacagatcggcgaagcatcatgcaggccatgcattatttggaattgaagcacttgccgttgggaccagacagtccctccagcttgagctttggaggaggaaggggaccaatggaccattggtcgcgcagcctgggatggttgccacagcttccagtttcagtttcatctcctcttgttgctgctcccattatttggaccacaaaaaggggaaaaaaacatgcaggtgctagaagtatacgtatgtatgtacatctatgctgcacaagtagcataaaaaaca

SEQ ID NO: 73086 - DNA, 8243 bp, Oryza sativa
cgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaggatatgcgaaaatcaatctagggtttgcctcctactctgtactgcgccgtcgctcgtagactactccatgccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgatggctcgcctttctcttcgctcgcgtgtttcgtgccttcgtagacacctgcgaaaagtttcgaccaagcagcaggtcttttcgtcacctcggtacgtgttcaatatgttgcgcatatttgatctgttcatattattctgcgtagtttacatgtgtagatctaatgatgcgttcatgctagttttcatctgtaatatcatgatttatttatagaataaattaaatcattatatgcccataatctcaacactttcatcaccaagccagaaccctgatgcttgccccgaagcaaccagcatgcagatgccaacttaattatggctcactatgttttgttttctctgcacctttttcgttctaacagctagctagctaccctatgtccctatctatcgaatagtagcaccaatttgatcaagtactaagaaaagaaattccacacctgagcaagagataattaagatgttattatgatccaaaatgtgccaatattgttctataatatacttttgttttcggatgtcgacatagggtcatgcacatcatgaccaataattactgaccgatagcagtcggggaagatctacaggcaaattatccgtcaatttaacattctgacataaactagctttctttcatcgacaagcattctatgggcaaaacttaggcagcaatctatctattagcaacacgggatgaagattatgcttgggcgtgggtacgggtggatgtcgggacagctcggctcggtctagctcgttaggataacgagctagctcggcttagctcgttaggaagctagctccactagtacagatccttctatctgtgacgggctctaatatgcttagaaatagcgggccgtcacaaggaagtcatctcaatcgggccgaaaagtgcccgattgagatatagtcgtacagacatgttagatgggtataaaacttaagactgtcacggatgacatctatcagtgacgggccgtagtttaggtccgattgagataacattccatatctcaaataggcctaaagttgcgggtcatctgtgacgggcactaactttaggcccgattgagataacattccacatctcaaacaggcctcaagttgtggcacgtcacagatgaccatcatccgtgacgggccacaactttaggcccgattgagataacattacatatctcaaacgggtctcaagttatggcatgtcacggatgatggagtcacggatgaccattatccgtgacggaccacaacttgagacccgtttgagataacaactaggcccgtcacagatgactcatcagtgacgggctatatacttaatctttatcgggtattaactaaagcccgtcaccgatgactatttttctatttttcatatgaaatgtttatatttgtaagttgactatagcaaaataattaagtacagtataataattcattttatgagtcaaaataattttatggtagtaaatgatttcaaatggaaaaaatatcaacaacaaagttatataacttatcaagatttataacttttagtttggtcatgtttctatataacatttttttgaacagtttgaatttgaatttgaaaatatgacaacttcaaacaacattttcaaatactaaatgatttcaattgaaaaagtcattaacaacaaagttgaataactcatcaagatctaaaacttttatttttgttatttcttcatccgacgaaatgttagtaatattattaacaaattttacatatatgtgttatagtttataaaaccagataagagatatgtcaattttgtgaacagtgttactatcactttgtcgtatgaagaaatgaccacaataaaagttttagatcatgataagttattcaactttgttgttgatgactttttcagttgatatcatttagtatttgaaaatgttgtttgaagttgtcatattttcaaatttaaattcaaacggttcaaaaaatgttatatagaaaaatgaccaaaataaaagttatagatcttgatgagttatacaactttgttgttgatgactttttcagttgaagtcgttcactgatctaaaattctatttgaacttttcaaaatttgaatttcaaatttcaaattgtttaaatagagtcagatggataaatgaccaaaataaaaattttgcacctcgatgagttatacaactttggttttggtgacttttctatctgaaatcatttaataatcccaatttgacatcctggcctagggcttaataggattaatagaatactcataccaacaagttacaactacttttctggaagccaatctccaaagaactttgatgttatgactgaccgggaagcgtgggtgcacactaaaaaataaaatttatttattaatttcaggatgggtgactgaccggtaagcgtgggtgcacatgagtgagggcagggcattaactatagccatttctggattatccgcgtgggtgcacacgagtgagggcagggctagccaaaaaataaaatttatttatttctggattatacttatctgtgacgggcattaactggctagccaaaaaataaaatttatttatttctggattatactcatctgtgacgggcattaactatagctatttctggattatccgcgtgggtgcacacgagtgagggcagggctagccaaaaaaataaaatttatttatttctggattatactcatctatgacgggtattaactggctggccaaaaaataaaatttatttatttctggattatactcatttgtgacgggcattaattatagccatagttaatgtccgtcacagatgagtcatctgtctgtgacgggctatagttaatgcccgtcacagataagggtcatctatgacgggcgctagttgtggcccgattgagataggtcatccgtgacgggctatagttggactggtcgtctgggtcaaagctatcggtgacgggctttaattagggcccgattgagatagattcatccgtgacagccgtttacccgattgagataactcttcacatctgtgactactagcctgtgacggatgccgtgcccgattgagatggtgttttaccacccgattgagatgatggtatcccttctagtgcttgttatcctagcaagctatcggcacggctcgttgtctagctttaaccggctcgtttggctcgtgagccaatgaagtcatgaatagtactggcaataatctgcaactgattagcatttcaagtatagcagcatcatccaacaaatgaacatataagggatttgagcgacaatttacagacatgcaggatcatctgcatgaatcaatatatcatgcaaaatctcagaacaacaacaacaaccaaaaaagagaagcacacagtatcacaaactcacagtagctgccattctatatttccaatcacgatagagaaagcagtacataatatgctactggatctcattttcctcctccatggcggataaggacacgccggcgagcagcgtggacgtggtgcgcggtgcgccatggccttcggcgacgggatggccaagggcgtggcgctgtggggacgggcgacggcgccgcagcccatgggatggtggtgggctgctggcggcgctagggagattgagattgggcggcggcgtggtgataggaatggttaccatgggttatgggctagatcgcaaatgggcattgttaggcttcctctagactcctctgtgctgttgttatttcttggctcatttagctcgtgagcggctcatgagcccgcttgaccccctgctcagcacgctaacaattttcaacgagctgaatcgagccgaaccgaccatgaatcgagcgagctaatgagccacgagctttctatccacctccatgcgtgggagaatctggagagcaaagcgtagagaaacaaatgccctttcctgaacctgccgacacacgtatggcttcacttcttgctgccccactcaactcctctaccgtctcttcatgtgctatctgcctctaccacctccctcctgcttcggcgaaattttctaccagcaaaggtttgtttaaagatctgtgcactggtaagagtttatctgccgggaagcttaaatttagtggccaattggtctgtcgaaaatgtctttttctgttggcaaagaattttattgacatgttctttcccactcacttgtttcctattgagaaaagcctttactgacaggccgaatgacatcataaacacataacctttgccgacaattgagctgttggtgcatttaggtcatggtgcagtgatgtaatgaagtttccagtctaagtccaccaaacacacaagtatcttggacctccaaatttaactttttcctgttttctcttgttgctaatcccctggtggccactcgccaagaaaatatgttcatttgatgatgtatatattgagctaataacattctgaattctgatattttatatttcaaaactttttgcattacatatgacaacaacgggatgccaatacaagctaatggaagagttcaaaagattgctgatccttttgattatggagcagggtttgttaatccggtcatggcagctgatccaggccttatctacgacatcaccgcatctgattacctcaaattcttcaactgcatgggaggattaggctcaagggacaattgcaccacagcgaaaggatcacttactgacctgaacctcccatccattgccatccctaacctcaggacattccaagctatgacacgcactgtcaccaatgttggccaagttaatgccgtgtatagagcattcttccaagctccagctggtgtcgagatggccgtcgagccaccagtgctggtgttcaacaagaacagaagagtgcagagcttcagggtgaccttcaaggctacacgaaaggtgcagggtgactacaggtttgaaagcttggcgtggcatgatgaagcaagccactgggttcggatccccatcgccgttcgcatcgtgattgaggagatctactccaagatctcctaattaattggatattggatatatatgctagctactaatgatgctagttgatcaatggtcgaatggaataaatgaaggcgaattcatatgctccaatatatagcatgttatatgtgtttctggaatcttgctgcatcttattccaaatccaagtggcgtatatctgttaaaatttatggttgaataatatatctaatcttgtgttagatgtttgtgctgaataggggaattaccatgtgatcaaaggaatcattaaaacttgattattaatatgtacggaaataatccctgcaaaaaaaatatgtatgaaaataaataaaaaagggcatatatgtttcgatacattgtgttttctcattctgaattttagactttgattcgaggattagttttaaggattttcttagccactttcgtgatggctctttttttatgaccattaataagtaaacaatctatgtataaattaaatttattatttattaaaagtcaaactttgagaattcagagttgctttggattataatactccaatactgtgccagggttataatagcccatgtaggtaacccacagtccaaccaatgggacatctcctatttgccatggctcaatttggaggacaccacaatcaattgatcgaagggtccttaatcccttatttgttatgtcatcaagattgacagtctaccctaaagaggcagaaatctgcatgtgaattagtactaccacaggctgggagtactgttatttttgcccattttgttggaagcgaatgtatgtcctacaattacaggcttatcatgtgtgatgcctgccatgtgcaggcttatcatgtgcgatggttgccatgcttggatagattgtacctctctttggcatatatgggtggacctgatttaattatggacgtaactactacacagctagtggtagctgttttgtctaaaccagctaccactccatctataagaggcaccatccacctatacttcaaatacaattttctcttaaactactcatccgatctacgatccgattgcaccgttgtgttcgtaacaattaaatctttagaacaagatctcacatgattatattttgatgaaaaatcataaattacttttatgatatgtctaaattacttttagttttcactaagttacttcttagatatataaaagtaaatttagtaaaacctaaaagtaatttacatatattatagaagtaacttagaacaaaaccaaggtaactttggcatgtcatttgaagtaaatccattgtagagataaaaacatgactctatctataaattaaattaatcagtataaattatggaattaactaaaataataataaaagtaatcaccttagagcattatgaattttcaatgaaaaaaatgcattaattaaagttactttctttttttttgttataagttacttctattttatatgtaaattacttttaggctttactgaatttacttttatatgtctaagaagtaacttagtgaaatctaaaagtaatttagacatatcataaaagtaatctgtgatttttcatcaaaatataatcatgtgagatcttgttgtaaagatttaattattacgaacacaacggtgtaatcggattgtaaatcggatgagtaatttaagagaatttttttttgaagcatagatgatagaatatttcccctacttgctcaatggagtaagtactagcacgtgggtgtctctggttaagactaattggagaggcctctccaattagatttaccgtttaattatgttaccttccaactttactttttttttctctccacgttgttgccttccatcgaaggtccttacctacacaaggagaggtctctgcaagtttggattattaaaatactcatgtgcctccttttcttggagatttaattatggatattttttttaataatggaatttattttggcttttgtttcaaagaagcacataacaagatgagatgactgtaataaccaattattacagagattgcaagtgagatgactgtgaagtacataacaagaaaacttcttaaactaccagcctaaagacattcatccatagttggcaagaatatacataaccgttagtttatctcagcgacttgcaaattttatgtagtaattgtctttctcaaatcaggaaacaaaatcttcgaaataacagccgatcattagttatgctgattaaatttctctcacatcaccgctgatgagaaccccaacaaaagaaatatcagagagtaattagtcattctcccaaatcttgccaccgccataacaattgaaaccgatccagcgggacaacggcaccaagaatgccgcaccaatgggggacctctaatacaatgcctccaaggtcaataacatctaggagtccccatagttattccaaacatcgggaattaggtcttttcttttcccacatagagggtggaggcccatgctgctgccttcttaatttgtccatctgtcgtaaaatataacaactatcaatcaagattcatcccaaaatatatcaccttcttcattaacattctctttcccaaccaatcacaattcttcactattcaatttttccacctacctctacttctaaactaatcacaaccttccccatttaattctacctacttcattattattcatgtccaatcttaaagatgcttatattctaggacggaggtagtacctgatatggagggctagtactaggtagcatatctatgggccaataattaatatcttagtctggaattaggagtatactcctactttgcgatgacatttta

SEQ ID NO: 73087 - DNA, 1193 bp, Oryza sativa
  unsure (1)..(1193): unsure at all n locations
aatgtttgatgcatatatgcaggtttgaaaaacgtccatgtcttcatcaaggaggctgatcttgtgaccttgcctgcagatgaagtttgtacaatgacatgaggtgtttcatgttgctactggacctgtaactgttcttttcgatattccattcctggactagagaacctcaatttcctaatatttaaacttcatanacgaaatataaacttactcatctcatgtttggtagctactacaagtgaccttgctgtcaacattgatgccaattttggtgtttcggaattgttccatcccaccttcttctcttaagggtatctttgctttgtgattggngataggagcaaaagcacatctgtattgcaaggaggaagattatggaatatgtagaattaaaaagagagggtgtaccgaactacttatctaaaagcttgcaattgcgcataaaaggaaagaatatataatggccaacaaggagcttcacttttgtgtttttaagagacctaccaaattttctccatcaaaaaatggtgtgacagttggtgccgcgcaacttgaaaagacttgtttaaaaggtcagatgttagaaaccaaataccatatctttgcagactttttttaacattattctgttggttatatagatgatggtgtggctggaaagcaagttccacactggaacctggggaggttgaagaatctaaaatgtggggaaagagttttgctcaatactctcctgagttttttgtaccagccacgtcttttggggttccctagaattatttaataggattttggggcttcttagaccggattttggaaaagtattgattacaatccctgggggggcggagaaaaatataataatatttcttttttttataaaaggcctttaacaaattttgttccaaaaactaataatatatttctttcttaggaggtgctttaaaagagaatatttggggatataaacaaaaaataaaaatttttttctccacaataatggggagaaaaagagagggtttnttttttctttgggcttcctccacccacctctctttttttcttttgggtggccgaaaaaaagggaaganataaccttgggttataccaaggagcgtgttgggttgggttatcataaaactttctacaaaaaatgtgaaatacagacgggccccaaccccttttttttt

SEQ ID NO: 73088 - DNA, 2778 bp, Oryza sativa
tgtacatatatataccgttttaattcgcattgaaaaaagcaggtgtccttagcttgcaaatcatatatatagctcgccacaccaaacacttgtgcgcgcatgctccaaacttgtgggcaacccaaacagctactagtaatatatctttagtctttacacgccgacgccgatgataatatacgctcggaattaaacacatatatgaatggaccagtaataactcattaatatttaattacttaagagaactgctgtgaggtcgagaaggtctggccgaacgtccagcccgccggggcgacgtcgaggaaggtgagcgtctgccgtcgctgctggtgaccttgaacgacaggctctggccgtcgaggtaggcgttggactgccagttgacgccccaattcctggacatggccatccacccggtcctcgaccccttgatcgacaccgactggatggagccgacgccgccgacgttggaacgagcaccagctcgaagtagtccctgccgttgatggtgaacctcaccccgccctgcttggcgcacggcacccgctggtacatcaccggcacgatgccgccgacgtagacgccgatcttgagccacgccggtcggccatgtcgaagtgctgccgcggcgggttgcaccacccgccggcgtcgttggggagcgcgtagttcggcgggcagaggttggtcgccgtgatggtcaccgacgtgccggagatgcagaaccgcctgtccgcctggtagtcgcacatgatccggtagcactgcccgcacgacgccccgtcgttgaacagcaccgtgctcagcgccgccgtgttcgtcccgtaccccgtcgagtacaggtccccgtacccacacgccccacctgcacacacacacgacgacacgcatgcacatgaaccaacgtcaccgattgcacgatggatccattcctagctacagtagctagctagctacgaacttacccatcgttcctgaagcgtcactgccgccgtagaaggtggcgaacgccttgttccagccggacgccgtgaacgatgcggcctcgttccagaggaggcatgtcgccagcaatgccaggaaccgagcacacgacgttgcggctgacgagccggccatgtgtgcgcgcgtgtgctgccggtgaatgtgctgctaatggccaaactcagaaggcaggtagtgtcgcttaaataggcaggagagctgtagataacacatgcacgcaagtagtagctagttatttggttcggtgtgaggtgtgctgcatgtgggcagcttctcgggagctgacacggacacgagcgaggggtgcgtccagatcggtcggcgcatgggagattctatccagtcggggaggcgccatgttcgcgtcaataaactgttggtggcgcctctgacgtgtgtcgtctaggggtcgcgcgcgcgcgggtcgggtcgatcgatgatgctgcgttgcaggttccaaactgtcggcgctcgctcgattgatcgatctggtcccggtgtagatctggccacgcgcggtagtacactgtgtttttgctgttcggcatagtgaaattcggctgcttctgatcgagtgttttcttttttttcttttggcggtgattgtgcgtacgtaacgcaacaaaagtgctcctttgggagtatacgtgatgtgcaggtaatatatgttccgaccacgtcccggtatataaatgcgacggctaaataactgatactggataatatagttagctcaaattatctcgagaagaaatttatatgttgtcatgttggcatggctaggagatatataaacatgttacatgtcgttctgttaaaacatgtcaagtagtatttctctaatttgtctgtggagaacctattacgatttttatctaaattattgcacatgtgtggttttgtttttgtgtaacgatcaatgttaaaacttcgctctcccatggcccacaaggcttccatttagttgtgtcggtcacatatatgataagatccggttcttccaatccagatgaacttcatcattgggagcttgggtcatggagctttcgcaggagtttgatgctacatcaatcaacaagtacaagatttaacccagtcaaattaatacgatagaaaaatggattactgtgttaaaaaatggaaaatgaccatctttcagccttaatttcatgctgcgtggtcatctttatcctgtaattatggaatattccaaagttttcattttaatcctttgaaaaaatatcccttcaaaatattgttttaaataatggaagaggaactctaataccaacatggcatccccaactgtagttgagttagaacactatgggtctgtcgaatttaaatgcctaaaaaggtctaaaatatcagcttataaactaactaggaattcaaattatgaacttataaaaagctagccaatccatgaaaaatcaactttccagacgataacgatgactgaaaaacaagcttggctatttaattaattgtcgttatcattccatctcatctttcactatctttcgcaggttacccaaccgccataacaatcttccccattcatttccctctcactctactgcagccacgctttttttggatatttaactatatagttgtcactcttacaaaagctaactcttcaaataagtttagtcctacaaatttgccaccagagagaagccattttttccactgtgaagtgatatgtatgcttgctaacaagctggattttttacattttgatattttttttacaaacagacttct

SEQ ID NO: 73089 - DNA, 1659 bp, Oryza sativa
atggacagacacaagaagagaaaccggggaaaactacttaggaccgagaattactttaacttttattgatcttaagtgagtttcgttattacaaactgaagactctcacaccactaaactcaccaactacctaacactcgaaagcaaacaaacgcacgcacttacatcccaccactgatgtaaatcacatgcgagacccacacaaccaaacttaaacaaacaagctaacacaacgatctaagataacggcttgacaaggcactctaggtcttccgggcatcggagttgatgaaggctcgttcggctcgtcttcatcatcttgagttgctccccactcgatcttggaataggtgcgcttcgattcttctcctttatcatcacttacattgacgaccggaggatccgctagggctggggtaacttctttctccaccacacggacctttggcgccaattggtaacgagggacaaatagagctctcttccttgcggtaaggcgaaccctggcctttagcggtggggcttctcccttcaacgcggctagttccttctccaaacgatccaccttgtcttctagcttgcaaatcttaccacgattccggtcttcacgatcttgagccgctaacacagtctccgcacaggtttcatccatagcccacagcatctcaaccaaatgccttgtggtagcatcattctcaattccttcagtctcaaggtagctgccacggtcactcccctgtggttggcgaggatggtagcgatactcagtgtcggccaactgatcactatagcgatcgcggagctctcctatggcgattcttgccacctcctgacatgcatgaatgtagtttcttcctccagcttcgaacatcaccgaggggatatcttcactattactattcaaggtgactttgactcggcacttttcttcgtgacgatcatgaggaatctgggcataaaaaggggcagtcctaaatcctatggcaaaggacatcgtacgcaactcctggacaaatccctcaacaccaaacaagtactcaggcttgtagcgcggcatctaaaggcaagtgaaaggagggagttaagacatttatccaattaatagcacaagtttttggattaatttgaataaagttagaaaatcaaagtaaaaggtaagtaaataaagtaaaccaatcttgcaagataagttgaaatagttggaaacaaggtcataaattctgtacttttgaacaacaggttctaaaagaaataaaagaaagttataaaatcaacatgctaaatttatttccttgcagcaagattaaataaaaccatattgtagaacttttgctggtaaatgtgccattagtacagtaatagatgtatagtactaacaacgctaaaataaattttgaacgggaaccactaaaaaaaatattaggaaatgcatgtgccattagtttggtttaattaaaagagaaggagaggagaacagttctacttttccaatatttttagagggcttctatgggtaaccatttggcataacctaaggtcaaaggggctctgataccaacttgtcacgcccggaatttctatccaaaattccaaacgcttacatgtgtgtgaaccctcgtccaggaatcagccgaggcacacaataacaaattgataata

SEQ ID NO: 73090 - DNA, 9803 bp, Oryza sativa
aaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttacattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttaggacccttctggtgtctatccattctctgtattgacatctccttggtggttcatgggaggaaagaataggtgtaaagcaagcaaagtaagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccaacgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtgggtgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtggggaaaaagagagcaagactgagtactacccactgtactcagcaagtcataccggaagaggaggtatgatgcaggatataaccaaaggaggctagaggttcttttgcataaagctagcatttaaaaacagtagttgaaggcagtaaaacagttgtagtaattaatcaatattaaccaaacactgtccaacgctaccccacgttgcaacaggcccaaccaaccacctgaactacaccagttcattaagctaaactagggatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatacttgtaaattgggtacaatatgatcaaacgtattgcatgacttgccttgctctcgaactgatgggacctcagcaacgtcttcgagaaacttcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataagtcccagggctgacgtcagcgaggggagggggcggcgccgacaggcggggcccacgggtcagcggctcaaagcggccggtctaccgtggaccaggaccacgcgggtggtccaccgccggtccacgggaccgatggtccggatcggccgaggggccgatcggacggcacggcggcggctaggcacggctcggctcggcttcaaaaccggccggccggccatggcaaccggcggcgacgcgcacggtcgccggcgacggcaatcggcggcgtgggaagcgacggaggacggggcgaaaagcgacggcagcggctgaaggcgacggcgcacgcgcgaaggacggcggcgcacacgggagagagggaaaaaaaaaagggagcggaggggagcctcaccggcgagcacggcgaccaaagcggaggatgaaaggcggcggtgacccggcgatgctgaggtgcggacgggcggcggcggcacgctaggagaaaacagagagggggttaggggtagggagagcgaccacggcggctagagcggccggccggagttaggtggaaatggagagctcaccggcgtgcgagagaaacggcgctccggcgacgattggcggcaaccgaatggtggccgaggtgcaagcgggctcggtgagcgtgacggtggcgactacgcggcgcggcggtggctctagcggcggcggcgcgcggccggagatgggcggcgggcggcggagctcgggtgcgcggcgcgagggcggtagacggcacgggagagtgcggtgaaaagaggaaaaaacgagagaaggacgcggggaacgatttataggcggagggggaggcggacgtggccgggaacccaccctattgcgccggcgacgtggaaaggtggggggagagagagagaggggtgggattcgaaatcgaatcccgccctctcgagcgcgcgcacgggctgggagatgtggggaaggtgggcggcgacgcgggcgcggagtggggcgcgaagaggggcggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggagaaggaacgggccggccccaggaaaggggcgccgagcgcggggagagagatgggccgacggcccatctagagaaaaaggaaggaaaagaaaagaaaaagaggggaaggattttcctgggattaaaattgcactttggtgatttttaattggttaaaattatttccaaggctctgaaaattccactaaaaatcttgttaatgcattggagcatggggaactcaagaaaaattccaccacgccgaattcaattattaattgcatttattaattagggaattagctctaggttaaataagataatttcttcggacgatttatttagccaatttttaaagcaaggagagggggaaacttcagggtgtgacagtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcacatataacaacaatgtagtcattacacaagcatacagtactggaaagtgaagcaagtaaacaaagagaagactgctctactggccctgccccgcgccgcgaccatgcttggtcctccgggcctgtgctcgcacgtggtcctgggagtaggtgaaacgatccggtggcacagcacgggtagcacgagtgtcccgcggaggagtggcctgcgcctagtcttgcgtctgcaccggcggtgcgcctcccagctgtgaggggccgatgacgtcctctgtcgagcctgaagtgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcttgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatatgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggttggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacaaagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgagacacctcgcctaccgcgacgtcagcgatgctcctggcgtagtgcacaagtcccttgtcgaccgcgtgcccgtgaccgccacagaacatcacccagccaaaaagccagagcaagtccgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccaccttttcgtaggtccggtgttgcggtggtgtgccaacggctcgaatgggaggtgcggtgcgcgctgtactagtgcgaaacgtgccgtcagatcatcctgccagtccacagccgtggtcactggcccaacagcgtctcccgcgagcggtagccccaataagtacgatacgtcctgtatggtaggggctacctcaccgcacggcaagtgaaaagtgtgcgtctctggcctccatcgatcgaccaaagctgctaggagggacctgtccacagtccatcgtctggccgggtccgcgtcaccggccgcagcctccaccagccgacacatcggtaggaggccggcctcacgtagcctgcaataacaaattaatatgtcattataaaaaatattatagtgcaactaacttatagtaaaacactattcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacatgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataaaaactacaccacgtagccagacgtggcacgacgacgcctaggacgtggtcgagtggaggtagtgccttcacccgtagggcgagctccatctgctgctgatcctaatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcattgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaacttcctggaaccgatccctaaaatacctgcatgttccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctatacatcttcccaaataccggggtatcctcattccatactcccaaactgcaactctcctatcgctcacagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacaacagttcacgaatgccatcttgcatgcatgtagagctaagaacgccctttgcagcacactcttgtcaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgc

SEQ ID NO: 73091 - DNA, 1141 bp, Oryza sativa
  unsure (1)..(1141): unsure at all n locations
tcaaaaaaaaaagaaaaagtaaagctactatactgtagtcattctgtctaaagctcagatatatgttggacagtaaaattgtaaaacatgtcactgcaatgtattagatggtatgcaccacagctacaacagacatgattctgcatggtcacttacaggaatgaatgaagtggtatgtacaatccaacgagcacttccagaacttaagcaaaaggcaagacttcaggaccatcacctctgcagcaaaaacatgtttccaggtttccaggatgatcagcagcacaagtttggctagcagtgtcactgtatgacacgatagctgacataaatcaatatcaatgtacaagaacatgaacatgaacttcatggagcgtggacccgtggaagagaattccaaccaaagcaaaagctgtccttgttagaatactggagaataataaacgaaggacattggaaagaacctttatcaaaagataaaagcgttcaaagagagaaattatgcacccgcttttgatcaaccatttctctttcttttctcttcattatatatattatgaacaatacacaaagatttagccagaacttaacatagcctgataggccaaataaaaaaaaaggttaatggcctcacacaccagttgttgagatcacaactcaccacactgagacaatcaattgggtttattgtcactcattgctgtactcgaaaaaaacctcgcaatctctcatgacaaacactgaaagaaagccaagaaaaaaaaaagcccatgaatcatgtgggaggcctcatttgttccacatggtttccatttgttgagaggcctttggttttgttccaactaaaggtggcgcccaaactatttcattgaggggttttttcaacaaacggatttgtaaaaaagagggggggggggggctctctcctttgggaggtataaaaaaaaacaaaccttgtggggaaaaagaaaccaactctcggtggttngcaaaaaaaaaaaaaataaataaaactactcctcttttcttccanacgcttttggggaaaagaatatttttgcagaagttttatggtttaatttcaataatatatatttctctttaaataaaattttgtgtccgccccctttttataaccccacac

SEQ ID NO: 73092 - DNA, 6593 bp, Oryza sativa
ttctccagtagtgcaagttatagctatttgtattagagtttcgtgagaaacttgtgagaggagtgctattattgtactttgtaaatataaatagaagcaataaagttcaacatactttcaagggtacttcgatttgtgtttagtcaggacgggcggtcataccggcagcaccactatgcttagaccggcgacacaaaaagcggatagaccagcacaagacctacagtcaaactaatctccatcgaattcgagggtaacttttaattccgctaaaaagttttgttttttggtgttccaaccattcacccctctagtcagcttagttcttactgttcgatcctacaattgggagtgctaggactcctctcacctcaggcttgaggtagggtttggcgccagggtgcatgagggctcatagtccttatgcaagggtaaccgaaaaatcagactgtgacaagtcttatgtgttgggtgcggcacatagtgcgggcttcaaatgaatctattcgaacagccgtgctcgtggttaattgagcgcctggacttgtactattattgatttgcctcataagttctaatcttgcttacaataggattgggaggaaatgtgtgaccttgcccaacgtgcgggaaggtcggaatggtgggaaatgcttaaaaccgaatgatagggtaaaccggaccaagcgagacttggggaagatggatgaaacctctttgattaacaacaacttcaacttaacgttgtttttagttaaaactgctaagtcataagttcatgaactgaattatgaaatctagcttttatgcaaataagccgagccatccttgaacccatgtgtgcactaaatgcatcctggagtagtgacttactaagtacggttttttgggggggttaacccccctaccccttgcttacttaactcttttagtagaagatattggagtcgattcgcacgtttgctatgttgatgaggaggtgtcaaagacggttgagtagggacctaggttctccagtcgttgcatgtggaataagatggactgccgttgcttcgcttccgctacttcttttggtatttggtaatgtaattgaccatacttggtctatttgggtcccactcgggcaacccttgtattattgatgtattgtaaaacctttataacgatgtcagctatgtgatatgtaactttgccatgtgcataccatcaaccgatttagggaatggtactgtaaacacacgaggttttcggtgtacaaaactggggccgacacgctgtcgctccagctcatcgacgagacgctgccgctgcccactcctcctcggagccaccaccgacatccctcctcgtcgccgagacaccgctcccgcccctgttccttggagtcgctgctcctctgcttggagccgccaacgcgtgagagagagagagaggaggagggggagggggagggaaatgggtggaggaggagaggataaggatcggaggataaggatgggacttagatgtttagtttaggctgatccacaggcatgatttcataggcagctttgcaggcggaccacttaaatcctccgcctatgataatttatatattttcgtagacggatgtcttaagcagtccgtctgtgaagatttattttggcagacggatgatcatcccatccctcacttaggacaatggatgctgtcatttgggggtaaaatttcggtcttcctgtaaaatgacatgggtctcgtcaacgaaaatcatttttctagtagtggtgattggtcacttgcatgagttcctggtttgcatggtcgaaaacttttatcttatgctattgtagcctaccaccagttaccatataaatttctgcattcagttctgcggggtgccaaccctagtaatctatatctagtccattattgctttgcttcttccttttttatcttgatttggtggtccagaaatctggattatgtagatggagggctgctataattcttgcaacccgtgacaaatcattcaacaggtatgtgcgcgtcaacgttcacagcattaacaaagtagcgatttactgagatgtctaaactagaaacaaacctatgacaattcaacacgatgtagctaatctttccccagaaagctagtaaaagcattgtttttcatagcctggagaacattgaaattgatcgaccttgtgctgtgacgacgtcaatttgaaagattatacgacgacgtcaaatctccgaccgaaaacaggaggagaggggtaaatggatgatcgacctgcccgtcaaaaagttaatagttttctgggtcctgtcatatatattgctgaatgacacacacacatataaacaaaacctacatcagcaattgaggttgaggtagattcattaattaattactactactactacctaatacttaaaaaattcacttgcctttgatcacgttgctgtattataatcaggtagattcaacggagagtgacaggatttcttcaagttttgcgaagacaaccaaaaagttcaattgaacactgtacgacagatgtgatacatatgatcgatcgacgaatgaggcgatacgatggaagaaaattgtagtattcaattaaactctgtcgacgattgacaagttgagctgttagtagctagtaaataacccgcggcagataacaccgaaaacgtgcatggtttttcctggatctcttctatcgatggatgtataaatagctcctaccttggcaagctctaactatcatatcgcagttcatttcacaaacggtatatgaaaccatagttcatttcaatccttccatatggctcaagctggtgtacatagaggaggctgttgccgactcctctttcttcttgttactgctcttttgttgcgaagatcctgtgttgttggacagcaaagccaatccaagaaagtatactggttttattataagtgaaatgtacttttctgtaattttgaccccatatatattttttaaaaaatgccgtaacatcttgaaaaaaaggtaatttcattgaatcaatgttttccactggagttttctttattgcccattaagaagttatcggaggcactattagaactaggatggtaaaaatgtcaatttcatattataagtcgttttggatttcttatgtcaaattttttgaccaaatatagtaacatttatagcattaaattagtttttattaaatctaacattggatggtttttttttgttttatgttgaaaatattgttatacttttttgtttataaatttggtcaaaactaaataagtttgacttcaaaaaagttaataatatgaaatggaggtagtagtctatgtgcctctcggtatctaactataaaaatgctcccatatataccattgagtcaatatatagctaagacgtgtgctggtggtaactactactctctccatttttaatgtatgacgatgctaatttgttgagatatgtttgatcattcgtcgtatttaaaaaatatttaattattatttattttattgtgatttggtttataaatgttctttaagcatgatttaaatatttttatatttgcacaaaaaatttgaataggacaaatgatcaaacgttgataaaaaataaacatcgttatacattaataaaatggagttagtatatgtgtatggagaggtgtatgcatggctgattgacaaactatacaatatttgaagatttacattgtctaccttggggagagacgacacgatgatgctgatgtcgtcactggttcccaccatgacatgctcgcctctgttttgggaaggtaagaatgcacatcgttactctgtccatttacaaatattagtcgtactacctaacaacacatcgagagttggatcactatctgctcactgaaagtgtgatggatctaagtacaaattttatgtattgcaaaatgtgatatggaatgatattttttaaaaaaatatatatagtagtcaaaagtgacaatgtttgtttacgattaaaaatggagaaccttatatgcaaccgagcaaacgaacgttatgaaagatacaaatatgtccgtatattattaagaaaatacaaaatcaaaatgatgcccttgataatataaaaccttaaaatgaaagggtacacaaatacaacaactggtaggcaaagaaaggaaaacaacgttgctttaatggaaacatgcatggactctgaagtagcgggaataaaattagattgaaaagggcaaatgagtgcataattagtaaatttgtgtatatgcgtgtgcgttttcctgtgaggaagaaaaatagccacacaaatctttttagcaagtaatatgtgcagaagaactgcatgctaatgcgtctatatgttgattgacaaacaaactgtagagtaagatttgagatatcgtcactaacaatattactacgtgcatatctacggtgaactaaaaattatttcgagtattattaaaataaaatatggttgcatctttgaagcaaggaggtggctcttgagtccatcgtgtacagctacagacatagtttttctggctttgctgcaaggctcacagaagcacaagcgagcacgatacgaggtaattaattaatcattttctttaccgataaaaaattaagaggacacatatatattctaaaattaattggggcaccatgaatcatactccctccgtcccctaatataagggattttgacattttgcttgcactgtttgaccatttatcttattcaaaaaattttgaaattattatttattttatttgagatttactttattatccaaagtactttaagtatatatttttgttttttatatttaaataatttttttaataagacgagtgattaggggacggaggtagtgtgtgtatgtatgtatgtgtatattctgacaattttaattatatttaatattctagggttgccagatgtgatcagcgtgagagagaaccaaatccaccggttgcatacgagtcgaagctgggatttccttggaatggactacagacagccaaatggcctgctagccaaagctaaatatggggaagatattattattggggttatcgacacaggtaagtaaaacactagctacatgcatatataacctgttcaaatattgtaccacgtgcaacgtaccagatctatactacgtacctgcaaccagatattccctatgataaagctactcataatataggacaatatatattttggtcaaatttttataactttaatgattaataattctcaagtgtttagtttaaaagtaagaaagatattatgcatagatttgcattgaatagaactggggcggaacttcaaaatttacaataataacagactaattttaaaagcagccctacactaattaatactttaagtttcttattccagctctgtcattcattatatagtagtactactacattaacatcgtaaattatgataagtttagttatgggtgaatagctaatttagtccattaagttttaccaaaggctcaatttggtctttcacgttttattttgtccacatagctcctccaaatatttgttttggcttaaaatcatccttggacccacttaatatgccatatggctatttctagtcagtatttctattaaaaagtcctttttgcccttaatttgtatacaactatatactagacaagagtaagtcaacatgaataaacaacgttacagatgtacttcctattatttcaagatgtgcacatggaacttaagcaattgctatcgtatacacttgctagtatataattattttcattttacataatatactatgtattatctataaaaaattgaagcatgcaatttttctcttatatatgcgaatgatgaggggtataagtgtcatttatgaagagagttgttggttcaaggataagtttgaactaaaatgaaaacttaaaggactaatatggatagattaaaacattaaggactaaactgagccttagatgaaacttgaaggaccactttggctattcacccttagaatacattgatgataatgtttgagcatattttagattagggacaattgtttatttgaccccgttttgaatcctaactactaatttgaccctactttttagagtttgcttatttgaccgtccttttcaaaaagaagcttccgtataaccctgatctgttaagggcatttaacgttgttaactgaagcacaaaatatctcttctgttcttactcatttgaccctattacatatgggacccacccgtcagttctctcttcttctctcctctcttttcttctcctctcctctctttcacggatcagcggcgaaccggcaccgatggggcggcggcttgccgcggcggcggcgctctgagggggcggagggagggagcggcggcggcggcggctgacggagggggcgagttgcggcggcggcgcactgagggggcgagcagccgcgccgactcgtggagggagggaggtgcggccgcggcgcaggcgagtggaaggagggaggaggcggcggtgccggcgccggcgcaagcgcgcggaaggagggaggagg

SEQ ID NO: 73093 - DNA, 4736 bp, Oryza sativa
attaatatccgtctcatcatctgacgaatcaccttcctctacacgctcgttgtcagaatcgtccctctccatttcatccacaatggcaccgacagtctccccctcgtcggccactccacttggttgaatgcccactggagctactacgcccccgtcctctcgtgcgttgacctcctccacagaagtctcgtttacttcagcacttggtccctcgccatcatccatgttcgtctgcacacctggatcctttgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacgaacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacacacttctagattagtacaactaaaaccctaaaaatataatgcatttattcaaacaaatttttaaagaatacacactatttaactcaatagtcacatataggatctatgaatattacctgaaatcggtgtctgaatccggcagggcttcgccccttcttctcttctcctcccctctcttctttttttttcactggaattgaggagagaagaatgacggctgggggatgggcagcaggccttttataggcaacgaggcctgccgcccggccagagggcggcaaggggccgcctgcaaaatagccggccccgactggctttttttgcattcgggccccttgccgcggggttttcctaaaaaaaaaccctccctctgtcaccgcccgttcctcccccgtttgccacgtcagcttgtcgccctagaggtgggcggtaggggctatttctgcaattttttggtcgatatattatttctgtaaatattaaaaaaaataatctaaaaccgaaaaaaattctcgtcaaatctatctcggcccaaaattgcgggcacctcacctaccaggacaggaccccggcccacgccacaggtggcggccgccgccgcgcgccgcagccgcctcctcggcttcccacggatcggacgggtcgcagactcgcggcgcacactggcacccgatttgttggtttcttacccctcctacaaggcggccggacgcccacagatcggatcggtcatcaactcatcatcgccccccttcaaaaggccacccccctccccctcccttctcgcctcattccccacagccgccgcctccttcctctcctcgatctccctattcgtcgtagcctcctccctcgttcgctccgcccgcaaccatgtcggcctactgcggcaagtacaagggtatggatccatccatccatcagcattcttctccatgtcgttctcctctctccatctgttcgtgctttcagttgcgtgctgtttagatctagttcttgtgttgggttttcggggtgagtttgttagtagatctgttcgggaacagtaaatcgatggagtggcgtttatttatgtgatcgtaatcgtgaaatcttttgttgtgtctataggttaaagattggttactagttgacttactgtatgccatattggcttagtttatacataagggttctttagtgataagtggagcagatcttgttcttgtgtgttaaaagattgattataaaacatattttctgccatattgatttagtttatgcatagtgtttctttagttataacttataagtcgtgtagtatctgtgacagaaataagttggttgatctagatgacgtgcatgttctgttagcagaaattttctatctatattgatctgttcaagtgatttaaattatgcatagtgtttctttagttataagtcgtgtattatttgggacagaaataagttgggttgatctagacatgcatgttctgttagcagaaattttatatctaatattgatctgttcaagtgacagcctttcggtggtctagttgagcattggacatagtttatgcctggcaatttggatagatctattatttaggccatacagagatgctgctttttttttgttaataatatagtgtttgccatcttgcagacgagctcatcaagaacgctgcctacattggcactcctgcaagggtatccttgctgcggatgagtccactggcaccattggcaagcgcttcgccagcatcaacgtcgagaacgttgaggagaaccgccgctccctccgcgagctcctcttctgcacccctggcgccctccagtacctcagcggcgtgatcctcttcgaggagaccctgtaccagaagaccaaggatggcaagcccttcgtcgatgtcctcaaggagggtggtgtcctcccgggcatcaaggtggacaagggcacaatcgaggttgccggcaccgagaaggagaccaccacccagggccatgatgaccttggcaagagatgcgccaagtactacgaggctggtgcccgcttcgccaagtggcgcgccgtcctcaagatcggccccaacgagccgtcgcagctcgccattgatctgaatgcgcagggcctcgctcgctacgccatcatctgccaggagaacgggctggtgccgatcgtcgagcccgagatccttgttgatggccctcacgacatcgaccgctgcgcctacgtctcggaggtggtcctcgctgcgtgctacaaggccctcaacgagcaccatgtcctcctcgagggtaccctcctcaagcccaacatggtcaccccaggctctgacgccaagaaggtgtctcccgaggtcatcgctgagtacaccgtccgcaccctccagaggaccgtccccgctgccgtgcccgccatcgtcttcctgtccggtgggcagagcgaggaggaggcgaccctgaacctcaacgccatgaacaagctcagcaccaagaagccgtggtcgctgtccttctccttcggccgtgccctccagcagagcacgctcaaggcctggtccggcaaggcggagaacattgagaaggccagggcggccttccttaccaggtgcaaggccaactccgaggctaccctcggtacatacaagggtgacgctgtcctcggcgagggcgcctccgagagccttcacgtcaaggactacaagtactgatttgccttgggaggtgctggctaccattggaacattctgcggctgttgcttaatgtggttttgatatctagagggcaatctatggttatctaaaatgtcttgtcgtaataattctggaacctttttgtgtaacacattaccaaatatcaattgcctggattgaaatatcgtttttatcagttctctgtgtgatggatgattttgctggatggaattaggctctgtttagtttccaaaacaaaaattttcaccctatcccatcgaatatttgacacattacgtgtaaattgtgagacaaaacatgatggattaattagacttaataaatttatctcgtagttgtaatctgatataaatgtatatctatatatccgatgtgacatcttaaattttttttttttttgccaactaaacaaggcgacaccccaaaacaatttttttcccaactaaataaggccttaaaccgctactcggcagatttagtgtaaatagcaatttggtctagtagacgttaccccaattttgcgatcaccttggaaatcgctggaccttatcagctcaatcgaagctatgcttcaaggcagattcaccaccctacctaagtccaccaaaacaaaatgccacaggcgtggaaaatccataaatcgataaaatgtaaagtaaattcggataacttctgccgtgagagaactgctgtagcaattcagcttcattgtacaaccatcaatgctataacattagcataagatatggaaaattttaaaatcttcatccaacatgtaagcagaatggatattgaccatgtatctcctagtaatggggcctacagtccgacaaaattctcctaaactacgggctggtttggtttgaggcctaaattaggcttaccaatattttgcaatttcaatagtatttagtatctatttggtttgaagccaaattttggcatatctaagaaaatagaccatttcaatagtgaacttaggttattttggcttcaatccaaacacaactttgccttaccaaaattagtcatgccaaaacttatcaaaatttggcactgacaaaatttggtaaggcctatttagattgaaactatgccagtggagcaaaaaattgaagtgaaggaaaaaaaaacaagatcctattcgtgttttttctcccgatttgcaattgcctgtttctgacgcttctcccatgctggcatcttgcctgggaacgcccatcgcaaaatccgctcccatccatagcagccacaaaacataaggatagcccaaagcatcagtttgcccctcattccttcaggcaggggtt

SEQ ID NO: 73094 - DNA, 2228 bp, Oryza sativa
tacatgtatcgttctaagggatgaggactcacttgatcaggctgtcctctctttttcacggcattgtcatgtaggagctgctcgtacaatggaaccacacataaagagggtgttgtattagttattaagtgattaatcaaagctaagtttgcagtgatagttattaaaggtgtaaagctagagacaaagtactggccccatgattaactttccagaatgcttttatggaccaattaaagcaaagctttagacaaactaaaagcccctttgggaacaaaaggatcatcttttgtgctttacttaactgatcagctgggtatagatcccataaaggaaaaatgactaattgatcgaataattcattagttacttaatacctggccagggtcttctggaaatatgctgttcctttctccttgcacctataaaattaaacagcaattaaagggaatcaaacagctagcttttttatcgaccagcatatatatactcatttggttcgtcaggcataaagtttctgtcaatacttttatcgaaagatctcacagagatacgatgctctgaataaaatcataagcacaagctttttattcttgattattgtgtgcaaagtttgttctgccattacgtaacctaatctaaactaatctagctaacccatgcatatggtagttttgttgttctttttgcagtgtgcaaagatcagtgcatgtgtcaatccatggatcggaagaatagtctattgagaccagtacaataaaattgcaatgattagattaattaataatagcaagtgtactccctgttctgcagtgtgcagactcaaatgcatgtgtcaatgtggatcagaataatattatattgagcagtacatgaagaagtaacgtaaccctccaattaacaaaatgtactgacgcaacacctgtgcaggcaacatagtttggaataaagccataattttagataaaatatttcaagtgtatgtgctacatgaaaatagttgtgaggttgaagttgtgggcacattttataaacttatactagctaaaatttgtgaggttgaagtttggtctaaaaatttgtgtatgaccgtctaatgtagccttttcctaaaagagaattcttgttggaaaaaaaaaaggttttatgcgtggtgtgtggttatttaattacaaaacaacctactatatgtacgaatatgttttttctatcagtatatatttttcccaacaacttagcctagctgccaaaaacatacaacaaatatgtgcgcaccactgtactatagttgacatatgaacagatagatgcatgctagatagtaattgacaacgtacttggaacacaatcacttgacattaccctttgtctttattgtggacaagctctgtgaggggatttcaatattatttgtgtgtactacgggtcatgcttcctaaataaagttaactagaataaattgcagtagtactgatagaattatattttgtgcacataaaaaaggtagagatactttattaatcgtgaggtggttgcaggaaaccaacaatttttcatcggtttcaacccgaccaaatcattggtgtgtttctgtcatgacacaaagcctttatgacccttactgttgcccatagcttggggactaaattgttttgggtattcccctcccaagggggtccccggttaaaacccatatttattgggagcgggtccctttttttatattaaaggaacggagggttttcttattagaggggcgtttatttgaattggtggcccccacttattttccaatgatcccaaggcctccgaacaaatttctggtttggcgttttttttgtttaggggcttgaggggcctttcttaggggccttgccctcatattttctcttatgggggctccaaggcactttttttttgttcccccccccccaccccactatgacttccttcctccaccaccttttgggcgcgcgctctattgagatggcatttctcccccattctcttgttacccctcttatagtttcatctgaggccccgcccatctcatcctctatggagttttactctaacgcgtcgccttctaaccatgagaaggaaaaaccgcgtgctcaatattttctttgtcgcaattctcttatccacgtggttatactaatgcaccgctatccttcccacaagatcacccttgtcgtgcgtccctctgtcttctattcctcacgtct

SEQ ID NO: 73095 - DNA, 944 bp, Oryza sativa
aggggggtaattcgtccgttattgaaagtttagggtgagtgatgtctgtttttgaagttcaagggggtaattcggtcgaccacgatagttcagaggtgtaattcgtactttttcatttggcatataatgatgtggggatgtattatagtatgtatggtaccctaaatggttctggcttgaactgcatctgtctttataacctaaatgatgtggggatgtattatagtcaatgacatgtgggccacagggaggaaaatactcgaaaattccatcattcacatgtgggccatagggaggcaagaggcgcaagacacctggtagttgggttcttcttcccagcatttgcctcttatttccatattttcctgatgggtaccaagattgataggatttgtccaagggcttcaatcccttgttctccttgttttgtgcatgaggtgctttattccctttctgtttttgataaagctaattattcctttttttacttttttttagaaagccaactgcatccatatgagcttcagcagctaagacaatgtatgcaaaatagtgcaaggatgcaccagctaggaattcccgcattagtaaaagtgcttggaaataaaagagtgatcccgcaaaatgatgctacagctaaccatagaaagcacacagattgtgatcctgactacgaacctgagcttgatgaaaccattgatggataattgtgtgctactaacaacgctaaggtgctagttccatcaatcctgtgatgatggtcatgtgtcttctttgctaaggcaatataatacaatccaagcctttttgattgatctatgtttgcatttgtgttcaggaagcatgtagtagcaagaaaaggcattctgacatggctcctggtggcttcaaggcgcgtaaaaagacagcgcttgcagttcggccagtgaatggagtccttacaa

SEQ ID NO: 73096 - DNA, 541 bp, Oryza sativa
tgtgaagctccgaaatttcacaaaaaaatccggagaatatattaaggttcccggccatgatttttaaaggaaattttttaattccctcattatttcacttgattaaattgttttaacttttatttaatttctagaaaatgcattattcaatgatttttaatcccgaacgaaaatcggggggttacacgtgcgccgggtgctgcgcctttccgccacgcctgcctcaccgacgcttccacctctctaccatggccgccgccgtgcgcgcctactgccggcccatccccacgcgccgctacccgcctttgcctccgtctccgctgccggctgcacgagcgcgccaccggtgcccgagtgagccccgccttccccgccggccgttcgcgctaccttctcctccgctccgccgacggtcgccgagcaaccgccgcgccgccagcacctgagcgtcgtcctcatcgtcaccatccactcctccattgccattctcaatgccaccgtgctggtgagctggtgaggagcggcgcggcagtaggatccc

SEQ ID NO: 73097 - DNA, 1237 bp, Oryza sativa
  unsure (1)..(1237): unsure at all n locations
cttctccccctatccttttccttggatgattttatcatcacctcgaagcaagcgctctcttgattgctgtgacggccatggctggtttggggcctgatcacggtggagacccatccttcctctgtgcaatggatttttgtccaagaaccaaattattccattagccttttcttcggtttgtttgcgtttcatctttagaagtttcagcatattgaaggacagccacaggaattcagcaactcacaaactggtcactagttttggtctatcaatatactgttctacttggaagtagtagtagcttgcaagaagaagcgaagatattcatttgttcctgcaaaatttctctcatctgatctggattccggtctgttgttttcttcagagccgtgggatcttggtggagttcagtttgggttggaacacgatacaagcctgcaaccatgtgcaaggagtgtactcgtactactaattttctgccaaaaatgccgaaggatttgtccaagagaccgaggggaactggtcttgggtggtcaaggtataggaaaggaaaagaaaacctgttaggagctttcttgatgagattgcttctcttgccgatgcttgtgttactggctgctaatctagcctaaatttttcaacaattttttctaagagggagttgaatttttttcaaaggaaatcgtaccatttgcatgtagacacatggatcgctaatcttggttggacctgatcttgtgggacgcctataatttgaatttcgtacgaaaacccttgcaaataacacgggcggcggtatttttattttattttccgtaggggtttggattggacaaaattacacttgtgttacccccctgatgagaggcttgttcaacccaattgttttgcggatggaaggaaattatttgtatttgtttctcacaatgaggacctcttacaccactggtggtggtaaaagcccaatccccgttataagccgagctctcccggcccaatgtcgtggttacccccttgttatattgctcccagggtggccggactcacgagaactcaaccctggcatgttggtgttgttgccctttttacagagcgccaacaattcgccgcctctattatatatatatggcgattgccacacatgagngaatatgttgtattttcggtgtaaggcgactaattacaacacatcctcgtcggcgcgttttcaggtataatggacaattactctgcgact

SEQ ID NO: 73098 - DNA, 1084 bp, Oryza sativa
gataaaaaaatagaccgcaggtatttcatacaaaagtttaaatgcatttgtctcccaaaaaaaaatacaacaatacatgtaactagtatgtacaattgattacatgcaaaatttgcccatcaaaacatatattttgaagctagattttgcaaaaaatagttagaacaaaccttgtcaaaatattaaaaaaactccactttccaccaacaaaatataacaaaaatggagccaaatgaagcaggatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggccgatcatcgcatgcggtcccttaagccagccgcatgcgaagatccattatcgcatgcggctgtcttaagcagccgcatgcgataatggattttcgcatgcggctaatcaacccgctcccggggggggcggtttttgcaggcgccgccacaagcggcccgcatggaacctaccgaccccctcgtacagaaaaacgatttttgtagtagtgtaattaaaacacccagtaaagttttggtgcacccgggagagactcccatcctggtagtgaggtcgtggatgtaccccttgcaagctccgcatctccggcggcttatgctacgaccgtcattttgacatcgtatgcagacggatgccttctaagctgctaggaaaagctgagtgttctcgtcttcggatgagtggttagtgcggcaagctgattggaggcgcgttgttgaactatcacggagacggagacgacgatgtgatggagatatcagaaatcatgatggagtgccatatctattatatactaaaagtccattaacctttctaaaatcgctctcaagctgacatgtggcatcctaaaagcgctctcaagctgccacgtggtgcgaggagaggagatgaggacccacaaaaaacgaaatcctctcccacaacgtccgcatgtacgcatgcatgtggatgctttccttccatgcttagcggcaggattac

SEQ ID NO: 73099 - DNA, 13055 bp, Oryza sativa
tttttttggttttttttaagatgtacatatgcaaagtttatattcgtatgtataccaaattttgtattcgtacgcatacaaagtttgtattcgtgtttttttctctcagtttttaatatatacatatacaaagtttatatacacgtatgtgaagtttgtatactcgtatgcgaagtttgtatacatgtatatattttatacgttattttttttgtacacataaaaattatatatatacatatatactttggatacaatacaaagtttatacatgtgtatataaagtatatacatacgtatatatacatgtagtagtattgttgtagtagtagtactccttccatcccattttaaatacaatcataagtctccgtgcccaattttgatcttccgtcttatatgaatattttttatgattattatttttttattagatgataaaacatgaataatactttatgtgtgacttctatttttaaatttttttaaaaaaaattaaataagacagacgatcaaagttgggtatgaaaaatcatggctgcacttaggccccctttgattcaaaaggaaattcataggaattttaaaggatttcattcctatagaaatttttcctacatagccatttgaatcaaaggaataaatcctgtgcaattcctatggaatgcctaatgccatacaagttttggaagaaatctagcataaggttgtaccgtatgaaaactttcctatgagtctccacctctcctctaattcctgtgttttttctgtggtccaatcaaacggttattcttgtgtttttcttatgttttgcaattctctgttttacccttgcattcatattaaaatcctgcgtttttcctatttctacatttttttaatcatgtgattcaaaaggtgcccttgaattggaacagaggaagtactactgtagtggtagtagcagcagcagcgcgccagtagtagtaccaggagcagaggagcgggaggagcagtagcagtaggagcagagctgtaggagcagttccacgttaaaattagaagtttgaagaaattcgaatgatgtgacaaaaaaaagttggaagtttatgtatgtagaaaagtttgatgtgaaaaagttgaaaattttttaaaaaaagttggaatgtaaatagggcctaggagtaggagagtagtagtaggaggtgcttagatcaggggtgtaaaatttggcatgtcacatcgtacatatggacatatatttaaagtattaaatgtagtctaataataaaacaaattacataatccgtctgtaaactgcgagacgaatttattaagcctaattaatccgtcattagcaaatatttactgtagcaccacattgtcaaatcatggagcaattaggtttaaaagattcgtcttgtaaattagtcgcgatctatgcaattagttgtttttttagcctatatttaatacttcatacaggttgaggtgagatctaaacagggccatagtactactactagaagagcagtagcagcagcagtagtaggagcgcgtgaccagtccactcatcaggggcactcctagcggtctcccagtattccgagcgccaaacatgcgtcagcccagtcccaccctaccctactttctatcatcccactcttacggttatcggagtaaatgatctactctgatcgcgtatctctaccacccaccctttcgagtaaatgtttttctctaatgtaatccaacctcacccttgcgcatactatcatgtctattcatgtctatgtgagattcttaactatacccaccatccccttgtattcctctccaccacccggatttttcggatctgaccaccaccgtatggagaggggctgtttccggcgatggcatcgagggaggccggcgagggcgcagagcctaattttacgaatcttgcctaccaaaaaccaggagcagaaagcgagcggcaatggtgcagttctggcgatggcaaaggtgacgagttaggcaggactcccatctccacgatggagggtggagatccggcattgctgtgaccgaatccggtgatcccgcagccggatgtggccatgtggcacgggacgacgcatgcaggcgcgccacggcggcttgtggcgcgggagacgacacggcgggcggcacgagcgttagcagagcggccggcggtggccgggcaacggcacggattagccgagcgatgaccacagagcggggtgggtcatggcgacctaacgacggccagatcctccctctcccggccaaatccggtggtggcttggcagctcttctgccaaggttgagaaggagagcggacggcagcacgtacgtacgacgaagcggagcggccgttgaaatgacgtggtggcgtgcgcccgtgggacagctgtggaggtgccggcgcgaggtgatgcagtcgtctgactgctggccaactgctctgctctgcttgtttcttttttttttttttgtaaaagttttattcacgtggttggtacatatgattcaatgtcgcatccggagtatacaaaaatattattatctacatattattctgttgtaaaaaatcattttggccctaggaaaccgaagtacagagtaaataccaatccaaaagcaaaacgaagtacatcaatgcatatttcatgtgggaataatttctttaccacatgttaaaaaataagctgaccgaagtataccaatacagattatcatgcgggagtaattcgtttactacctgattaaaattagtttttatctaatcgaagtacactaatacaaagagtaattcctttactacctgatctctttctagagttaatttcttcatgaagtcagcagtctgttagtaaatgatttactcattttttttggctaattgtaaatgatttactggtactggtttcctattagtaacgggaacggtttagagagagatacgggagagggacaacagaaaaattaaaattgccgtgaggataggagagcccaatagaaatacgagggggaagaggaacggaaaaggcggaataggaacggaaaggtggaagcgagataagggaaaaaacagaaaaaccgaaggtatgggatacctgagacgctcgaactattgttccaagcgattttgagttcgcttcaacaaataaattacaatgttctcctagcaagcaaaaagagagatattttttcccaattgattaaccaaggctactaactaaattgaccggttaaaattattctttctcagtctcggactcagtactttcgatctcggtcccgttcttttcactttgatccacccctagatggatggttggacgacagatatgagggagcgcacaagtgctggggagtggggcccgtctggtatttcagtctttttaggtccctagcggatataagccaaacaagaatcggtctttcttaagtacgacaccgcaggttaaaaaccaatgccggacaaacaaaaagaaaatttttgttcggttatttttttgccacccctcgcaagaccctgcaattcactaacctccaatgtctgttttgtgctttgtccgtgaatgttagagctcgtcacttgccaattttcccgtatcattttacttataatcaatcactgtttaatagattgtttttttctgcagctaatcaattacgttataataaacccttttttctttaaaaatactaaataaaccgacttagctatataattttcatgttaccaacattaagaaactacattttccatttgatttttattatttatctcaggattttagctaatagagttatattttttttaatttcatttttcaagtatttatctcgggatttgagctaatcgagttgtttgagttagcatgatgattttgcttcttggcttttgctgatggcgtggcatcaaccacgaaacaattcatgctgaatatcctactttcaattgaagtggttatactaattttctttcctagctttactgatctttcataaaaggtagttcggcattttgatttggattgatttctttttggatgagttgtaactatgaatttttatttttttagaaacatcatttttttttaaaaaaaatgctcatatcacaaaaacaatcatctcataaaatttgattgtttccgtggcaacacatggacactgtgctagtataaatattattactcttcccctcggttccaaaatatagcaagctggggagggagtattgatttttgatcttttgtttatttgtaaaaaatatgaatacttaaaaggatgtcgtatttatcaaagtgttgcatattagccatgaaacttttgttcatagtctaatcatttaagaaaatattttattggtgatttagttattaaagttgaactagataattatttaaaaatggagggagtatttctcggttaatgcaaggaaaaaaaaaccttattagtcccacaatcttccactgtaagtaaaaagagtactgctatatatacgacatacgagttagttgtacaactcatatacaaatagaaacatgcaaccataaataaatcaaggagagattatattcatatgcactatagctgtttgcaaccgttgattaaattcagtagtacatgagtcggatagctagggtcgtatacatagcaatttccaaaaaaaaaaaaagtttcatgacaaactacaacccctgacgaggttgcttatagggtgctcatgaattagtctctgatttggactgatcccatcccacaatctgtatatctgctggttcatgattttttttttcatgaaccagtaaggtaataaagtggcgcttttttaagataaaaaaagaacttccatgacgagtttatcaaatatcaaaattgttaaatttgtagaatcatgtcagaggtttacagatccacaacaaaggacatgcattcagatttatatatgacagacaaaaaaaaagaactggtcttcatctattccattaaaaaatcatctgaatcatgttaaaatgttttttttttcatacataggaatgcgaagccgaagattgcttataaaatttacatcccatctcaaagcatgatctagatagatttaatccattaattccttacaagcatacaatttttgagcaagcagtaattgaaataacagtataaaattataagaggttgcctgcgagaagggttagagcatctccagcaaagcccctaaacatagaccttaaacaactttgaggggttgtgactaaaaaataaagtccaacagggctcctacttaaggccccaaagtagaaaggctctcaaattctctcccacagcccctaggcctaggggctatatccccagcccctatccagttttctttggcgtgaggggatgtttccatgacgtgtgctccttcccacgcgatcgcttgcacgccgccggccgtcttgtgggtgattctgctctaatccggccatctccctgctatagtattggtcacctacatggatgcaagtatgcatagatgtttcagcgtatcgatgagacatcgtttggttcctgttaaatgtcaacagccatctgccgccagtggccaactgagatttgatttggctgatctaggagttactactaccatctccttgcatatatgcctgcagtaccgtgtatgcactggatattgtctgaatcttgtccagcccatcatatatgattatatgcatccatatatatatgtacaggtatatcattggatgttgatcgtaggatggatggatgaactgctactgctaccagccacagcagatgcactgatcgagcattctagcgagtaatcatgcactcacactagtgtatgtatatgcacagatcaaatgtgatatcagaaaaaaaaattcaaaattcaatttgaattgtgttgtttgaaattattaatttaaatatgattaaattctatgcgttggaaatattaatatttacattattgtgatattaaactaaacataaaaaatggattataagatgaaatagaggagaaaaagaaataggggctaagaattagaggttgttgatggagttagaaccatttttagagtcttaaggaaataggggcagcccccatttaacctttagggactttaaaataggagctattgctggagatgctcttacaaagtacaaacaaaaaataagcaatcatacaaatttattccaaaggacatggaaacatttgagaaagaacagcaaaaataaaacaatcaacctcattggtaaagcacaagttttatcccaaagaactttgtctgtgcagtgcaaacatccatgcatatgcaaatgttaattacatgggcagtctactgtagtatctgtatcagtatcactccatttccatatgaaatgtgttttgactgtgtattaggcatatacagatgaaatagggcaggattcaggaggaccaagttttagtggcttcgtctatgagtgtctgatacagctcctcaaccacattgaggaggaaatggtctgcaccatgtcgcgccacgagcgaaactgacacaggaagaccattgcgcatgcccagcggaatactcacctgcagcacataggcagaacacatcaaaaaaacattagtcaccccaaccattgtcaaggtagaattaataagaaaagatagattaacttgctagctagttctacctggcaaaacccggataatccagcgatggagagaagtgaaaatgctcttgctcggaaattttccagaggagcagcttccatgcccaccttgggtggaggcccaggaactgtagggattgcaaggattccatgatcctatgaataaacaagcaagtggctaagagagctggaaactacttatctgataattgacacaaatcaccagaaaattattggctgcagaagaatgcaggaggaaatcattctttcagttaccttcagaagagcagcaagtgcagacttgaattcagcccttatagcttggaaatcctccagggattcattatccccagatgcaatggcctccagtattctctcccgtaatccagggcctaggttaggttttacagtgttgacccactctgcatggtttgctttgaactgagacctgaagtacacatagttttaatggattaatttacagttttatctcccagactccttgtcctacatatgcaactctggctagtgaacgagcacaaatcctatcactagatgctgctgaaaattattggatttttctaccacgattatgaacaagatgattggtgtactaaaagaatatactaaactatttggcatggtgtgcagtagtcagtagctagcactattaactcaaaccttaaagcaatattactagatatcctgaataagctagctgtaggtgaaacctttgaaggcctcgcatgacatgtgaaatgacggatagagctggcacagaagggagttcgctttcagagaagtcagtgatgaactttcctatgcttggaacattatcagagatgaaatctccaaggttcctattgtctaatatctgacctgtgaaaacaaaggaacaaccccatcagacaagatgtatggtagaaagcaagaattctagagctctaagctagaacaacatgagtgcgtagatagtactactcactatcaaatctctttgctaccgaagcattgatgatttgataggtgcggtcgtcgagagagcctaagatctggaaacagtccataggaattgtgacttgagtaggttgcttgacaatgtcatcagggagtggcaacagcactttggttacacgagacaacgtagataaatctctggaaaaccaccctgcacaagcaattgcatgaataaaccagaaactcatcaatcagcaccactcgcagtagtaattaatactgattaacaggtctttgttttcacctgattgtaactgtgctgaagtaatttgaccaacattatgcagtaacattaagggtgtaatttgaacagaaacaatacctatgcagtagtaatcaatactaaaagggaaatggaggagatagtaagtgaataattaccaacagtatcaaacatttgcgccatggggatgacattctctgcagaaaccaacccatgggaagggcggagtccaaagatgccgcagtaggcagcaggcaccctgacgctgccgccggtgtcggtgccgagggagaagtcgacgaggttggcggcgacggcgacagctgaaccactggaggatcctccggggactctcccaggcgcgcaagggttggtcggcgtgccgtagtgcgtgttctccccattgatgctgacaacaacaaaccaatcctagctcataagagttaagacccacaaattttgtgacaaccaaccttttacaaattttgtgacaaaattattggaaatggggaaaacaaatttattttggggggatagttggcttggtaggaaaccattagctgagcaatatcctttcatttataacagtaccttcaccaagcatgttacagttgccaaagtgacaaaagaggggtgaaattggatttaagtttaggagaattcttcttctttttttttagaaacaaagttcaggagaattgttatgggtgacaacttgctttagcatggagataaactttcaacagaaagttcagtcgattgtactgaataatctgaaagataaattaatctggaagctgaccaaagatgggtgctttactgtcaaatccttctacagggcattaaaaatgcaagacttagcttatccttccaagaagatttggaaattaaaagtgcctctaaaaatcaaagtttgttctttctgtggcttgtgtttaagaaggagtattctgaaaaagagcatgggggtcgcagtgggtacctgtagcccatctcgtccatgatggtggtgccgaggctggtggcgccggcggcgagcgcggcgaggacgacgggggaggtgccggcggcgggcgcgtgggtcctcgcccagtccgggttgccgaacccggtgacgcggccggcgatgtcgaagctgcgaattaaccaaacaagacagtgagtattcgtcgttcatttgggggagaaaggaagaagaagaaggcagcgagcgagcgagcaatccgtacatgtccttgatggcgaaggtgaggccgtggagagggagttgctgcgatggcggcggcggcagcacgaacctctccatgaaggcgccgtagtctcctcgtcctccacccgccatcgccatgtcgagctcgagctctctctgtctctctctgccgcgtcacctcggctaatctaatcgtcttgttagcatcgaagctgggctgggctgggctgggctggacgatggccatcgcggtggggccagtgatgaggaaagtgaggggctgatcagattgacgctatttttaattatatcacttttttgggtaaagttataaaaaaatatttacgtttagtttgttgtcaaatttggtagatatataagaaatcctgtcaaaatttggtaagacaggccctaaattctattttggctacaacctaactttcatctctcgttataaaatcagatacctccaattctcgactattaaaaccgggtaaattttgtctccattagactgtttggatgacgattttatcacatgtgatgcttacgtggtacgttagatgggtcttcatcttttgtgtggagtgtgtggcgcttgcatagtattacatccagcaaaaaaataaaaacaaaaaaatttaaaataagtgaaccatgtgtaattctatcggagaaaacaatagagttaatgagacccgcatgtcattctctctcctcctcatcgcttctctccctccctcccctcttctttctcgtcgtgtcattctcctcagagagcatgaacacaacggcagtatcatgtccggtgattgcctacggtagggaccatgttgtcgacaccatcatgatggtcttgattagggtggtggtgtcctttacaggtaatgcggaaccttctcataggtgagtttgtggcaccgaaccgcacctcactagaagcatgaaataggtctacccctatagggctccaagtcatcagcccgcgaccaagacatgaccctcgaaccccactccatccacatcacaaaggacccttgttagctgtgagtactccgagagctatccgttgggcatcaccctttcttcgcagcattaatactggagtcaatcgaggcactggagaggcggactgaggtggtggaggagttgaccaaggtgttgaggaggagggcatgctcatggaggacgacgataccgaccgaccgcctggtgccacgtggtagcactgctagaccgggtcgtcatcatctctctattccaccaatctgcgcatgccatacgcagccgaccaagccgaaagctcctagggatgtgaggcatcgcaaagagcgctagggtcgacatggctcacacagatctagacgccgatgcttggggaccctatcccctactcagtttagatcgttattggcatcgtgtcaccgtcccattgaattattttattatttattttttcttgaatgtaataccatgaaagcaccacatatgacatatacatcatgttttgcctttttcttttcttttcatggatatgtttgttgccagataacacaatctttctttacggccacatgcatgtttgtgtgggcttagactctggcgtattattttgattgttttttacgcaaacatattattctgattcaagccaaagctcttatgtttattaacttttctgtagatgaattgaaatgaactgaaagaaagtttcaaaatataaaaaatgacacagcatcatgtggcccaactcgaatgttaaataattattattctctccatttttttttagaaaaaacggtgttgttggtaaaacgtagagcaccatccattttcacactttgacaacctttttaataaaaaaaaactataaatacttacttcatccgtttcacaatgtaagtcattctagtatttcccacattcatattgatatgaatgaatctagacatatatctatctagatttattgaatgtgtaaaatgctagaatgacttatactgtgaaacagagggagtacttagagagattgtattatcaacgtatgttacatattagccataagtatctatgaaacttccgttcatagtctaaacatattaaagttaaagttgaaacaacaataatcagcgctaatagctacttgaaaatatagagaatatttaacattttcactgttaatggcacaagacgagaaaaggcttgatagtcccagaagccacacaatctccgcgattccaaaaaaaatccatgacgaggtttatcactattgttaaatttaaaaaatcttgctcggaacaacaatcaagaataggtttgtagaattgtaggtttacacatccattctttaatttggtgacagcacagaaaatgcattccgatcaatataacagaaaaagagcaaaatcacatcttaaaatgttttttcatgcgcaggaacatgcatcagagacatcttatttcaacgaaggagctagattttatgagtattcattaattcctttacagttttgggcatgcaatagttgaaagaatccacacaattatagaggtcatcgacacgacattaccgtgcatagagattagcatggagttcccagcatataacgaggaaccaagaacgtagaaacatttgacaaatactatcaaagagaaaacgatcgatctcactggaaaaacatacaaaagctttaatccaaataacattgtctaaaacttaacgtgcaagtgtgtcacatcatcatccactagcaattattatctaaaatattttaaattatatgactcactagcaactattatgtggagtattttaatctccacatcattttcacattatttaaacatatacatttatctgatgtataacatacattcatccacgtatttcgcagcaaagtgcgaggtatcagctagttcatgtatatatgcatatgcaagtttacattgggtggattgtatcaccccatttccattattccatatatgcaatataatacgtgtttagactttgtattagtaggtatatacagatgaaatcgggctggaggattcaggaggcccaagctttagcggcttcgtctatgagcgtctggtacagctcctcagccacattgaggaggaaatggtctgcgccatgtcgtgccaccagcgaaactgacacaggaagaccattgcgcttgcccagtggaatactcacctgcagcacatacgcacaacacatcaagaacactactcacattttctaaaattaaaaacataaaaacactactcaaaggtggaactaatcagaaattgatagatcaagtacctggcaaaacccggatactacagcgatgtcgagaagggaaaatgctcttgcttggtaattatccagaggagcagcctgcgcctgaatgcccaccattggtggagggccaggaaccgtaggaatcgcaaggattccatgatcctatgaacaaacagggtaaagggataagaactgatctaggaacacctaatctgatactccctccattctaaattgatctacataaagttttttttgaggttattcctaaatgatctacatatttgtgttcattcattaagtctattcattatttgtgcattggagtaaatggacattgatgcatgcatccatgcatacaagtatttataacccacgttgtcggtgatatgggaccgggagtatcatgaccagaggcttgaggcagacacaatcgcccacgtggcctggcaccttcggggacgtcgggcccgagggtgaggtgtccgccctcctcctgatttcccccgaggggggggggtcgggttgcgcttgcccggccccgagggccgaggcaccccgaccccttaaggaagtctgcgccacatatatgggataagtgagcacagctgtgctcacctaacagcatttattgcagtctggtcaagcgtgtc

SEQ ID NO: 73100 - DNA, 2802 bp, Oryza sativa
  unsure (1)..(2802): unsure at all n locations
tgtaggtttttggagcagggcgcccccccccaccgctgggcgcccgtggtatttcaaaggtccgtcttttacacgaaagattctcgccgcgttttctttaggcgggcgcctttttggcccctatttgtttcgagaggcatccctccctctagctcgcggctgtagaaaaaaaaaactcccgggtgtttttattaagtggggaaaaaaatagggccgcttttttgcccaaaaaaaaagggttgacctttatcttgggaaaaaccctaaagggagagcggaccttattggtcccttccctccggtattaaaacccccggaagatggccttcccgtgcctcgcctgtttttttaacancccttggtgtattccgcctatgtttgagagtttgtaacccacttaatattttaaaattcccggctgttcggaaattatgatatgctcctataattttcccatagatttataacaaaaactgcaagaaaacctacgccgttttttattttcgtctcaaagttataccgagatgattatatcagttatatcatcatatataacttcataaacatggataacaaaaaatatatctatgattattcgaagtaaatatttcgttcattatgaaactgtgataagttacaataacattagagtcatgataacattatcagattgtcaaataaactactttcatgtattcatatttttaatttttattgtgaatatattgcaagaaagaccagatacaaagctcttactatggtactacctgcatatgttatacgtagataacttaaaggtatcaagcatatgtcccattaatcttgaatgtgtgtccaacccacttacaaattattatccaccaaacatcgagctacaattactaacaaggtatttgtgcatcatatcaaatatctaagataagatatgatgaacatgtgtaccattagacgcacaatagagataaagggcattttataagggacattcgctcatttaacccttttctaaagcttaacatcaatttaatcattttaaaaaaaagtttgcttatttgaccatgtttttcaaaatcgaagttgtcgtctgactctactttcactacatcctgagtttttcatttagagaaaaagaataacatgtatttacaagcccaaatgtctaaaataacactgagtacatcaaccttatcctcaaccactcatttgctcattccttatccccatctctcctctctctctctccaaagcgtgaagggcaggaggagcggtggcggtggcataacgacagctgcggagggcccccggctgctttgcggagggtaggagcggtggcagagaggcaacattaacttgccgacaaggaggaccgctggcggtggcggaaggggcagagacaactcggcagaggggaagcagcagctccatgaagggtaggaggggtggcgtcggctcaccgacgtggaggaccgccggcggtggcgaacgggaggcggtggctgtgaaggagcggtagcaaccacggatatggtaggaggagcggaggcagagggatggtgtcggctcggtgatgagcagatattgaagttgtaaccagattcagtgatgaggaggatagccagtgacggtggaggggccgcggcacggtgacgaggaggaccaccggcgcccatgcgcatctccgccattagcttgctacctgcggtttcttccgcataaaattggaccaaaggagaaaaattaactttggaaaaatatggtcaaataagtaaggatagaagtggtatttggagcttttgttaacaccgatgaaccgatgaatgcccttaagagaagagggtcagagtgtagcttcggttttgaaaaggagggtcaaatgagcaaagtgaccaaaacagggtcaaatcggtagttggaccttcaaattgggtcaaatgtgcaattgctccattttataatatagattatatcattttgtatcattttatatacatacatagccaaagacacgtgtgatgtactttaatctatctaaaaaaaacatgtctacgataataagaatcatagaaatttaaaagacaaactcaagagcatataccctaataatacactaatagtaaataaaaatatcaatggctaatccctaggacatataaaattataaagtattattttatcggtttattaaactccctaaagaaccctcctacaacgtctattaaagtctttaacaaataagaggaaactttaaatttcttttgtaacagataaagcatctaaaacttaatcctcattaatttaattctcccattaattttggctattgggtcatttcaatgggtatgtgtatacacacattatttaataaaaaaattattcatccaagcatgttatctagcagaaaattatttgagatgtcaggtgaggttgtagtgacctgttgcatggtttagagggttgttgtaaggatgactagcgttgagttttactaggttgccagccatccaatgcatcacaaaaagagcccataggagattttttgtgttttgttgatcgagccaccattaagagaaggcaacaagggaaccccagtacaaatatttttttatgactaaatcttctcttaaatcaagtatctatgtaattttatttaagtcgcgttggcttaagcatacataacttggtatatctagaaggctacatgttagaatattcaattaacccatcttagaaataataatacttagcaagaactcaagcagataacaaatttatatcattaattttgatatttaattttaatcg

SEQ ID NO: 73101 - DNA, 10629 bp, Oryza sativa
gtccgttcagctggcgaggcctttgtgccacctatatatgccatgttccttgtattaggagattggtttttagttttcctctgtgttgtgccgccgccaccgcctaggtcaggaaggagatggcgattccatacgttttgccaccatcatttctgtgatggttaatttggtcctaggcatgttctgatttctgacgaagtcttcttgctctgatcggctatcattcttgctgcatgggtggagtttatgtacatgtttcgctagtttattcattataaactgaatcatctatctatcttaaatttggtgctactggagctattcagttcagtttatctggagtaaacgatcttatgtgtgcgaccctatatactttgctggacgagatctatatcttaatattgatgctgctcttgattcaactagagattagggtgtacatatatatatattctcgctgcattagaaaggacacatttatcccataccaagttgtacactcaacatagttatgtttacatcccaattttaagagatcaaaagcatttcaagaacaattgatagaacgtagacctccaatataaccaaagaaacagaaaggatggctggagttcagacaaaatttgggctaaatttaaacaaaatttgttgaatccaaagcccaatataaattgaagaaatcatttgaattttttttgcttaaagttcaataactattcttaagaacacgaatttcttaaagtttagaactccaaaacgaagatttgatatgtattaaaaatgacatttcataggaaccaacttcatttttgcgacataatactttcctataattaaagatttcatgtttgtaagtaattttagtttagaatttatgtgttgcaaggataattagcattcaaaatattcacaaacaaaatattgacaaaaaaacaggttgccaatagaatcaggaacaatcacgcatatacaaacattatattcacatgtgtagagtaatatttcaagcacattaaattagatgcccgcgcatatgcgcgggcttcctttttagttgttctaattttagaaaaactatagtggcatccatccgatttcatgaatagtaatattatttttgcaatgcgttgtatttgcagtggcattgatccaattaatttttttattacctatcattgattaattaattaattaattacctatattgattaattaattaattaacatacttttttaagaaaacaacgaattaattaactgagccgaccctatccaagcgagccgaattaaaaaaagaaaaaaaaagaacaaaaaagaacatacgctgatcctatatccatccgccctctcgctctctggtccgcctcgaccgcgcgggtgcctcgattcttccgcctcatcttatctcccctcctccgttcacatttccaccccctcaccctccttttcacactcgccagcgtcaccctccatcctcagctcctcccctccccccacaaaactctcactctccccacctctccttcgatctgccccgtctcgcctccctcgccggcagtggctccctacatcccgtctcgcctccctcgccccctcctcctctccctctcacctccctcccatggtggatacggctgcggtggtggcgggttggcggcagccaccagcggatccggcagtggtggcggcgggtagatcgggcggcggatccctcccgcgccagatccggcggcggcggctccctccgcccctcttgtctccctcctgtggcagatctagcagcgtcagccacagccacgagtagatctagcggcggcggccgcgggtggatcgggcgacggtggcagctgctgagggcagatccggtggcagtccgcggcacgggtggatctggtggcgccggcggcagccgcgggcggatctagcggcagcggctccctccaccccatcccgctttcctcccgcggctgatccagtggcggtggcggcgtcggcgtcgtccgcgttggatccgttaattatggcggcaaccgtgggcggatccggcagcggcggctccctcctccgccttttttctctttctggtggcggtggtagcgtcggcggtggctacggatggatggtggtggccgcgaatggatgcggtggcgacggccgagggcggatccggcggcaggcgagtgaagttttgtgatgtaatatattgttatttttcttggatgtttattttgtgatcttgtgattgtgattgattttttggggacagtgatttgttgtgccgattttgggaagattccatgtatccgattctgagagtgattgggattcgggggtaggggctgcgaaggcagaccgctgacggatgaaggccgccttcgttcgtcttgtgacgaatggaaaaatacgaatcttttaattagttaagataacagtagagaagagatatagattaaaaccaaaatataaaattaaaaccgactcaaatacggatgacgaaccgcagaaacatcttcaatttttataaccaactcaaacacagatgacggaccgcggaaacatcttcagtttttataatagtaacataaaattaaaatcgactcaaacacggatgacgaaccgcggaaacatcttcaatttttataaccgactcaaacacggatgacggaccgcggaaacatcttcaatttttataatagtagagattgagttcaacatgctcaagggtgaatgtttaacttgcctttctttttcaaaaaatctcccgaactcttttcctcacgatagcgatcttccgaaatggcggaatctacaacatggcacacaaaacgagaaaaaacaccaaaaaaaatcaaataaatagtacataaaaagtaaaaaaacatctagggctcaattttagattaattttgtaggttgaacggctcaatttggagtttgtatgaattagttatgaattttaaaagtattgagccatttaaatcaatttctggaattaaaatcgattttctaaagggaaaaggaaagtgctgacgtcatgaaaggggcgaccagtgctcacacgggggccccacatgtcagcaggtcaatgggagggcagtttgtcatgacggagcgtctgatactaaaaaggtctaatactacaattatcccatcaactgagctagtggtaattaagcatggctaagcatatagttctaaatgggtcacataagtaacacgagctagtcgatttattacccaaggttgacaaagggccgatatcaagtaaacatggcacaagcgagtagataggtaatacccggatcccatgtaattagcaaaacaatgcatgtttatttgtaaacgataaaacatttgtaaattaggatcaaaatgctcaaggagattgtgtgacttgccttgtttcttcacttgtatcttctgaactcttatccttgcgaccgcggacttccgaaacaacggattctacacgctggcacgcaagacgagaaaaaactctaataaacaagaaaacagtatataaaaagtaaacaaacatatagagctcaattttagatgaattttgcaagttaaatggctcaatttggagtttgtatgaattagatatgaattttagaagttttgagcgatttaaatgaatttctataattaatatcgatttattgcgcaatttaaacgaattatgacgtcgccgaggggagttggtggcgccggcaagtgggccccacctgtcggtggctcaaagggcgggcgcacggtggaccgagtccacgcgcgcgctgcccgcgggcgcaccacgtggcagccacgtgacggccacggcgaacaacgggctgtggtggcaaaggcgtggcgccgaggtggcgccgatgcgggacgacaccagggcggccacatggacggcctggattcatccacgcgcatgagcgggcggcccgggcacgggcgtgactcaagccgactcggccgagccatggtgcggcggcggcacgcgaccggacgaccgccggcgatggcggcgcgacgcagcggcgaacacgggaagtggcagagggggaaaaaggaggggtagggaattctcactgagcgccaaaagggcgagggacgatgggcggcggtggcgcccttgcaggttggcggtgacggcgacggtccggtggcagccggcaaacacggagctgcggacacggatggccacaacctggggatggcggcaatgaggttaggagaacacaagatggcagagaacagcggggaaggacggccagaggaggaagaagagagagtgagctcaccttgcgcggggagaacggagtctcggtagcgattggcgagggtggggggcggccgggcatcatcaaggccctgcgaagctggaggtggagatgtgctggccagacgcggcgtccattgccggcagcgagcggctcggagtgacaaaggcgaaggttgctcagttttgcggtggaggcaaggtttcggtggtggaagggggaaatggggtggaggccgggcttggcctcgagacgatgaggccgatggaggtggtcgcgtggcacgacgatggctaggacggcggcgaggtacggctggaggcagcaaatggcagtgatagctcaggtgcacggtggaagaggagttccggtggtggtttgtggaaacggagtggtggccggtgtacggcgcgaagcggcgaagctgatggtggtggcggctcggtgcagagacggctagggcggtggtggtggccggctggacagcgccggcgagcggtggagctcgagcacgcgtggggagcacgggagagggcgcgaggagctcaggaggaaggggaaaacggaagaggagagcacggggaggctttttatagcgcgagggagcaacggggaggccgggtagtggcgaatttggagcggcaacggccggtgacgtggagctcaacgtgggcagagtgggggctcgatttggtgccaaaaactggggaaaagtgggggatttggtggaggaggtggaggggaaccgatcccacgtgtttgggcgcgagggcgcgagcgggagagaccggaattgggggcgacgtggggcggcaaaggcgccgcatggcgcggttgggggcggctggaggtaggagatggccccgataggtggggcccacctgtcggcggctcgaggagaggagggaggaggggggaggcgagctgggctggcggcctaagaaaggagaggggaggaggcggaagggccaggaagggaaaggggaggcttgggccgagcccatgagggaggggaggggattttaaattgttttctttttatttaaattgattaaatgaactttgtattattaaaattatttcctgagctccgaaaattcgcgggaaatttcagagagttcattagggcgcaaagaacattacaaaatattctcggccatgatttttaagtggaaaattttaattctcccaatatttcacttgattaaattgctttaacttttatttaatttctagaaaatgatttatttaatgatttttaatcccaaacaaaaatcggggcgttacacctacctctatagttccgtggcatattgcaccacttaatgatattcaataatctaaacatcatgcttacattactaaatattcctagaagcaatcatacgaatgaacattaagccaataccattgcatatctctggtaagctagccatataatgaatacgagacaagtataaaccaaagttggtactcgtatagttatgcaaataaagtaaaggaccacaacaatataaagaataatatttcattatagaataaagtcttgtaggagggatataaattattagaaccatacctgaattctccggaagacttgaagaactaggaaactattcaaattctaacttcactagcactagaacaaagtaaataaactatggagagcttcttctcgattccttcttggtgtgtgttggaggagaagatgagagggctacttataggccaagtgatgccttaggaatgtggagatgctaagcatcaaaagagtatcttcactcttgagctaccaagtgtcctctacggtggtttattccgatagaaacggttgcaaccgccttggatagtcggtaactaccgacatgtgaaatttgagggtcagattggccaggcctgggtcggccgacccaacccctggctagccccactggcccaatccttcatcctgggttctgcttggtgggtacttggtccagtggtgtgtcggttgggcccatttgcagtgcttccattaggtttgtgggcccttccatacattcatttgccacttgtctacctttgacagattgaacgagtgttttctaccatttctcctccatttatatggtgatcttctgtaagcaaatacaatgccaagtacgacaaagtggaaataggttatttctaactaagtatgcatgcaagcattgctagttctcaattatttttggaagtattgatgatcgaaatctatttataatgaccgtcaacacccacaccacctcccacgttgcgagctaaagctccactgcccaccgccgatctccggccaaccaccgtcatcgttctagaccagccgcactacgcctaggccgcctccagcttcgcctcgtcgctccacacctcagccgccacttccccgccgccaggaccaaccaaaaaattcatgtcctcatcacccagtgagcccctccgcgatctccatctccggcaacctcttcctgccgcttcgtgccactcctccctctcctaaccactctctcatcttccccaggttgtgccgctcctcgggcgcccctctaccgacgtcgctcgccgccggagctccgtccacggcatcaacccacgaggcgccgccaccaaatcctcgccaccgccaccttcccagcgcgcctcttttccgggtgtgcccagtaagctccccctctctctctccctcgccttgtctgctcctttctgttatttcctatgcctgtgggcctagacatacgaaggtaattaactaggagtctttcaaggccccaggaatcggaggaccacttctctaagttcgatctacccaacagttagccatggtgtgcatatacatattacattgggattggtatttatgatcctagaaattaatcaagtacatctttcttttgttctttgtttactttgtatacttagttatactgacaagcatgcctatatatctctctaaagagatatcctcatgtgttattttctgtcctaaataaggaaaaagtacgaattacacccctgaactatcgtggtcgaccgaattacccccataaactcgaaaaccagacatcactcaccctaaactttcaataccggatgaattacccccctcaacccaatccagagcggttttatcttacgtggtgtacacgtggcactccagtcagcattttcttatttttttaatggtggggcccacctatcatgtactctctcacctcctccttctcttccctttctcttggcgttctcgccttctcagcaaagcagcgcgcggcggcggacggtgggcggcgccgtgggatgcggaggcggcggcggcgtgggatgcggagccggcggctgcatcgctttctcctcttcccctctctctctctctctctcgggcatcgttgggtgcgggtggcgggcgcggctgggcgagcggaggcggctgtgggttccccggacgcagcagtagcttcaggggatcagcgacgacgcaccgcacgttcttgatgatcggcgtagagaatgccctgcacctgatcgacgcccgacgcggcaaagacgaagcatgtcgctgcaggagcaggagcaggcatggttgccatcgatctcgccgaaccattcagagctgtatcgagcaaagcaagtgatcgataatagatggctaccaaaaggtagaaagcagttaagcagaagattgtcaaatgctgttcacagcttgagcataacacacgggcagtaggtattagtagctagtcgtgtgtccctcggctcggtcttcgttttttctcgtttgatcatagccatgattttttaggcggtggcgcgtgttggtatgcatgccagttcagtgaacctccctccattgtatgcagaaaagacacgagatagaggtttcgtctagcaagcagccacaaatgatacatgcgaaaacagaatcggcagatctcgaacggtagaacacaccaaacacgtaaatttctcacaattttttcagcttctaaatgagtatacaagccggccatcttattgtacgtgtttgctttgttctgaaatgtgtagaaactactccatcttgcagcgaacgcgcggcgcactcatcggcgcgtgtggttctacacgaacgccgccctgacacgagcttacgttggctagctcaaacgctggacttgcccagccgcgcccgacacccgcgcccgagagagagagagagagagtgagtgagaggggaggaggagaaagccacgctgccgccggctccgcgtcccacgtcgccgccgcgcgcggctttgctgagaaggcaagaacgccgagagaggggggggggggggcaaggaggagtaggaggtgaaagagtatatatgacaggtggatcccaccattaaaaaaaagaagaaaaatgctgactggagtaccacgtgtacgccacgcaagacaaaatcgtcctggattgggttgagggggtccggtattgaaagtttagggtgagctatgtctggttttcgagtttagaggaataattcagtcgaccgcgatagttcggaagtgtaattcgtactttttccataaatatgtggtctttcaacaacacttttgcaaatatatgtgttgaaatacatagtttccacataccacggctcacaagatcacaaaaaaatatattgtttgaatgcaacaagagcaacagataaaacaagaaaaaaaaaacaactactcatcatcgctgtcaacttcaagtagagcatctccatcttcctcgctgcagtactcttccaatgtgtcatcgaaaacttcatctccatcttcacattcactttgacatacaagggttggcctttctttcctcaaacgagaaatctcagaagcttcaaacatttgtcctggttcatcatctctatttaaaggcatctcagttgttggttcatcaactactgttcggataataccctcctcttgatcatcacagcaatattcctcttgatatgcaggaccattaaatggtacagaagttttcactgacattgtatagatgtctatggtcaaatgtttggacaacttgccaattgttaccgaatcttgtatctggcaaataaaacacttttctagcctgagtagctagaattaaagaatcatctttgtaccatagacttcccacattgatgcttttatagaacccatcatctttcagagcattcctcccatccagtttataccaatcacatttgaacaacacaactgacctatcatcaccattataatctatctggatgatctcttttatgtttccataaaactcaatgagctcggagttatgtgtgcctagtgaaattactccactattctgagtcttcttattcttatcacggtccaaagtgttaaaccgcaccccattaactatacatgacttgtatttcttgattcttaaatcaggaccacatgccaaggaaaagatgtcatcatctaccatttcctcatctgtattctttctcagcatctggcataccacatagaacaataaacattattagaatgcatagcacaatgtgtatgataatttgtaaaagatgcttaatgaaatctaaccaggttcctaaaccatgtctggaatccttgtcgaattgttttttcaatgttagacacctcttccctttctaattcatccctgaacattctgtaaaaacaaaaaagtgtcaaaaaaatggcccatatgaacaagaggaagggagcatataacacactacataactgaaaacatacttgatatattcctcaacttgactacagttgttcagcacataccacaccatttgatctaatccaccatcatcatatactaattctgctgctgaagtaaatctcactccatgcccgaacacatctgcaccataggcttcttcattagaaaacccaacatttctcgcttctctattaaatcttgtttcaacatcgtccatgtacttggagcaaaatgttaggcattcatctgcaatatatgcctctgcaatggaaccttctggtcttgccccattcctcacataacgctttaaagtgtacagccgcctttcaatagggtacatccacccatactgcacaggacctcggagcagcgcctcctcaaccaaatgtacaggaaggtgcatcatcacatcaaaaagagccgggggaaaaattttctcaagcttgcacaataatacaataatttcttcattcatttgaataacacatccttgttcagagttttgctacacaatcgcttaaaaaagtttcccaactcagctactgcttcatatatatccttgtcaacaaagcctcgtacagcagcaggtaagattgtttgcaaaagaatatgacaatcatg

SEQ ID NO: 73102 - DNA, 4924 bp, Oryza sativa
atgtattgatgagaattatctagtgcaagggcatattatgaagcatggagtagatggatctttgatttactttttccccagttgtacaaatgaaataccattgccaaatacggggtatcatttgtacaactgccacgaactaaccattcccctgcagaccatagaagaattttttgcaggtggagcatacagggagacgcgcaacatgacaatgaatgaacgagagagttcatcatcctcaacacccttgatatgtagacgggggagatccagtacaacctcacggaacacatagctcaaatgcaagaatggcaacaatctactgatgctcaatattccaacttcaacaacatgatgcagcaacaacacgatgaccttcatgcgtacttccgttttcaggggttcaatccttatcaaggaccctgagcgaaagccaagcttggagggagacatttctccccccactgagataacttgtatcacattgcatatttccctttccaattgcatatttgctttccaattgcatcttataaaacttgaaaacaacataaaaatttgcaaaatagaaaataccaaaaagataggataggtttgagtcatgctaggtaatacaagctagttctctgttttataccacatacacattttgcacaatcttgatcttaagtatgtttagtcatctgctttagtctaagtttttgacctagtaataaatgtgaatgcaagtatgccatgtttgatccctaccgagctccacatatcaaacctgagagtaggaataaaaaaggcaaaactggtgaggaattcaaattgatacacttggagagactgagtgaatcatttgaggaacttggttttctttttcaaaattatttgaaaacttctggaataagagttgaatgaagattgggtgattggtgctctaattgctgttctgtctttcaactgcccaaggcaaggagaagcagtgtctcataggaatcaggagtaagggtaagccaccgtgccaaatattatttaatctgagagagagtacatataccttggacctgtatctttgagatatgcagcatagtagcaactcctgagggggttttgttgacggtcgttatcgatcagtttcaaccgtcaatattactaaaatagaggagaactagtgatacttgcaatgcatgtatatgccagaataataagattacactagtattaggtatactaaccttttgcagagaatgacaataaagtggaggagaatcgacatcaactcagacgaaaaatcaatcggacggtgtcgagaaccagacttatgtatgaatgggctaagaactcagaaataacacgacacattgggccaaaattcacaagtctacagaggaggacaacaaaggaggccgctagccgaagatgggctgggttgggccagcccatggttcccgtggcgccgatggatgcaggatttggatggacagctggtattgatccccaatgacggttggagggtattaccgaccattccaaccgtcacaaccgtcattacctgcctataaaaggagctcctcttctcacttcacaaacacaactcaagcaatagctctctcatttctctcaagtttagtttagtagtatctagctggtggaataggaatagagtagaaatcaggagcccggaagccttcagaagagttcgggtatggctcttgtagctttcctcttctcttttgtaagctttgtacttttattagaatactcttctatatacatttatggtattgaaatactttccgagtatatgaatgtctactttacaatatgttcatgttatactgaatatacggctagcttatctgggagatgctttggtgcgggtataatgtttacatatacaattactctatgtcatgacgatgatattagagtagtatctggtagattaggcttggtgtctagattacgggatatcattatttgagattatatattgcggatgacaggcgggctgttgatggtgacagctcagtacgggtattcctccgcgtcggtatataatcctaagttaattccctggggagggtattcctccgtattttgccccggttgtatggtcatgacgggctgtcgtaaggaacttggcagtcagggatggcttctcgaagtaccaggagggcatcggatagagggtattatctagtatatcggttaactagaatgtatgtatactatgtatattagaagtataagaatatattttctttctcttttctttctacttagcttagatattatattatgagaatgagtagctaatgcttgtgtgtcactctacccttggattatcttaacctctgcttagaatatgattatcacaagtaatatataacttattagtcaagttctctctacatgatcttcccacgggataaaataaatacgatacccttggaatactctcgggtgaaatgctacaatggtatatccgtacgcttgcggatgaactttgtaaccataatataccagatttctgcgtcattgctgggaattatatttctagtaatgtcgttaagaaataccaacagcgtccgccagcgaaaatcacgttttccatggcggcaggtgagagtccgctacaaaaaaaattgaggtgaataaaatccaccacccgcccaccgcccagtccgtccttgtccctttccccttctcccttcccaccgcccagtccgcctatctcccttctccgtctctcctccctcccttctccacctccgccagctcgtcgcctccccaccaccgccggcttccgtcgccgcggctccaccgccgcatacgaccgccgctccggcccctttctcttcctcttccaactccctctctccctccacggagtgcgtggtggcgagctcgggcgcgggcggtagcgctcgggagcaggcggcgaatctcgagagcgggcgctggcggagctcgggcgtgggcgcggcggcgactctcgagtgcgggcgcggcggtgctcggaagcggcgacggctctcgggcgcgggcgtgggcggagctttggcgcgggcgcgggcagagcttggacacacggggagggcagatccactgccatcggaccacggggagggcggcaccgatctcgacgccgttgaccgtgctgcccagctccctcctctccgacctcaatgccgtcaaccatgctcccgcggctccctcctccgacagagctgctagatttgatattttttcttttttttgcatgttgttccagatgttgcatatgttttgatctgtgtaaatgatgtttgatctatgctgatgatgattttatatttcgtgtttgaatttggaaatgagcaacgaatctagatgtggatttgaattttgaaattaatgaatcaatgggcggctgcatgggtattttcgctggcggttgtgcagctgcatgggtatttctttctggcccaaaatatattttcactgatggctgatttaacacagtcgctagcgaaaatggatttttgctggcgataaataaccgctagcgaagatcttgattttcgctggccattgttttgtggcggctgcaaattccgccaggaaaaatccaaaatggccgccacgaaaaatggttttcgtagtagtgactactactttgatgaagttaaggctcttcactccggatgttaatgggggcaaataagtacttgttggaaagatctcatctctactttcatatgcgttcgacctcatcatcagattcgatcgaagctactcagaatgaccaaaacgatatccacatcagaaacttgggcttgggacttatatttagtagagcccattagtgctcagaatgactagggtttgctcccacctcacctcctggtcattcctccacccatcagcagcagtagtttagacatcagcagtaaccaataacacttgggttttgtttagatgaaaaagtttagcttcagccacttcgttgtaattgcatgtgttggctagaccacccgaatacttgtattcagaaccccaactctgtatgtatcagtttcatcgtttggtaagtgttgtaaactattgtcttatcaacttggtcttgcttattttaatgagaattatacttctcgaagtaagatgggtggcttgtttgaattttcccaactcacatttctcgtttttcacgcgcacgcttcccaaactgctaaataatttgtgtttttttaaaaaaaatctatacatgtgttacttaaaaatcatattaatttatttttaaaatagctaatatttaattaatcaaacactaatggattgctccgttttgcgtgtttgaactttgaagggagaggttccaactcgaacaagaaaaaaaacacagcctcaggaattttgaaggaaggaagtggttttcttgataacgaataaatttctgatgaagtccgcggtctgtagacaaagtctattaggactatggtctcgtaatttatttctgcttcgtccatataaaacctggcacgtaggggtagttaaaaaaaaaaagttgccttgccgggttctttataatcggaaaactccgtgcaaagaccgagaagttgcgactgaaacgacttggtgccacaccggaatgtagtcttgtggaatagtatgcacaattgcactgtcctcgtcaaggtcaagttagtcgtatggctttctttcccactagtccctaattgcattccactagaaaatggaacaggtcccagtcgtttggtacgtctctctcatcaggaaaaacggaaaaaagatcaaaattgttggagatggtgctctgctagtctgctctggcctggtccggcttcttcacaccgtaatttcattaaacctatatttttctcatcttgtgaatgtggcaatagtttctcaccgaaagcgatgggctgcagga

SEQ ID NO: 73103 - DNA, 17168 bp, Oryza sativa
  unsure (1)..(17168): unsure at all n locations
caaaaacacagagtagggtattacgcttcgcagcggcccgancctgtatacatcgccgtgtctcgtgtgtcttgcgggcgggtgatttttccacatacagagagagagagagcttgggattgcaccctaagcccttggtcgaaccggcaaaggggggcttacgcagtctcccggtgaggggccacgagctccgtcatctggcgcgccaggtagggggctcagtgtgtgttttctgagctctcagactcttccgtgtgcgccaagtttttcttgttcagcctaatggccgagcaaggaaaagcgcacgacctctctccgagtgtgagcggcgacgacggggagccgaatccacgccgtcgagctcgtactcccccacttcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcgtcggctgctgcgcgccattcggccgccactccctcgtcgacacctccaactcgggaggatcagcatgagagccggatgcccgcatcgacatcgagcgccggcgtaataaccggcgtactccccgcgcaacggagggcgcctcttcgtccagagtgtcacctcgacatggacgtgaggatcagccctccgtgcccccggccggtggtgttgcctgtagagcctttgtggcgagtctcgggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgttggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggccctcaacatcctttcccccgcggcttttgatgccatcaaggccccggggatggtgctccgaccgtccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctaggtatgcccgcgttggtgaagttcatggcggcggtccactacgcctacctccagatgaagatgccgggccccggtggccccatctctgtccatggcgatcttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccggcggatatgcccggggtccccagggaggtgattgagcaccgtctcgccgtacgaccggatgcaaggccgatccggcagaaagtgcggcggcaggccccggaacgtcaagccttcatccgcgaggaggtggctagacttttggaggccgggttcatccgtgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttatcatcagattcgcatggctagggaggatgaggagaaaactgcgttcattacccctgtaggaacctattgttatacatcaatgcccttcgggttaaagaatgcaggtcctacttttcaacgaactactcgaatttctttgggtagccaaataggacgtaatgttgaggcttatgttgatgacttggtagtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaacatgcccttactcagctaaaggcatatctcagctctcccccggttctagtcgccccggagccaaatgagcccctgctactttacttagcggcgaccccccaagtagttagtgcagcgttggttgtggagcgcgatgaagacaatcctcattccgcgcacccccaccctgtgccgacttggcccgggagcaagcagggaggagaggcccccgagtcaaacggtggcctaaggcccctgacgaccggagacggccctctgcccgcttgtcagacggtgctgagtgcccccgaccctcaggaaggccccgaggccactgcgggaaggccgcacctatcgccctttggccccgaggctaaccctgtgctgactcgacctgggagagagcagggagaagaggcccccgagccgaacggaggcctgacgcccctgacgaccggagttggcccgttgcccgcttgtccgacgacgccaggagtccccgaccctcaggacggccctgaggccactgtgggaaggccactcctgtcatcctccgaccccgaggtcatcggtacagaagacaagtgccccccaagaggccacttggacgaagaacgccccggggatacggcccctagcgaaggggatcggccccgccgaaaggtgcagcggcctgtctattttgttagtgaggccctccgggacgctaagacccgataccctcaggcccagaagatgctttacgctattctgatggcctcaaggaagctgcgccattatttccaggcgcatcgggtcactgtggttacgtcttaccccctcggccaaatcttgcgtaatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaattcccgaggccagcacggacccctcacagctgcctcaaaccgcccactgggtgatgcagttcgacggttctctgtctctccagggcgccggtgcaggggtcacgttgacctctccgaacggagacgtcctcagatacttggtccgtctcgattttcgagcgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgatcccataggggagacggatgcgcctgaccggcccccgaggcccgtcggagtccaggcctcgggacccgaagggagcgctccaagctcccttagattgattgcttggatctctgagatccaaacatacctcacagatatgactctacctgaggaccgcgaagggagtgaacgcgtacaacgcatttccaaacgctacgtgttggtagaagggaccctctatcggcgcgcggctaacggaatcctcctgaaatgcattcctcaggaacaaggcgttgagcttcttgctgacatccatgagggcgagtgcggagcccattccgcctcgcgtaccctggttggcaaggcctttcgtcaaggattttattggccgacagctctcaatgatgcagtcgatctggtccggcgatgcagagtgtgtcagttccacgccaagcaaatccatcagccggcccaggccctgcagatcataccactgtcatggccatttgctgtctgggggcttgatatcctgggaccgttcaaacgggccctgggcgggtttgagtatctgtatgttgcgatcgacaagttcactaagtggcccgaggcttatccggttgtcaagattgataagcactctgctcttaaattcattaagggcatcacggcccgttttggagtgcctaaccgtattattacggataatggcacccaattcactagtgaactcttcggcaactactgcgaagacatgggcatcaagctctgcttcgcctcacctgctcaccccagaagcaatggcccaggtgagcgcgccaatgcagaaatcctcaaaggccttaaaaccaagaccttaaatattctcaagaagcacggcgattcatggatcgaggagttaccagcggtgctctgggcaaaccgaaccacaccaagccgagcgaccggggaaacgcctttcttcctcgtttacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgaccttgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggccaaccccgcacccccctcgggtgtgcaggattggccgggggctaccacacatgcacatatattcatttttcctttatttcagcatttcaatagaagcagtttcaattttctaaaggttgtgtctgtgccgttttttccttttgaagaatcttgacttgaaataaggtcactcatgcttgaccttgccctcgggggttcggttcggtcagctaaaatcgccaaacggggcccagaaccgagccgtgccccggggcgtggtgaactccgggggggaatcggcaaaaacctacaatcgggtcacccatacccctcggtcaccacgttcccggcctggccagtctcgacatgtggatctccccaggcactagccccgacccgagccatccaagggcacgaacccttatttcaagctaagacgcaaaaggaccacggcacagatcatcctcatctcgtatgtatagcaaaataaaactaacacaaaaattttttcatcatttctgattgcagattaagttaatttgtacaaaaaagaggcatgaaggccttagaagaaagaaaaagaaaaaagttaagattggcgggggcctgggggctcattctgacgcgcccaggtcgccggcctcgttgccaccgtcgcttgcactgctggcgttcccctcctcgtcggagtcgggggcgaacgcgagccgaggggccgagccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgccgggcccaatctcgcccgccaagcgaagggcctcggcctccccggtggaggagtccagcgctcgctgcatatcggcgacggtgtgttcggcagctacgaggcgggcggctaagtcgctttcgcccgcggccgccccaccgatatgcgccctcgcgtccagctccttttcccgtgcctcgaggtcagcagcccgctgctccagtgcggctctctcggcgcggacgcattcaagattgcggcgcgcctgctcctcctgcgccgcctcgcggagggacaggctgtccgccagccgtttggtcgtggcctcagcctcctcgagagctcgctcccgctcagcgagtgtgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggagaggtgggcccaggcgatgtgcccgcggcctcgtcgcgagcctccctggaggctgtcgcctgagggttgcccgagggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcctccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcaaagaaagagttagagctcaggcggcgaaggcaagaggaacaatggcgaaaggaaggaagcaaatccttttctcgatgcttttatacccttgccatcgctggccctggctcctcgtttctcgcgcccactacctcgctccctcgtatctcgctatctcgctccctcgtttcccgtgcccacgcttccactaatcccattcgcccgcttacggcgcaggaagtggatatgcggttgtggtaatcgaaatggattgtatcgtgcgcgcgttaattacgctcgccgactgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacacaatcgcccatgtggcctggcaccttcggggacgtcgggcccgagggtgaggtgtccgccctcctcctgatttcccccgaggggggggggtcgggttgcgcttgcccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttaaaaagagaaaggtgcatgtggtatccccttgagatataaaaggaggaccttgcccatttagaggggggtttttttccttttttggaaggctgaggggaaaggaagttaatcctttgtaacttgtccatacacaaatccacaaaaacacaggagtagggtattacgcttcgcagcggcccgaacctgtatacatcgccgtgtctcgtgtgtcttgcgggcgggtgatttttccacatacagagagagagagagagcttgggattgcaccctaagccccttttcgaaccggcaaaggggggcttacgcagtctcccggtgaggggccacgagctccgtcacacgtgcaatatcctgatttgctattggctaggaaatagtggggatggtgcatgcatagagtttgttgctagagtaaatatagtatgagagagttattagctttttttggtcttagtgtacctatgaaatatgtatatcaatttggaatggatggagtactaacaaacacacaaaaaattaaaaataaataaatattgcctgcagaagaatgcaggaggaagtcattctttcagttcagttaccttgagaagagcagcaagtgcagacttgaattcggcccttacggctagaaattcctccaggggttcatcatcccctgatgcaacggccccatgtatgttctctcgtaatccagggcctaggttaggttttacagagttaacccactctgcatggtttgctttgaactgagacctgaaatgcacacagttttagtgttttatttgatctccctgactccccgtcctatattgcaactctggctagtgaactagtacaaatcttatcactagacaacggatatgccgctaacaattatcagatttatctgcctgaattatgaacaagatggttggtgcaccagagtaacagtagaattccaattaaaactgtttggcatggtataaccttaaataaatacagagtattaccagcagcattactggttaccttagagaaatgttactacactagcaaaatgctcatgctttgccattggtaaaatgtccatactttgcgttgcttatgcttatttgaatataagttactcactttattcaaacaaacattagactattacataaaaatatcaggagcttatttgtaaaacattttgtcttttatagtagtatagataaagatatcttgattgaataagttgtaagtgagacctcagaaggctgaacatgacatgtgaaatgacagagagagctggcacggaaggtagttcgctttcagagaagtcagcaatgaacttccctatgcttggaacattgtcagagacgaagtctccaaggttggcattgtctattgcgtgacctgtgaaaaaaaatccccatcagacaagatgtatggtagaaagcaagaattttataattgtaagctacaacatgagtcaatagacgatttggtattactcactaccaaatttcttggctactgaagcattgacgatttgatatgtatggtcatcaggagaccctaagatttggaaacagtccatgggaattgtgacatgagttgggtgcttgacagtgtcatcaggaagtggcaacaacactttggttacacgagacaacgtagatagatctctggcaaaccaacctgcataaacaatagagtttttcagataatggaaatgattcacatctccagtctctaccaacaggctcaaaaccacttagtctaaaaacgataaataaaaatactcgaggttattttccctcgtaatgatatccaatttgaaaaaaaaagaagaaaacacatagattcaatctataacgatgatatataggaactaggccaattgcataagcaacaattgcatgaagaaatcagaaaaactcatcaatcagcaccactctgaatagttgtcattaataacagttgcttgtttgctcctccctgtgattgtgctataatttgaccagcataattatgcagtaaaatcaagtgtgtaaatttgaccaacaaattatacaagtatatagatgcagtagaagacattaatcaattaatggtaagagggaaatggaagtgaatagtaataataattaccaacagtatcaaacatttgtgccatggggatgacgttttgagcggaaacgaggccatgggaggtgcggaggccgaagatgccgcagtaggcagcgggcaccctgacgctgccgccggtgtcggtgccgagggagaagtcgacgaggttgggccccccgggngggnnccngnaacgggcganncggncggagccactggaggatccgccggggactctgccgggggcgcacgggttggccggcgtgccgtagtgcgcgttctcgccatagatgctgcgttgttgcggccaagaaattcaatcggattaattcttggatttcttatatatacacccctgacctacctgtatgccatctcgtccatgatggtggtgccgaggctggtggcgccggcggcgagcgcggcgaggacgacgggggaggtggcgccggcgggcgcgtgggtcctcgcccagtccgggttgccgaacccggtgacgcggccggcgatgtcgaagctgcgaattaaccaaaccaaatcaaacagtgagtcgtcgtcgtcgccgccgttcttcatttgagcgagcatgagtagtacagtacatgtccttgatggcgaaggtgagcccgtgcagggggagttgctgctacgacggcggcggcggcggcggcagcacgaacctctccatgaaggcgccgaagtcttctgccatggcgtcgcgacgcgtcactctcactcggcggctaccgcttcgatcacttggtcctccactcctcctctgcttaatttattaaggcggcagagcggctgggcctgggctgcacggcggcggcaaatggaggcccaattagcaaaacagcagaatataggtactgtatgactgaattatattccttaacattaaaatatatatttacgatcggaacaagtttttttttttttgagtaacaaatctggttaaagataggaagtgcaatgcttggaatcaaatgtactctaaaaatgtacacggccgctacaggtggcgtgtcagtattgttgtcacgccaagcaggctgacagttcagattttagaaataatttttgaaaatattattttttaaaatcaaaaaggttcaaaaaataaaaaagcctagtttcgacaagatcagcacgatggcacaacactgaggcaatataacgagttggtttggtttgtggcctaaataggtcattgccaaattttagtaatttttggcatgactaattttggtaatgcaaagttatgtttggattaaagccaaaatagcctaagttcactattgaaatggcctatttttttaggcatgccaaaatttggcttcaaagcaaatagatactaaacactattaaaattgctaaatattggtaagtctaatttaggcctcgaaccaaaccagcccaacataacagcagaaactatttagaaaacttcgcgtgcatacgaaagtcctcattggggatagagggaacagaattttcaccgaaataaaaattccttcagaaatgaagcggattttttcttttggcggtccaagggagtcataatcccttgtcacggtaattccctcatcacatattactagtagcagctctctatgtttaaataaacatgaattgtgtcgtttgggtgaagcaaaatcatgctgctcccctacaccgccggttcaagtaaacattatcaggcagcatggagctccaaggctgggcacaagctttgaagagagatgaatggtgttagccgttttcagctcgatcataagcattggatttgtgcttgggtgtaaacgtaaacccttctggaactttgccaagcaacatctctgagatcctgatctgtacgtacattagacaagatatatattatcagcttgtgatagctagtaaaagatagaaaccatccaacactcagaacgaggacagcttacccagtcagctgctgaatcagagatcattagggtttcaagatcatcacggccacagtagcttgggggcctccagttcaaacgttgcgggatcacatccaacaggccaaccggtatgtagcggcaggtgtagcttagccattctagtaaaaaatagcgtgttgtttcaacacctgaaaatacacatgataatttgatgatcaagacaaccctttcaaaatcaatttgatttcatgccgagcatttcagtgcagcaagaaaaaaaaaactgtaactcgatgatgagcagatattatcgcattccaggcctcacaaaactcataatctgagccaatatctggcaatagagagaacctacctttggaatcggaaccccagtgttccagaccaaaactcacaaaatctttaagaatattgaatctctcgccagatgtaatatcccagtgcctttgttctttaacctcagtaaatatccaaggctgtcaggtgaaaaaaaaaaccatgcattagcacaaaattagcagacatgaacttgagggaacaaaagcctgacattacagctagcaattatagcatttttctcatgatagatgttaaagtacatatactgcagcaccaaactaacctttatgagtgcacctcgagcaatcatgcttgtcgatattttagagcagcctgaaacatgtttgttccagtcagtaaaagagaatacatcaccatttccaacgacatgcaactggtcaggggctttctggcacactggtaaatataatcccaatcagcaagtttgctgtagcgctgttgccgggatcgaccatgtactgttatggctgacgcaccccagtcatagatgtcggaaactatagaatcagcacggttccttccctcaaagaaagcagttcttacctggaatcaagcaacagagatcaatatgagcaaagcagtgtttatttccattttaatatgtcatacatgtcttagcagccccctccccatgtaccttatctctaattaaactttgcattgattaccgatcatgagacataaaatgttcaagcaggctaagtccacccatagatagttttccttccaaaaagtacgctaaacatgtaaaatatttggtttttcaaagctctgattctagttcaaccctgttgaccataaatgtgacaatgcattggcagatcgacatctggatgaaatcaccaaagccagaacttttgtcctcaagtgctaattagctcctaacagagtataactgagctactgcaccattaccttaacagttaaaggtttttcagtaacagtggatgctgcttgtacaatacttttgatcctcataggttttgttagcaatgatgatccagcacctttgttgacaacaatatcaattgggcaccccatatttatgtctatgaaatcaactgaacattcgttatccacaagttcaacggttcgtgctactgtatctggataggctccacaaatttgcaccccaaacaaatcctctgatgaatgccgtcgcagcaaagcccactctg

SEQ ID NO: 73104 - DNA, 15738 bp, Oryza sativa
  unsure (1)..(15738): unsure at all n locations
aggcaagtcatccaatatgtttgatcatattgtacccaatttataaatatcccgcatttctattaaatgttgcattcttttacaatgtcatgtgggatgggtcctactactcagccatatattgatttccttatgccattgacaacttcggtattaaaatgactagatgttggtttaggaagtgcttagccatgcttagttcaactagtacacaaatgggggtcacattattacatagactttgactatgagcatagctttggattggtgccaccgcgatggtgttagttaattaaaatacactgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcagccggggtgtccggttgtctagctgccggattcaccgcggcgcaagaggggactgcccactgccttttgaggggtgggggtgaaaccttagcgtggtgtggatggttaggggagggttatgcggagggtcttgtcacgattttcccctttgcagtatcatggtgatacttcggggcatggcgacatgtgtggaatcgtgtcttgtgggtacagttgtacacctctggccagagtaaaactattcgaatagccgtgctcgcggttatgggcgatcaaccagattcaccgtgattagtctcacccctagtttagcttaatgaactgctgtagttcaggtggatggttgggcctgttgcaacgtggtgtagcgttggacagtgattggttaatattgattaattactacagctgttttactgctttcaactactgctttgaaatgcctactttatgcagaagaacccctagcttcctttggttatatcctgcatcatacctcctcttccggtatgacttgctgagtacagtgggtagtactcagtcttgctctcttttcccccacaccagagttgaagttcttctcagttggagccgtctcagaaaggttggtttcgtcgctgccgtcaaggtttgcctgtggagtggagtggcccgctgctgaagtcaagcttcccggtttagctcgctttaatctttcccgctgcatttgtaatcttttatattttttgtaagacgtgggtctgtatgtcaacaattgtcgtttgtgtaccctggcttgtcctggacagggatttaatgcacattcagcttagaaattctggttcgagaatttctgagtgtgacatcacccatcctagccgtgaacaaaagtaccgacccaaccttgcctacggtaggtatcccgaacaggcaggctaggattgagcccctagcaacaggatcttgaccgggtgcgctacacacataggggtgagaccacccgcgtactagtccagtgccatgacatctcgactaacggacaccggcccgtgcagccttcatttgcctagacatctcgattaccgagccgcagctcacgtagccttcatttgcctcagagatatccatcgtcgcaacgaattcatccatctctatccgtgtccttttgttcaggactagaccgagcaccgagttaagccttaccaattagtcatgtggttagtacggtagtgctttgcaacagaggcctgagcttaatccttggccggggttctacttcccacaactggcatgcacccaaaccccaccggaaaacaggttttaggggttttgaaagaggaagagtggggcatgtccaattccaccataagccaaccattccatagtgtccaagtgatatgagaattcccaaagtctaaagttataaaaccacctagtgttgcctaattaatcagcgaagcatctacctaaattcatacaaatggaaccatgaatggagtacccactagttggggttttattttccttgggtgaacaaggtaataataaacaataacaatgataaggctataacaaggattaataggaagtgctaaataaaatagtgataatgcgggaatttaaataaagcggtaatgcaataatttaaatcaaaatagttttatatactaggattcaatatgctcaagggtgatgcgacttgccttgctcagagagaacggccttccgaaccatcggcgacgacagcgaaccacgcttcgggaacctccggaatgacataagctacgcgaagcacacaagcaaagctacaagcctataaagaagcaataacaatacataaaaagaaagcacatggttctttgggttataacaaacattaggagacttgaacgggtcgattcggggttcgtatgaccaagacatggtcatccaaagtttactgctgttacatgaagatttgcggattattataattaggctttgcaactataaaacatgtgtaagcgctagcctggaaaagacaggaaggctgcgcttgtcgacatgcagaccccacatgtcaacccaaaggcccacggtagaccgagtacacagagacggtccacgggtcgacggaagcggaccctgtttgtcaaccaaggtgagtggccgacaaacggactccactagacaccatgcgggctgcacacgtggaaaccacgcgactaccgagcgggcacactaacacggtcaccacatgcacacatgaacgactactgacaccggtacacgggtacctgggtcgacaaccgcacgacgggcacggggcgacaccaaaaggacgagaacggggtagcgagaagagggatccttaccaccacaagacgaggcgcggaacgacgatgacgaacgggcgcggcggagacggctcggggacaacggaggcgaacggtgatggaatgacttcggtggtgatccttggacgaaggcgagacgaggcctgcacaaggcttgacgacacggagccgaggacgaagacgacgaagaggctgcagcacacttgacgaaacgcgatcggcttgacggagggacgaacgccatgacgaccgggaatgacgagagggggatgatgaccgggccggtggggaggcgacgagggcagccggcagcagctgcacggatgcgaggacggcatggaacacaccgctgcaatgccgacgacggtggcggcgcaacaagatgacgtgccggcgaggaggatcggccgaccggaggaggggatggcgacgtcggatggagacgacgatgacaaacaccggcggggtacgggtggaggggaggcgaggccgagggcgacgttgccgctgcgatgccggaggagacgacgacgtcggccggcacacgggcacggaggaaggagtggccgaaggaaacgtcggtgaggtggaaggagaggctagggtggaggtcgatgccgcggtaccgaaggaggagatggcgacgtcggcaactggaggtggtgcagtggcggcaacaccactggacgtcgacgaggacgcgcctccggcggtcaccgcgcgaaatggagggcaggccgggggagaggaggcggctgcgacgccgagaatggtgacagcacggcctaccggtgcatgggcgaggcggcaaaggcggctggaggtggccggcgacacgggagagagagaggagggctgcggggagaggcggtgcggccacggggtggcacgggaggaggctaaaatgagagaacagaggaagaggatcccattttatagcggaggggagctagccgggcacgggagagggcggaacggcgccgagaatggctgccggcggccatggaaggtggccggggatggcgcggccgttccgggcgattgagggtgccattcaaggtggaaattaggggggattgaagaggaaggaaatgggattaattccccctaatcaatttggaaagaagggaattgattcgcgcagatttgagggaggaaattgatagggtttcatgggagaaggaggagccgggcgggaggaggacgacgaccgggtgggtgggacccaccagtccgcgcggtcagcgcgcgtgcggcgcgcgtgcgcgggagggctgcggctcggcttgggccggggcaggcctaggcgggaggaggagaggagggagtgggacgggaaggagaggagagaagtgcggcccgggagaaaaaagggagggggagggagatgggccggggggggggagaggaggcccgagagaggagggaaaatggagggaggagagaaagactttgggatgaactcggcccaaaggcggaaggaggattatttttagttttctttttaataaactttgataaaggttgttgttgcttatagttatttccggtgttctgaaaattcaagtaaaatttgagggctcctttttgaccaaggagaatttaacaaaaattctccgggccacattcgaatttttcttgtttgctttttaaggtttgccaatttcttttcgagttttaattaattctattattccttttagagaatgatttttatttcgagatgaatttatcaggacgtgacacctctggccatagtaaaactattcgaatagccgtgcccgcggtaaatggcgggttgagcaatatttttcgtgattagtctcacacctctcacaataattattgatgctataactggtaataatttgcttagctcctggtttggagttagatctgtacagccgggtatgtttgttcaggatggttgggcctaagcagcatgggtgtgctgttcagtgttgattaatattgatgattaattactctactgttttactactcttaaatgtttgcttaatgctagttttccaaatgagcctatattatgccatccttcggtatccttgtgcacttgcatatttgctgtgtggcttgcggagtattccatgtactcaccttgcaataatcaatcaaacctcagttgaagagaagtcgcaaagaagaggacgtttggcttatacccaagttgagcttcctgtgggagtggagccggagcttcgctagaccatttatccactgctgttttttttttttttgaaagatgcaatgttattattttgatggacttgtatattaaaatgtcagtttgtgtacctcggctgattcctggacgaggattttatgcacaaataacttcagaaattactagtgaatttctgggcatgacacgacgtgtcgtggggttgtgtcttgtgggtacagttgtacacctctgatcagagtaaaaactatttgaatagttgtggccgcggttatgtgcggtcgaccaaattcaccgtgattagaatcacccctagattagcttaatggaactggttagttcaggtggtggattgggcctatctcaacgtggtgtagcgttgagcagggattggttagtattgattaattattacaattgttttactactttcaactactgcttttaaatgctagctttatgcaaatgacccctagcctcctttggatatattttgcatcataccttcccttcctgtatgacttgctgagtaaagtggatagtactcagtcttgctctctcttccccacaccagagctgaaaatcttcccagttggagctctcccggagaagttgggttcgtcgttgccgtcaaggatgcctgtggagtggagtcgccccactgcaggagtcaggctttcaagattagctcgcctttctcttttccgctgcatttgtaatcttttaatgtttctgtaagacatggatctgtatgtcaacaattatcgtttgtataccctggctggtcctggacaggggttttaatgcacattcagcttagagattctggttcatgaatttctgggtgtgacaagttggtatcaaagccgaccttgattgtaggacaagctaactggaaaccctaagagcccttcgaatccttttcatttgcatatgctctttgcaattggatttgtttcgggaaaatgagggtttgttcttgtggttgatgggaaaaatcttgatcgcttgttcaattgaaatttatgaaaatgagatcagtctagggttttagtaaaattctagtttgaatttatttgacagtcaatcgggatttatcggggtatatgcgttaattcgtgtctagacttgatggggcgcaatctttatgcgcatcattactactatgtagtatctattttgggcattaatttattgcttagttagtgtcatttcatgtacaatgctctatgcataaaaaaaatagtgcttggctagatacttgagttatttgttgttttgtttaatttggatttgagcgtgcattagttcctaccccttgtcttccttagatgtcagacctgttccttgatcacaagtgtcgctccaagctttcagagacaccgcctttagctttattgtcttcttagttgtatgcttggtttctgtgtttaggtttgttgcttgtgggttagtcggcggtcgatatcatgtgtcagtggtatggttgcctgaattaggagttgcttgcctcctttgtagtgttttaattcaagtcagatcaattgcagttaaatttataataaagattagtttctaagccatctgttttcttccttttctcttatttctatctatcccctcaagatgaagtcaaggaatggtcgcagtgtctccaatgacgccagtggcagcgaagagcagatcaatggagcacacgccaacggtgcaactggcagcagttcatcgccaccgttcgagaaccgaacgatcactcaggtgctggacaaccatactcagatgatgacaacgatgacgaaacaaatgcagcaacattaccatcagatgttgcagcagacgcagcagaaccaacagtttggtcctccaccatcgcacctgtccaaactgttagactttctccatataaagccactaactttctcaagcaccaccaatccaatggagaccaacgaccggctccattctattgagaagaagctgaaccttttccattgcaacgaccaagagaaggttgcttttgctacacaccagctgtagggttccgcttatgcctggtggtaacccgtccagctgcaatggaggttacgtgggtagagtttcgtcaaagcttcaggaaggcataggttcctgaggggattgtggcacaaaaggagagttctgttctttgcaacaaggaaccagcatagttacagagtatttgcacgagttcaaccgcctcgggcgctacgctccttaggacgtgtacaccgatgccgagaagcatgagaagttcatgtcaggtcttgatgatgaattgaccaattagatgatctccagagactctgaggactttgagaagcttgtggacaaggctatccgtcaggaggagcagcacaacaaaatggaccgaaaaaggaagactagtcagttcagggtttccccggggaacaatcagaagcctcgcttcatgactggacagcaggttcgatcttccaccatgattatctgtcagcaccatccctacaacagcgtcaaccacaacagtagtgggcagcaccaccaccaccaaactcctcacccactaatggctccaattcagtcaggtctgccagctatgtcagctaagttagaacagcctgttgacggtcgttaccgataaatttcgacagtcactataactaaaataatggagaactagctatgcatacaatgtatgtttatttccaaataatatatttccacttgtacttggagaataacatgttgcaggaatttatcaaataaaataaagagaaaatggagaaaacctcactcctaagcaagcaaatggataagatgggcccacatgtaatacgagtaactgggaagatggcaagacagaatctgtctcgcaacttttcccaactaccgtttacacatccaacggtagaggtgtaccattgcttcgctctctcttgaagggtgaacggaaataatttccaccatacaatttcttgtctcatgccacgaatcttaaggcatgagtagacttgttcaaagtcccgtagatgatggtggagattttctagatctaagccagaaaaagggtttttccttaaccatgctgatgagttcggcgcgaatttcatagctagttgtataaatcggctccgatgaaggaggtggctcatagaattcgcccctaggagcagacacctcgaagagaggttgctccatagttgagaagagtttaaaaggaatgcttctctgggtagcaggggtggaggaagaataaaaaacaaaaaagagatccgaggatgaactgggttcggaaatgattagcaaccgttccccagcaacgacgcaagatatgcttgttggtaattcttatggtcatggataaaatccgcaagcgcacggatataccgatgtctaagggaacgtgtacggtcagatcttcttccggttcatccaaggacacctagcaaaggataggctaggatagagaggatttactagtgagaaacagtgtcaagggaaagcttatgtttaatcctaacacaatacttcaggtactggcaacccgctgttcctagatgtcgctctactacgtacccggtcagggaggacttaagtgatcttgagggctgtcaccacctccacacctatgttggtatttcttacgatcacagatagaatccgcaagcgcacggatataccaatgtagcacttcccctatggagtattccaagggtatcgaatccaagggaacgtgtgtgattatctcttcctccggttcatccaaggacacaaagctaacgtgggcagagggcagagaggatttcctaatgagaaacagtgtctagggaaagcttaagtttaatcctaacgcaatacttcaggcgctggcaacctgctgttcctagatgtcgctctactacgtacccggatagggaggacttaagtgctattgagggctctcaccacctctacacccacctcaaacgtactgtgggatacgcagcaaccactggagattaattacccagacaccacgtctacgcaattaataactactctagtgccgatcaaacactaaagcaatcactataaataaatggactacagtgaacaatgatcccgtatgctaattaggaactaaccaaaatgtaattctcactaagtaaatcttaaatactcataatgatatttctattaaagcagagtaattaagaagatacaaaagtagaaagagattaccgacaactccgggattcctccgattccttctaccttactctctcgctattctaatatgcaataaagtacactagagcctcttgtaatttagctcatgctttggtgtgtgtgaatgagggagaggagaggggtatttattggtggagagttgccttgggagagtggagatgctctaagcatcctatgagcatattccctctagctttatctcctcttgacaagtgtcctctctatgacggtttccactggtagaaatggccacaaccatcattgggatgagtagtacaaccgtcatactgaatatgggctggactgggccagctaggggttcggccgaaccaccctggttggctcccctggcccacatctttcttcaggatgctgacatgtgggccccacttcttgatgctccattttttggctcaaaatgattgcacattttatatattgtagctcaaaaccatgtgagtttatcagagcaaaatatatttccattctttatgctcattctttcccaacttaggtggttgatcacctgcatataaatatacaccaacactcatggaaattgttagaaataaatcctacaactatgttagaagtttcacatttatggttttatgcaggttttgacggctttattttggcacttaactgccgtcaacaaaaccccccacactttgctctttactcgtcccgagtgaaggttaaggattaatgtggaataaaatttcccaagatataatacaagtacacaaattattctaagccatacctgtacctgtgaactattgaagtgtctaacttaccatcttgggcaattgatgaatggaacgatcgtgactcaagtcctccttaatcctcctatcaatctcttgggatttttatatattttcgcaaagtagctatactcttcgaataaatctctcaaatcactcacgtggtttgatttgcggatcctcaccaaggcatggttgccgatttgtccctattctaaaaggctatataggtggagctcggtagggatcaatcggggcatacctgcatcaggtatattgcaaagccaaaataccagaccgaaggagatagcaagtcatactttctgatcaagaatgtgcatgtgtgtgatatgtgtatgtgtataaaaaaaatgtgtggatggaaaaggaaaataaaagataacaactcctttggtatacctcctcctccaattctttctcttggaaatttaagagagtgcatggctatttcttttcctctttttatttcatcatgccccatacttcgtatgagcaagattctctttattattattattatttttttcatcaatgctccattcttgtatgagaaagactttatttttttccttctttttcatagccacgcctttctctctgtttctttttttctttgaaagaattttgaaagaagaggcataaatgacatggagtatttattttgtggataatggataaaataaatgatggatgagggatgctagcttccagtgtagaagtttagcatagtgtgtgtatgtggagtgtggtgtgatcttgatcatgaaagtatgaaagcatctcacatgggtgacaataatttgacaaagctgaatgtaatgccaagcagcctaaacatatatcagaattttgcaatgagaattatatatggccttagtaggtaataatatagttactaaggagtattgctcgaaaaagtttttattttcgcaaaataaaatcccaagtatcatgacagttgtataggaatttcttttgtcataaccatatcacataacttagattagcaaggttccctatgatagatgttagttcacaagtgacaagtgttagcaaagaataaaaagtatacatgattaatcataggagaactttatttgttgagagttaaggttttcaattttcatttggagtcaaactaaatttgtattcaatttttccgcaaaagtttaactcacaaactagggaggataaggaaggagacatgcaaacctgaccacacggtagaagggtgacagagctggtccaagcaagggtcgggcgaacacttggttcggccgacctagccaggacatggttctgattgccgaattttgtgcgcggccgtcagctggtgttcatcaggttgtcatgttgagttgatgctattgcgcgtcgggagttccgaaaagactcccccacacttgttttgtaccttgtctttattcaacaaaaaccataaaaagcaaaatgggcttccaccgggttgaaataccggtgagccaaattttattcaaataactctaggcgcatgaagtgcctattttttatttcattttcatttttttatttttttatggcaacaatgagaatggtggttatcctagcagggcggatatatgacgtcatgattcacagggtgtttgagattcttaccagattgtacttaccaagctttgaaccaaatcgatggtaacaaagtgttgcatttgctttgcttggttccctgtgcatctctctcataaaccaaggatcttggtatggatgttggagttattgtacactgctccttagttgtcttttttatttcctgcaaaatgttagtggacaacaaatacccgagggactacaaagatttgaaaagattttatcatagcctcaagattagttgttcacatccatactaaaaaggaattggattctaaacttaaagcgcgtggatcccaccaatttgccataattttattttgtcatttttatttctttttactcgagagtcatttcttttattattaaaaacatttttttcaaaaaaaaatttttgttcaccaaacttttattcaagcaaaactcatacagggctgagataaacttatataacatagaaaaggagcatttggaaatatacgtaccgtgtaccttgagaggtgatatgtttctcctttgtatgttttggcaattgatttgttcctggcccttgacttacctccagtgtgactcgtgcttgagaactcacccatcagattgaataatttcctgtaggggttagtccacgaagggtatacatccaaagtccatgaaagtactggctctacggttcatttaaacaaacttgacaccatgtcaactttgattaaagcaagctatttatcctaagcatcatgcttaatttgagaagcctatgaatgtcgacgaccacccaaaccataacatatgaaaatagaccgaggacgcataaccatgcatgatcaagccagactcaactagagataagtatgagtaatagtaatggtgaatcttttgttgtatacctgagtatatttacagccagcatgatgtatatgttgaaatctttggagcggtggcacggtcaaatgtgattgttgttctttcctccatctggatgcaggttgtggcggaggaaggcactttgaccatgccaactcaggcgagtggttcggttatgcacacatcttgggtgcaagaaccttatgccttgaaggcatgttccgtcggcataatgctaaagagacataggatgcatctcttttcgggcaagtatgcaagtgctaactagagtggagcagcaaacagctcgaaaagaagagggcatttcctcttggttgtatgtatgtaggtgttgcgggagcgagaagttgtgcacagctaggattggatgaaggctaagccaagtcgacacatgagctcaagagaggggctgggtatagcctggcagcatggttactactagcaaggtgtatagccatattttaaagactcgcacataatgcggtctttgatctaaatgtagtccgtttgctctcttgctgtcctcttctcccatctcttttttttatatcttccgtctctcttttcttttcattttttttcttgttcttttttttcagcaaggtaaaactaacaccaactgcaaaccaagatggccttggttgatggaactcatcatacaagctcgtcaacctcccccacacttggactttgatgtcataagacatcaaaaaccatgtgtgttatgttggagtcttcataaagtgtgtttcaacaccaaggatcaccaaaatgtacatttgatgtagctcccgagttcttaggcatcgtacatccctcgttcttaatctcaacctgaaatggttagtgaccaagaatacccgaaggtgcataatatcctaaaaattggttttttcttttattggaaagacaacttaccaagataatccggggtatctcccggcagtgctttctttatggtcacaagctcgaccatggagacatctcgttacaagattagtgccacaaacacatacgagatttgcaatatttatgataaacaaaagcatccacaaccaaccttctaaacatgttagagataaggcccgaaaggtggttatggttctcacacaaggaagtgatactaatcggatagaactctaaggattctttatgtaagcatgaatcctagggtattttgaaagagaagttttcatgctcatttgtggagttctcatcctccagagttgatgtctctaacttgtccatggcttgcagtttctccttctcaagagatgcatcgtgcaagaacaaggttgtttcttgacaaatgtcgagaacaacattttgatggccagagggacaaggttcaggctcgataggaggttgtgatggtggttctttggactgcaattcaacggtcttgccagaatctttttgaatgaaatgaagatcatcctgttctataatagactcaggggactcatgaagcagaactgccattgcttcctctatcggtgcatcatcagggggtatgtctgtcaacgagttctcatgatcgttatggagatcacccctgaagtctagagcgcatcccgaagtttgaaattcttcgttcttcggtgctgatggctcgagagaggataccttagctgaaactgatggtgtggaaggatttgattcagatttggctattgaaggttcctcttgttttgacaccgataccttctggaggggttcagaatgttgctctatgaaggaggtgatttctagaattcggtctagaatttccttgccttcggatggagttttgtgcatgaacgtccctccggcagtgatgtcgagatggaatgcagactccctacctaaacccgcatgaaaatgctgtaatagcacgtaattgggtatagacagggttggaccagactgaactaaattagtgaatctgaaccaggctgcaccaatcgattctttatttatctgctggaaactcagaatttctacatgaagagtagtaatacgggttaattagggggcanangcactattgcttggnaagggggggtcccccaaangggnttaaaaaaacccccaaaatttgggggtttttcccctttttttaccccaaaaacccattttctagtaccgtttacacacccaacggtagatgtataccattgtttcgctctctcatgaagagagaacggaaacaatttccaacgaacagtttcttgcttcatgtctcgaatcttaaggcacgagcaaagcttttcgaattcctgaagatggtggaaggggttttcctggcctaaaccagagaaagatttctccctaaccatactgatgaattcgatacgaatttcatagctaggtgttaaaattggctccgatgaagaaggtggctcgtaaaattcgtcccgaggagcgcacaactcgaagagaggttgctccatggtcgagaaggattgaacaggaatacttctatgggatagcaggggtagaggttgaataaaaaggtaaaaaggataaggatgaacaaggttcggaaataaacagcaaccgttccctagcaacggcaccagaaatgcttgttggtatttcttacgatcacagatagaatccacaagcgcacagatataccgatgtagcacttcccttacagagtattccaagggtatcgaatccaagggaacgtgtgtgattatctcttcctccggttcatccaaggacacaaagctaatgtgggcagagggcagagaggatttcctaatgagaaacagtgtctagggaaagcttaagtttaatcctaacacaatacttcaggcactggcaatccgctgttcccagatatcgctctactacgtacgtggacagggaggacataagtgctcttgagggctatcaccacctctacacccacctcaaacgtactgtgggatacatagcaaccactagagattaattacccagacaccacgtctacgcaattaataactactctagtgccgatcaaacactaaagcaatcactacaaataaatggactatagtgaacaatgatcctgtatgctaattaggaactaaccaaaaagtaattatgactaagcaaatcttaaatactcagaatgatatttctattaaagcagagtaattaacaagatacaaaagtaggaagagattaccgacaacttcgggattcctccgattccttctaccttactctct

SEQ ID NO: 73105 - DNA, 27636 bp, Oryza sativa
  unsure (1)..(27636): unsure at all n locations
tgattagcagcaaattcaagtcattcattatccatcatcacatcggtttcagagagaagtgtacaacaagattattttctgtgaagaaaatagttaccattcgtggaagcctagaaggcaatgttcataataggattataccagaaggctaaaaaggaatattaagtgagaacttgttgactcatatttgacagactaaaaagaaaatgcatactttcagagcagacacctatgcaggaccaactattttatatataaaaaagaacatgccaatagaaggtctaaaaaaaaccactgcattggctcctcgaaaaacactaaagtaactatgtctgcataattatcgggagtgaatctgacaatgtgtgtatcaggatctatcaagcatctctaatagcaatatgattttcatgtgcactgttcatagtgtaattgaggggccattttgcaattaacaactacaattaacagcagtgggcttaaaaggaatcttaagtgaaaacttgtcgactcatttgacagattgaataagcacacttctacattcaaagcaggcacctatgcaggaccaactattatagaaggtgtaaaaagactacccctgcattggctccctcgaaaaacactgaagtaactatgcctgcaaacctattgggagtgaatgtgacaatgtgcgtatcaggatctatcaagcatctctaatagcaatatgcttttctaagtggaaattgcactgttcatagtgttattgaggggcaagttttgcacctaataactacagttaacaacagagcacaggcattcatagttcaaaacgggggaaagaaaataaaaggactctgatctactctactatgcagtgatccttacggttttggaggaggagcagaggaaagactcttaagaacagaagatggaatagtaaattatatgatatgtcatagagcctaagagagagatcggcaacaatttggtgccacaagcttagttaaggcaatggaacagtgtaagactgatggcagccatagaggtcaggatatagcaataaagacatcagaaactcatattctgacatcacagttcataaccaagaaaaacacggactcttccagtgcactgaaggaaacatgacgaacaggtacccagtacagacgaaggcagcaaacgtgacacaactgataacgccatagggagatcttggctagacgatgccatttgcctattgtcatcgagagcttggcatttccatggaacttacgcaggtgcacgggcagcagactggctgtggagctcgcacgggcgcctaagcatggtaagatcattgcgatcctggatgtcaggccagcactaacaagccccaagcacacgatagagttgaccgtcgtcgcgcacgattcaggagagaaggacggcgaactgagtacagagctgaaaccgagatgagcagggctgccggttcagatgccgcaggcggctccggcatgataataagctttggcacgcggcggtccaccctggatgccgctccccgcacttgccgtcacgagcacggcgcctcgtcggagccgcgcgacacgacgaaagcatgcatgctacggcaagatcccatgcctcggcggcgatggaagcgggacgaggcggcgcggcaaccgccagtgctgccagctcgccgaacgagaacaactcacagggaccgaccgaccgcgccggcacatgagccgacacgaaaccacgaaagatcccaccgctcgtacgcagcagcaggagcgctcacgccgacgcgtacgaacaaagcagccgccggctgggccaggcaccttcccacgacgtccgctcgctacgccaggcaccttccgacggcgggccccctccgccaccccgccaaaccagtggtaccacgcagggagggaggcggcgcgatgacgacgccaaatcgtgacggaggccagaggaagcccaggcccagaaaaatggaaaagggtggggggaaaggggtcaaagagagcagangggaagttccacggcttacttactcgtccatgtcgccgtcgctctccgaagacgggctgtcgcggtcttcgtcggcccctccaccaccaccgccgccgccggcctcctcctcctcttcctccgcatcagaatctgccaagcccaccaaacacagaacccactcagcgacacccgaaccgaaacagagaacgcgatgcgcgcgcatcgcggagtcgtcggcgccccgctcccgccgcaaccgggggcccgcccgggacgacgtcgtcgttgggaactcaccagcgtcccgccgctccttctccttctccggcccgccaccgttcatcaccttcggggagcgctccccgccgcggtgggcgtcctcgtccgcgccaccaccaccaccagcacctcctccttccacgtgcccgtctccccccgctggagccgacgccgcctccggtgccggccgcttctgcgcgggcattccggcctcctccccgcctccccgctcgccgcgcgcgcgcccccttctccgcgacgtcgtggagcaagcacgaggagggggaagggaggtgaggtgggtggaagcgactcgactcgcagtcgggggcaataagaggaggaggaggcggagagcgagaggaaaagaaaagcaaaggcaacgcaaacgcaatgccgcgatggtggtgctggtggtggggcgccctccctgccctttgcctgcctgcctctgtgtcgtgcaattctcgggacggcttgcggcgcggcctatgtacgcgcgtgcctgcgtgcgtgcgtgcatccgtccgtccaccgccgccgccgcggtctcctcacgcggatgtgcggccccgatttcatcccggcgccgccgctcgtaaccgcgggggtgtgtttggtttggtttggttcacactccccacgagattttcaacccagatctaatccaacgtggagctggggatccacatcgagatgggctcgaaattgcgttcaacggatgaatgtttgaatcctccgagcgaattttgcagggtttccttgtaatttgaaagttgaaactcttcacatgaggcaggagcggttggttgtgtgatgtccactatccagcttggcaaaagtagagaagcatttatgggatgtatttacatttggctgggctgtacctggccgagtaagataattggactttcaggcctaatggttaaacgggctaggcccaatagtttttttccagctccaaactttattttataccaagaaaaacaggagtatcattgcttctctgaatattgtcgattcagctgttttccataaggaaagttgagatgataaagattattcaaattttcttctgccttattcaaattttgttagtagttgacaatggtggcagcagaaacttcgattggcagagctcaggcttcagagtctgaagagtgaagatcagcaaaaggaccacaagaaaatgaattccgccgaatagtgaaacagcgattctgctacttgcatagatcaaacaggaaacatcattgttgtaaattgcaagggcgtaaccaacatcttcataatgacggccaaatgtagatgtgcttatgaaaactgaggctcgtagctctcgcttcagaaatatgcagatccatggtgaaagatggaagagtcagacagtcagttgatactcatcaagttagcgagatctttagggctttgcttggaatgaaggaaaatcaagtgctccctccgtttcacaatataagtcattctaccatttctatattcatattgatgttaatgaatctagacatatatatctatctagattcattaacttcaatatgaatgtagaaaatgctagacatatacatcgtgaaacggagaaagtaggaattgtgaaaaacacatcaatgtcacatgaatatgtatggaagactcgagaatgtaacaaacccgtaaaagataattggatcgaaggcatatgaatgcatgtcttaaatgctatatacgcgtcaaagagagatgggtttgtattggagctttcagagtaagagcaagtttaataggacagctaactactagaggcttcaccatttggcttttttcttattagggaataaaaatgattttggagttaaaacttttatatatgtgttcttggtgatttaaaagccaatgctaaaaaagaaaccacgttgaaaatatctcaaattaagtttgaaaatttaaaatttggctttttctttggggcttattaggccatccgatgggagcctaggttcaaatcacctatagtcaacttaatagccaattcataacaattaactataaacatatacttacatgatctcacctatcatacacacattgtatcttggagtctgtgctacagctggctacaaatctgtagcctgctgctcttctctcgcctcttttatcttctcgatacgtgtttatagctggcttatagtctgctattgtacctgctataacagacccatcgtttcatttattcacggaataagccaaacggcatatttacaaacggaaagtaatttgtgaataaaacttttatatacgtattcttagcgatctaaaagcaaatgttgaaaaataaacttcgatgaaaaaacctcaaaatcaactccaaatttaaggttgaaaattcaaaatttggctgataagcatgagcataagcaaaaatatgaggccctaaaattttgtcgaactattgtctcgtttctctctctctcccgaaaccataagaggatgatttagatttacaatggacagccaatgaaccaattctccgttccaaaaaccctaatggcaatttcttagacttccgttggaatgtaggattttcaccggaaactcaactccctttttttttttgtttcctttgattcagataggatctatagtgaattttaggggctttatggctgagattcgacatagaaagtcggagttgcttttcttgtgccgaacttatgacaacacgcatcaggtactaggtaccagtcttttagttcacacggtgatatgtcgtctataattattttctttttgttctccacattggttttcacttgtgtttcttgagttaaccgagttataaagtttccgggttcggttttccttataatttttgacaatcctcttcttcaacacaagagcggtttggcctaaaaaataatttggcgtatgaaataaaagagctcttactcttttttcatttgagtcctgtaccaccgtctatcctacattagcttgattattggcttggatttgtctattacttgcaaaattaataatcgataacttctcacgttacttagtatttttgtgcttttaaatatagctcattatccaccattatggttaaaagtccatcgcgctagtcctatagttaaaaaagccctaactatcttgcaacagaacaatgctctatggttgagcctagttgaaagctattatatgttcccctagagttagctagtgttgatgtcgaaaaggaaacaccaaaagaatctatgctttcaatccaataatgcaactaatgtgaagagttaacaataaacataaaaatcacagaacaatatataaagttaccttcacattaaatgatcaccaagtcattaataaggtacgagtaattgtatatagtactgtagttacattatttaatattaaaaccagtagtgtcgtttcaactcccagtaagtttggtacataggaacttccttcttagtcgctagctacacaagtaacatcatagcacaagttttatcattcttaacgggtcaatcaatagctacccttttactagcggttctactttgcgctagtgagtaaccgtttattcaacccttgcccacaatctccacaggcaataatatcgtatgctacatagactattttatgcttacaccctccccttcagtagcaccggatatcttaaaacatgtatatatatactattttccccatatattcatatttgattgtaacatgcttatatctcaatattcgtctttaacttgtatttggaaatattttatttcgaaacatgttgcataacgaaaaattattcaaaagttatggagatggtacttgtcgagagtactccacaattcactcctatgtatttttactacaacattgttacattggcaataaatgggcccctctatataacagccgatggatccgagtgggagaggcgacatcatcgccgccgtggcaaaaaaagcccaaggaagcagcgaaagtaacgtgtggaaaggggagcgtctccgagagcgagagcgagaagagcgagggagagaactgaagcggacggcgaggtttttgctcccaatcccctcctccccaaacacctcgccgccgccgcatcgggtcgccgcccctccatccacccgagccctttctcgccgccgcggcgtcgtcggccgcggccgcggctgggaagcatccggatggcgggcggcgggcggggcgccgggctgccggcggcgggcgaggccgcgaaggccgggcgggtgggcgtggggacgacgaagagggccagggacccgtcgcccaactccaaggatcccaacggtataccgccgtgatcgccctccgcacgcacgcttcaatcggttcatctgctgttgatttttttggttggattgctgtgtgattatccagaatgctagatttgtgcatgcatggtgcggggtaggagatgcggattggggatgcgcgctcttcgcttagtatctcgtccggatgatgtgttctgctaatgcttgttttgtttttgtggaaggggatgaaggggagatgatggtaatgcttgttttgttttgtggaagggggtgaaggggagttgatgctaatgcttgttttgtttttgtggaagggggtgaaggggagatgatgctaatgcttgttttgtttttgtggaaggggtgaaggggagatgatttggggacatgttggttgatagctgtgggttataagaggagggagggggggggggctagtacttcggcgtcctgttatttaggacaataaaattgagccttttggtgtgtatccatgcttctgggtttgctatgctgctctagatagatggatgaagtcctgctgctgagtacaattagcttggcttgttacagatgctttgcatatgatatcctcggtactatttacggatattcgcaaatagcgattagatggtagctgggtgtaatagtagcccggaagcatgcattgtgcaatgaagcagaatggcatgatctttgaggcatttagttgcagttgtaattatgctcaagatcatggttgttaaggtgttgttgctaacttgctatggcgtcgctatagtggtaaggtggtagcagaggtcaaggcatccattctgccttatgttgcctccaccttagaggcgaagcaagtggagaaagggaaagaagaaggccttacaggcaaaactagtagagaaagggaaagaagaaaagggggtaaggtcatcctagaaggctagaaccctagttggcttgcagtcaccttcttcctcgctgcagctggcttgctgttgcaaattccatgccactgccttcagattttgttgcagcttgctgcagcctttgaatctctggcgacaccatcagcggtggacaacgaggcgagcaaaggcatcaagctctaatggcggtggtagcaggcagagatgttgaggtcatgtggaggtggccagcggctagtgcctcatctgctcatcatggcggctggtgcctggtggagtacgatgcctttagggcatagaacacgtgggtatgaagacctatgatgggctttatttggctggctgcctggcttagtgggccttttaccaatttccccttttctcttccaaatttctctaccatattctccactaatcaggcggtcacgcctcaaccatctcatatggtgtcccaacgccttacgcctcagcactatagtgctaaggcagtggtgggtcgccttaaacggccatgccaccttaacaacactgctcaagattacaccagtttatttcaccatgtcgcaagctgcagtcaatccaggagacagtgcacagatttctttgtatgtctctcttccaaaagtgtcctgacataagcatcctcaatctgtgtttgtttggaggaactttatcaaagatgcatctgttttctttgtagccaaatattccaacatcccaaggtaacaactccttgctagcttagtgaagaatccaacattgtttgtttattgaaggtgcataataatttattatggttgatttagagttgactaacactgcaaatagaacaaatgtgtaccctcatgcctcatcgctgcaatacattcccttatgttaatcaagtaattactgttcaagtggtgtaatggaatggttaactgttgtgcaaccttgtgctcaacagaaaacttggaagttcccctagactagtgtactgaggtttagtagaattgcatggcaagtttctgtataatagtttcatcacaagaagtttgctggtttatgtttgaatagcttgtggttcacaaaagatgatgtggacaaatctaataacttgacctatattacagtctctttgggattatgggagttgtagatgtatagtcccacttgaatagtgctattgtgctataccaaatttaacccatattccaattatttatattttatagttcatcggatttcttccttcatgcgatcttcctccatcttcaattatatccatctttgtttttttttaatctgttgccattatagcgatgctcctctgcattgaaccccaaccccccccctcatatgtccattattatttgtgtatcgtccactccatttttatttgtgtaacacccactccatttttatttgtgtaacacacacacgtccatttttttatttgtgtaacacacacacacacacacacgtccatttatttatttgtgtaacacacacacatccattttttttatttgtgtaacacacacgcgcgcacgcacacacatgtccatttttatttgtgtaacacacatgcacacacatctcatacttaccactcatcatctaggttttgttggagtgattgctgctgagaagaaaccagcactgcagcttcatggcgatgaaaaatatcagaagaaagctgggaatgatcctgtacctcctaccattgatgatacatccaaaactggaggtcttcatttgcatggtggtcatgtatcacaaagcccacctgattctaatgctttgaggtatgtgctactgcactaggaattttgaaatttagaagaaaatttcttattttctgtgatgtttgactaaaacatacttctttctgtatcacatcttaaaaataatatattttgtcactagttcgcaacgatttgggagttcatctcctggtggagatatgaagaacaaaaccagaaagcgtacctgtaccttttatgctcaagggcgatgcaagaatgggaagagttgcacttttcttcatgaaggggaggtatctggttctgataaccaggtttatggaaatcatggaggtatgaactttttcattagaataagctgaagaatatcatgtagctgtgaacttatgatcactctgtcaatctaaacacttttggttgctccttatctgctgtgttcaggcactggagaaggatctgaaatacaacatccatccagctcaaaagagcaccagttcaaaaattcagcggggtcatcccaacatgagatatataggacccttgttcatgcatatggtgaagataatagggggttgacacatcccgttgttaaacatagttgtcacatgctaaaggcttcgcatggtttcaaaattggtggttcattgactgcaaatcctactaatgaggtggttcagcttccagtagttcaagagaagaatcatgaaccttatttcatgggacatcaaattagtttgggcactaacaactgtttgaatgacatgggtgcctattctagattgcgcctagatggaggaaagctgcagtttgaagtggccaagggtgacagtccaagggattcacatctatcaagatcttaccttgaaaagaaccccttaaagcctgattatcggtatcaaccgtttgactcaactatttcattagatcctcaccaatatagcaagaagttgtcagcttatggtggagcaacagagaatcttcctcacaaacatcaggaagaaaaaagttcaagccatgtctcatacagtttgaatagttatacaggattcagaaagcaaggtcatgacagctctgattttttcttggttaatcagtctctccgagcaacttctcaccatggaaccctgcctcttcatcaattaacacctgataaggatgccagtcaccataaaggtgctgattttgacaagggtggtacctctaggtctacattacatgtgagcagttcatctcaacctgtggtagcatcggctgggaaactttccccaatcaaggatgaggtttggataacttcagtgccttttgtaccttcttttaattttcctgattttcctggcagtacatcaccttcaaaaagtcagtatgacccacttgtcgacagtatcgaccctcccaaagttgaaagtttaaataatctgaagacctcaaacatatcctgcagcatttcaagccaacatgtagatacgaatgttataagagggggaagtcttgaaaaaccattgacttttgctgacaagttggcaaggaatgtatctgctaaaggatcaaatgattttggtttgatttcatatgataggggacacagctctagcctggatggtgataatagggtgaaaacctgtgaaaggaaaaatgatgcatcacttaacaatgagaaatcagactttcgttttcatttggtggagcatgtaaaggagctggtgaaaccaatctggaaggaaggcaatttgagtaaagaggctcataaactgattgtgaaaaaatctgttgataagatttttgcttcacttgagccaaatcagatgccagagactgagaaggcgataactacttatataacagcctctgcaccaaagatagaaaaacttgtgaaggtaaaatatcttgaatttgttggtgaatggcacatcttctgattattgattatatgtttgacttctgtatgatttttgccacaggcatatgttgatcgttatcgcacatcatgagatccaggcttctaattatgagctacaacattgaagagatggggtttgagcctgctggcctaccaatgcgttttgttgctgtgctagatgttttgagtaaggtactctgttacatgaacctgtttggttttgtagacttcagtctgggctccctagcagcatcttaacatggtggatgtttaatttaatatgtttttgcatgtgagctgagaggagatctaatgcaaccaagacagaatctttattgcatgtgtggttaatctatgggttaaggaatgatgcttctaatgctgtttgttctgtttggtgaaaaaaatgtcttgcttaaaatgtaataccctgtttaaatgtaatgtccacataatttgtgttagtaaagtggacaagagggtgtggaaagagaagtgtagaaattggccatatgatgccctagcctcattttatagggtgagcatatagtatatatacaaatttaaccccatggtgcaagggattgaaagttaattggcgagattcttatcatgtgtccaatacattccacgtgttgtgactcagtacaccacttccaagttccaattttcaattggtatttggtgccaaagtacagcatgggagaatatcttctatttccttttgtgcttagagcccttgttcatccgatggcgattacttggttggtccattgaaatcaagaatcttgctcccttatgtctttcttctctaaaatacttgtgtagacccttaacaagagccctcttacatgtagacgttagtgtggttggtagggtattgtgagatatgtgaagcatgatgtggaactcttagtcaataataagcatagttattaggaccggaccggaccggcggttggaccgaaaaaaccggaccggttgggccgcctggttttttcgaaaaccgcttaaaagccggtcagaaaactggcactagagcgctcaaccgtgagatgctactctgaagaccacgtgcacgcatggatgaggagaaaatataggaaaaatgggtgtatggtgggattcgaacctaggatgggttgaatggagtcatggcgcaccaaccaccaagccatgttgttgtttgtgtctagagtgaatcagttatatatttaccttactgaaccgctttgaacatacggttcaaccaatcaaaccagtgaaccatcgaaccgagggcctggccggtttgatggtcggtctggtctcaataactatgataataatatcctcaaggatgattgcctaaaaaataggtaaagaattctattgagctaacttatttgaaaaaaaagggtttgggggcatttaatgctttttaattcgggtaaaggtaaacaccgatatggccatatgggtgttgtaaggaaggtagagatttccctaaggggaaaggtatatatgtcttcgtcactcgtggatattttgcatggtacgacgctgtgatgaatccgagcaaacaccaagatggtttaaccttcttgcgtaaaattaatgtgtgaagtatgaatagacccttttatggtatgaactgaaagtaatagtccttgaatgtaggattttgcttcgtttgtgcttttctttgtgtagtatgtgtagatgaatccatatcaaggaaatgttaagttgtgtaccttaatggctaacgtggtaatttaatggacttcacatgaaaagattgcctcaagaatatgaatatatctattgattgtatatgtgtggatttaggttggggcactttgtaatttccacttgggcattcatatgatcattacctcaagtagtagggatctcctaaagttttatgcgatactttgttagagtgggtacaatagcagactataagtcagctataaacatattttaaggagagaaaagaggagaggagagaaaagaggagagagaagagcaacagactacaaatttgtagccagctgcagcactgactccaagacgaaatgtgtgtatgacaggtgggatcatatattaatagtgtagtaggtaactattgtatgaattggctattaaattgactatagatgatttggagctagtagttggctatactattaaacttgctcttaagtacaactcaaacaagataggtggttgatggaccatagcgacccttgtcatgaccaaggggttgatagaccaagtgataggcgatttgctcctagatgaaatgatgtgaaagaaagatggggtcagccctgtacaaacttgtgttcgtataaaattatggtgcaacagtttgagttgagttggattactgtatttgtggtataaatgtacctaaaacaagttgaacccaagcatcgaataaatcgaagggatgaagtcgcctatctcagctcttggggggtgtacccatcttgttgaaccttgtcaacaaaggtacgcgcttccgaattgtttgcttcaagtgttgctagatcaattgtacaaatctaggcggtctagatgtcattgggtgataccaccaagattgtataacatagttgactctagttaaacaacttattggtaaggtcaaaatggaatccaaatgttattagtgactattgcatctacacacaagtgtacaatgagcaactccatgcctaccacattccacaaagaaagaggttggctcatgttatgtgtgatgccattcattgcaacgtggacaagggtggaattgacgacgctcacactacctgatcttctattgaagggataattctcactttgatcaaatatgatgttgatgacgacaatgatggaaatacctaaccctaatgtaactaaacttggacatgatgagcgggctaaactcaaccaacgcaaaactgtatgaaaattatgaggttcggaactagggtttggcgatgagaaaaagcgatacaactatatatggtagacgatggtagatgaaatatacataactaaaactttcatcatgcaacaaagtctttgatccaactaatgatgccttttgttgtggcctggttgttgacgtaaaatttcgtcactcacacgaaggcccgagagatttgcttgactccagtgcaggtcctagatttagatgaggtgcgggcgtgccagtcagtttgatcctgcaactgacaagatggataaattgatgatcaaagagccgatcggccaataagttgatgtagcgatactaaccgacgttgatagggttttgaacaatcggctatatattcaatgtagattctgacacttagataatgacaatggaagaactttaacaaacaatccaatcaaccgattataatatgatgaagtagatgtctaatgagccaatcgaccaatattgatacagaatattaaatgtaggctcgatggttaaaacatacatcggatggaagtccaatgcaaaaataacttatcggatagcactccgataaaaacgtagcacaaatatatgaatttagcaagacttagattatcagcagtcatatagaagatcggacccaaccgagacagttctagattagtctgatcaaataagctagataagtcaatttgatctatgctaacatgatggttataacaaatctatttaaaacaatattgtggttgtagagatatatcgaataagacagaaaatcggacctaacggagaccatcccaactataccgatgcatctcaaaacacagtgcaattaaaaacagaattgaaatatagggtagacaaatataccaactgaaccagagcaattgaagagatcgaagcatagccttgaacaatgccaatatagccgatacaattgccagggccagcggaacttaagggcttaccccttcgccggagatcgaagcgatgtagccccgcgtttggtgccatgttccgccggtgataatacctcggaaaagagggtggcaatgcgctgaaagttggatcgagagataatttacattgtccttgggtgtacatatttatacccatcggtagatacttgtccttattggatacaactcagacttttttaaagataaagtaaaagatacaagtcctgatcgaacactaaacacttttctaagcataaaaaggaaaattactaaaccctacctaattattagataaatcaagttgccatgtcatggtcttcacgatttcttcttaaactcggtctcttctggataaactttgcatcggctgattgtattctttccctgaccgaatccactaaagaatcttaccaaattttggtgttaacaccgttcttttggtgaggggataactctagcttggattgatgaatgcatagttgatgaagtggctgtaacatccttcccaaaaaaagactttagttctagacaagtcaatagccagaaatctaagtctttttgggatgtagggagtatatataatggaaaaaagagacctaaacttccaagccactacaaccacttctgggccacttcagccaatacaactactttgttacaattatcccccttaagggctaaggcctcataagcgcactgcatgtagcccggaaacccttctgatgcagactgtagcccaatgaacatgaaacatataacgaaggtttatactctgatgtcatctatgacacctagcctccaaaatccgcattagtccgctctcacatagagcgagcccatgttcacatagtacctcacttctacttttgtcatcgattcgtgtaaaaggattaacctaggtttaccatagttagagcaccaaggcttataaactgaccggcacccacctaaacatccaaggtggtactaaaccaccacttctaggccacaccactcctataggcttcaaacaagacaagctggggtgttacagatgtgttctaggtcatggaggtgtggcattgcatgcataaggtgggtagtctattacaaggcataagccctaagtttgacttgttccatcaacaatattgtttttttaatgaccttgaagtgctaaaaatgaattttgagatcagaccggttgtgtaggaaagatgatgagataagatttacatgaagtcaaagatcatccaatttggagttttcatgaagttgtgcccattagaaattagtatcatcttaggagaccaagatgacgtgttgaacttgaaaaatagttgaaggtattgacaagatcctctattgcctttatagattatccaagcatttgtcgcatccttgatcatgagagcctctcttattatttaaagatgacacaatcatagctcaatatcatttgctcaaacagatagaatataaatctaacataaaccgggtctagctatggcaaagttttgtacttctcatgcttattatgtgcaaatacttgatgaccataccaggaattatgttttaacctttctgtggggtagggcagcttaaggccctaggagagtgtggcatcccttgcaacttttattgtgcatagaggacatgaaggcaacaatttgggactaaagagatatggatggaaccaatggagcttagcaggtaagctcttcatttgatgattgggctagcatctcaatctaaactaacatggcaaaccagccttatatttgacgtcatggcatcaattggcaataagagtgaactggaatcaagttggtgaaatgtatgatgtctagttataaggtctaggaatttaagtagacttgttcctaaatgtaaacactttgcactcaaaattcttaacatggccttgcatggtgatgataccatgccaagggtaatatcctttttttccaaaatgaacatacctttaaacatgcatatattgcaaaatggtgggagtatttgtgatgaccatattaagtaccttactttgagccaaagagtataatttatagagcaacaacgagacttaacttttttgggaagaggatgaaattatgttccctcctttcatttgactaaagctaatatataccatcatttttagttagagaataatatgtggagccttagttacacttaaaaattgacttaacaatttccatctagcttcgaaagatttgattgacttgatgttcaagtggtgaaatatcttttttttaaaaaaaaagagagtaaatttcacctaatcacaggtattatggtctgagttgcacaaaccacatggattttgacacgtggcacataaccctagatattttggccataaagttttacaaaactacactattggtcattttgaccttaatgcaccacactttttagttctacaagtataccgcaatgtccctatagacaaggggacaagtgattcatcacttttgggcataggcctttgtcaatggaaatacaatggtaagaaaaaaaatagatagaaaaactcaaaataaaaaaaatgcatatgttggattggcacgacataaatccagtcaaaaataggattaagttacatctcaaatttatgagttctatatccatcatatgaatgttacatccatgtaagtatgatatttttaaattttaacgtgggagtatgtcaaattagttaacaacgtgcttctgtaaaactttaggaccataaacctgggttatgtgctacgtatcaaaatccttgtggttttgtgcaacttagatcataactagttgatactctgcgctttgctgcgggatatgtggatgaatgcatgttatataatatagaaatgatagatgttatgtttaaatgatgtggagataatgatttgtcattgcttacatattgagttctaaaaatacaataaaattgtaaatgatatgtcatgtttgcatgatatttaaaatactctagataataattgctagtgagtgatgatgtggcacacttgcatgtgatttagaatactttagataataattgctaatgggtgatgatgtggcacggttgcatactgggttttagaagttagtaagataggtaggtgaagttttatgaaatttactgttgcaaaagcaaatagtaccaataaatttagtgaaccacttcattgtcttccattacccattctcatttcacctaagaacttcccttcaattgtattgattgaaatgacacttggaccttcatattgcatttcacttaatatatttcttagcattctgctcaaaaaatatatttcttggcataatttgaagttgatgtgaggatgatatcatatctaaagcgctatcagaaagttatagaaataacttccattagctcagaaggtttaagcaaataatgccaagattggtgaatagccctttgatcctctgtattccacatttaagtacgagtgctagatactatcagtagtaataggaagttctgagctaatggcattccaatgcgcacactactcattcaattcgctgatttgattccattcctctctcataatatcttgaatgtttgtgcagaaaccatgtctcatgtaagacctagtttccttctcttcattaaatctcttgccacatcacaaatcctacgtggcttctcatttaatactgtggaaaccatcctaggtggagtattgggactgccctaataataacttccctatattagctcccatcaatttgaatagccgttggccttccatattatttctatcacttaatatgtttcctattataattgcaaagaatttgatgtgaggatgagatcatatctaaagcattatggataagttttagacaatttccatttagccttggaagatttgagcaatccttgttcttgaggcaatttatgacccctccttttttgggcaaagaccaaataataccatttaacaactttctatcttacaacatgttaaactttaccaaattttggtaggggtatttggagcttgtttgatttgctgatgagacaattctgtaatgtacgacaatgacaagtatatcttttgtcccttcttcgaagaggatattccctgatatataacagtttggtttagattcaaacggtcgtaccttgcagtcttgcagctaactgaatagatactcaaatacagttgagttttgcttttaagtatcatgtggtgctattgttcttcttagtggattgagtgttattccctgcacatttttttttcttttgtgctgcacctgacatgttccactttcttgctttcagtacacaacatagtctacatggagctcatcggcactaacaagctgtcatcaatgataatattgttttcttgatctccctaaaaggtaatttctcatatggcaaactagattgtttatgaatttctgtagccctatgcatccaagtagcattttttatgtactttctatggtggtaagtgatgctatacagtgaaattcacaagatattttattgtcccttttgaggtataataatggttagattcgttattccaaaagaggttgtttaacctgcttaacctaggattcaaacctaggtcacacgctttgggaggtaggacaaatttctttgctgcggccgatgattacatgatgggggctagtagtatgatgtggtactagggaaggccagggcccttggtacgacgggagtaagttcaatatggtatgaggggaacttatttgctgttggcttactagttaattagcttggaattactgaaatcatgtagaagtttatgtacttgaagttcaggttcctctataagtctatatacaagtcaagcagacatatcaaagaaaacatcatcacccgtgtaagatgaatacttagtgctgaaattatatactaatgagaaataattttgtgagattttgtttagattaatatggatggaaatattttaattaaatgtctttcaagctcaattcaatccaaactacaaatgcacgcaacattagcttatattccagcactgctttctggatatagagtgaggttctagagttgtgccctgaaggtgtttgtacttgacatatcatgtatataatatattccctccattttcaaatgcatgtcattgctgctttcaaaatttgttgccaaatacatgtctctatgattttgaatctgattaagatattcaatgttgttattatggtttactttttacccatgacaagctgaaatcacatggtgctaattaagatattcagtgtaggcactatggcttttgcagtcagtcgatgtttgtgcaagatcctaaaaagcatgtttttgggtaactaataatatagataaaatactaattatgcttagcaaaacttccaatgagatcctgagactacatatttcatccttcatagttactgtcccagagcttcaaattatatccctctaaaagaacatcaaattattaacaaatagttatgatatttcccttcttcagtttgtaaaatgtttttttccaatgcttgtagcctatcagcaattacaactcgcacaagtccaattatcatgaggtagttattaggccaacaactacacttgttatgttgatttgtaactgtaatgtgatttgtttcaggcaccatggattatatgtttgatctggttatgctatgagtggaacatttgccctaatgagcactgctgaattgctcgataattactagagtaagatggcatcttgctgactgcatctgcttccaataattcttaatgaaggcacgaaacatggtacttgtttgcaccaagatgattatcaagtgttcagtaaatcagttccctttggctactaattctgtgctctgagagatgttgctctcgagattccagtggagttgatgctgatccccagtctttatttagtaaattgaagaccgcgatggtccacctgaatatattacttctcaaagatagcagtactgatacaaagcccaagcacaggcgtgaaaaataagtgacgaggaagggaaaagagtacgatgaggttatgtttcatgattttcatcttgttgatgacagggcagaatgggggtcagtttgtgtaggttcttgggtaggttcttgggtgcgcattgaagccataacttgatgatccgttgtttattattccttcatgatattagcttggttggttagaggggttggagagatatcttggagatctttcagttctttggatcttaccttcacttagaggagatgtgattcgagttgttcaaacagggctgcatgatgtgtttctagttcacgtgtatattcatgggctagtaatatatccagaaacatgctgcaaatattgatgggcaagtaacacattcagaaaaatactgcaacgagggtgttggtgattcactaacttcacttaatgatggaagtgaccagggttttttcctcttgtgattcagaataacataactacagttctagcttacaaagtgtttgacgtgaaccataaacatggccgtttgagccatgctgattaatcataaaccctctttctgaaggatgtagaccatgcagtgtttgcagtcttctgctgttgggtcggtgcatcgcaaatagaccttggcagaatgcaaaccctacctgccctctgcatgctcactcatattggaccatacatgatacatgtatgttggttgagtaatttcaatccactgtcacgtggtgatttggtcctggatcagtgtgcttggatgacaaaaactatatccttgcttttattgtatttgttgtgcatcagagaaagggaagtgaacagaagcacaaactctactattgcttttattgtatatccattgagcatcagagaaggggaagtgaacaaaaccgcaaatgaattggtttgttggcgaatgctaccagaagtcgagcagatagtatgttaaagcgttcagggtggagaattagaaagttaacgagatggggacaagatggcagttgccgggtcagggtattctcacaataaatcttgatggcgtgtcttcctttcagcatcttgagtttgttttatgatccgtgatcacgtttgagttgtaatctggttgatatcctgtatcaagggttcggaaacagcgacgaatctgggcgttagaatattgttagttgaacccaattctgtgatcctgaagaatgcgactgaaggggattcttttgatatctcagcttaacgacgccctgttcgtattcaaaaggtgctgaatatgttcttcagtttacagtagttctcgtgttttctattgtcggtgcaagtgtgtaactgtaaccaagtggttcatgccattgccatgtccatgttgggttctaaccctagctcatgaggaatctccaggttgctttaatggagccccctgatgttgtcctggacctgctggccagcgatttcattgtaatcacaaaaatgaaaaaaaaagagaactttttctttggtccaaagcacggtgtttccagacataagtatagatggaattattcatagcagctcacaagggaccatttgtgaagagagaaggcaccacgaccagcctactgttgcatcacgctcgtaccatcatgaggggaggacgtgccctgcacagatctcacacgcacgctgatggagcaaccgccaacgaggcaacgacggacgaggcctcccctcagaacaggaaagaaccacatggctccttgtgagccatgtaacgcactggtccgcagatccatcaaatcgtcctatcacgccgaaccagaaaacgtgaagcaattcgattgcccgtatcacaccctgacgcgtcgacgaaagcaccggtccgctcgcctcctcctgtggatcctgtgtccctacagcccaacagcccctgacccagcaatcgtcaacctccaatcggcaattaccgcagtgtgctgctaccacctcagctcgttcatccacacgactccacctactactacgcggagtcgtcgtcatgatccccacacactgtcactgaaagccacgaaaagatactagaagtctagaggagactaagagcaagagcaaagagcaagataataatagtagagctcactatctagtagactactactccctctatcttataatataagggattttaagtttttcttacaatgtttgaccactcgttttatttaaaattttttgaaattattaattattttatttgtgacttactttattatctacactactttaagcacaacttttcgtttttatatttgcaaaaaaaaatttgaataagacgagtggtcaaacgttgcaagcaaaataactaaaatcccttatattgtgggacggagggagtattagcccattttaaagcaacatataatagattagctataaggttggctataatttttcttttcctatctctatctctcacttatacatttattatttttgtcttggagtttgtgttaagctagctcttgcatgagagccaacacctttgatttttttttgttacctctctcctccacataagtttatagtaagcttatagctcactattatacttgctctaatcccctcccccgcctgctaaacgagagttgtaaacgcatggattaacttagggtgtgtttagttggggaaaaggaaatttttgggtgtcatatcgaacgtttgaccggatgtcggaaggggttttcagacacgaatgaaaaaactaatttcagaactcgcctggaaaccgcgagacgaatctttttagactaattaagccgtcattagcacatgtgggttactgtagcacttatagctaatcatggactaattaggcttaaatgattcgtctcgcgatttcctccataactatacaattagttttactttttatctatatttaatatttcatgcatgtgtctaaagatttaatatgatttttttggaaaaatttttagggaactaaacgggccctaacaaaaaatagggaccaaatccagcagcacgtcacggctgctaaaagcgacacacggcgacgccccctccaaaagaccaaaaacccaagcaggactgggaacaatacggtttcgagctgaaaaagaagagaaatcgggtggatctggccagtacaccgaaccgcgtaccgcgtagtacagaggagagagagagagctcacagttgttagcgacccggagagcggagacttgctggcggcagacgcaacggcgaccgattcgcccgagcggcacaacccactacgtgtacgaccaccaaaccaatccccatcacccccatcacccggctccgttctttaataaagaagcattccttctgtgccaaaatataaacatttttagtatagtgttaagttaaactttttaactttaactattaaaaatttttaaaaaataataatgtaaaattgatgtcaatagatttatcgttaaaaaaaatatcataatacgcaactctttttatttaaaatatcttatttttatagatattattagttaaagtagcaccttaaaaaccgtgtcagtctaaaaatacttactatattttaggacggacgaagtagattttaactcggttttttttaaaaccgttaaatagtgtatttcgtgtaaaaattttatataaaagctatttaaaatataaaataaatttattttagaatttataataatttataattgattttctggtttttacgtgtcatcttcatccgttgcaaacaaggcctacgtcgtctcgcgcgctcccgggccgccaaaacccgcacgaaacgatcgaacgagagacgccgccgccgccgcgatgcgcatgttccacgcgcccagagattcgcggcaaccaagacgtgacccgagcgacaaggaccccgaaaccggcggcacgtacgctcgcagccacccgtcaccctcctcgctgtccccgtctccgcgccgcggtcccgcggattattccgcgatggatcggatcccatccaagacgccacggcgtttttagcgtagcgtaacccgccagcccggtggaggggcccatcccccacgccacgagaccgcgcgatccggcggcgtcggtacgagtagtactagtcctccactagtacaaggagtaatactctagcggtagccgtccgtgctttttttaaagcggataatgtgtcggccgaggtggattagcggctaaaatgccgatactaatcgagatcgggcggcgtgcgggctgctttgtttcgcgtggcgcgtcgttgatgagcggccggcagctgccagccccacccagcgtatcagccggggggaaaaattcaatcgtgcctcgctagcagccggtgatggcgcatggaagctcagagaggcacgttcgtgcgcagttcaacatgagaaattatcacgaagatcgctgtccggaatagttgatgacagtagtcgttccagacttccagtaatttcctacagcccacgcggagcatacggcggctgcctgtcaccgtcgtggcagattgatcgtgcagcacggcagcagaccttggtccgctgtcatcgtcggaaataaatagtgatttcttcttaaccaattgctctttcaagtttggggtattggctgtgtttagatccaaagtttggattcaaacttcagttatttttcatcacatcaacatcttatacacacacaacttttcagtcacatcatctttaattttaaccaaaatttaaactttacgctgaactaaacacacagctgtcgtcgtacgaataacttctgtcattcaaactcatatagtagtaggagtattttagaaccttgaagctttggtggctacagtatagtccttttcttgtactactaaagatatagaaaaactatcctttattactttctaaccatataaaaagaagaaaaatgaaaaaactatcactgcgtgcaaaaccatcattgtgcagtccaaactccaaacgattgctgcctgggtccaattacttctattgtcatcaagtgatgtgtagttcttttttcaacacaagatcaatatccaattacctatacctatgtttttcttttttagccaaacgatactctgttcaaacatttcctatgacctatataaacataaaatatatctggatttattgaattaaaaagataaagcaaaatagaagttaaagttcatctttgtttggattcgaaccattttctgcgttaccaaaacgttggcaactttaatcatatgaaataaatagcactgacatttgtccacggtagttcaaattctatattatcaaatttggctgtgctaatacttattaagcttctgttagtaccaaaatctagctccaaactaaacaaactcaaaagttgctctttctataatatgtgtatgtaatacatattttgatatgggaacacgcatatcttgcacacgctttgcacattagctactccctctatcccataatataagtgattttgatattttgcttgcattgtttgactattcgtcttattaaaaaaattagaattatcatttattttatttgtgacttactccctccgtcccaaaaaaaaaggcaaatcctgggtttccgtgccaacgtttgactgtccgtcttatatgaaatttttttataattagtattttcatcgttgttagatgataaaacttgattaatactttatgcgtgacttgtctttttaattttttcataatatttttaaataagacggacgatcaaacgttgcacacggataccagagtttgtcttttttttgagacagagggagtactttattattcacagtactttaaacacaactttttattttttatatttgtaaaaaaaataagacgagtggtcaaacgcaaaaggttaaaatcccttatattaagggatggaggtagtaattagtatgatagaatttttttaaaaaaaatataaatgtatttctaagagtataacaaatatatctaaagtctcaacatcaaatcattattttaggtaaaaaggaaaaatatgacagatttaagagtgtaaatatgttgtcttttttaggaaatatgttttgtctttttctctctttatatatgttgaatttgaagataagaatttccacacaagtaaattacatgcacataattttctataattttatgtgacacttattagttaaatatgttacacttagtgcacccgaagattgtgcacacatgatcctttcctagtttactacatcggtaagtgtaggagactaacaattacgaagaaaaatcaagtgattggcatggatatcaaagctaaaaaaaaaactttcagtatagtatacaaatgttgccaaattgctcaattcaatttatgtacacaatttatccataagagtttttattttgtcaaccacagctacgtaatgctcctacgtatatttgcatactccctttataaaaaaattaacctaggaggagatatgaccccataaatctggactacctttggccaggttcggtggtataggaagggttatatctcttttagttttgagtttttttatacggatggagtagatatttag

SEQ ID NO: 73106 - DNA, 13087 bp, Oryza sativa
gtggtattgaggcacatggtgacatgatgtggggttgtgtcttgtgggtactgtggtacacctcttatcagagtaaaactattcgaatagccgtgcccgcggttatgggcgggtctaacaatgtctttcgtgattagtctcacccttctcaccatattagaagatgctataactggtaataatttgattagctcctggtttggaatggtatattcctggtttggagatagatctgtacagctgggtttggttgttcagaatggttgggcctatacaacagggtatgttgtatagtgttggattaatattgtttaattattactcaacggttttattaaattctcaaatgtttgctaaatgctgcttttgcaaatgaaaacctattatgccatcctttgttatcttgagcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgactttttattcgcttcttaattagagtaataattgtactctattatcaatttgttattgtgtgcttcggctgattcctggacgagggttcacacacatgtaagcgtttggaattttggatagaaattccgggcgtgacactccttgaccctaggacgagtcttagatcccaatccttagcaatattttcgaaataaaaaaaacctttcttacttgtgaaaatcctttagtctccctctgtcctgctgcttcatttattgtcaaaagctgatctttaaaatgttgcttttctcttttgctattgtttgtagatggccgacaccctcaaccgtcgtggtctggacttgactggctttgttttagagctgcggggcttgtgcgttgtcctggggtatccgcatggagtggactaccagggcaagaagcttccggagcaggatggtgacgatgcagagccccgcgccgcttgggaggtcaccgcggtgatcctcaccggctctcccgagaggacttctttggcaatcatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaatggcgcagacgactccactccacaggcagcttgaccagggctacacctaatcctccacaccatcagcatcactgtagaactcctcctctgatgaatgattgcgaggtgagtatatggcatactcagcaagccacacagcaaatatgcaagtgcacaggataccaaaggatggcgtagtatggtttcatttgcataaatagcatttaataaacatttcagaatttaataaaacagttaagtaataattaaacaatattaatccaacgctatataacataccctgttgcataggcccaaccattctgaacaaccatcccggctgcacagttctatctccaaaccaggaattaaccattccaaaccaggagctaatcaaattattaccagttatagcatcttttattatggtgaaaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcagaaaagagctgtgacagtacctctcgcacaacataatccaccacagtgcaccactcccggatcatagtcacccccttataaacaaggtatggactccccagcgaacccccgtgggcttatctccgccacttctcagtctggtgctccgcaatgaaccatgctatacaaaaggtaaagccgttgcccacgctggcttgtggttggcacggtaaatgtttcacaaccgaaactcgtgaaccggtccttaattgtcatgagcacgaccatcaaaaccatctgctcacaacccaccattatcaagttttagttggcacattaattaattaaccaatcacgattgaccatcgtgagctatcagtaagagatcatgaaataatagtgagtcataagttatcccaatagtgtgctaatgtttctaagcatggctaagcaatcacatctaatatctagctgaaccaatatataaagctcaactagatcaagttataataacccaaggtatcaaggaataaagtaatcaagaacgaaagggctataacaaagaataggttaattccacccaatgacattcgaaaataaatgcaatagttaaatagaaacaatagctttaaataggatcaacatgctcaaagggttgtttgggatctgtgtgacttgccttgctggccttggaactcttcaaactcttctccggcgaaaacggactctccggaaacgacgaaatctaaacagaaagaagcaaaatcaccaaaacaacacataagcaagcatgaacagtacatgtggatatttttaacatgtagatctcaattttagaaaaatttagagacttgaaccaactaaatcggagctaagatgaattagttatgaatttttgaagatttaatcggattaaaacacttatatagattttaattgaattatgacgcaataatgaattatttttgaaaaggaaaagaaggtttattgcgtcagcggctagggtttcggtggaccgggcgcacgggcgacggttcacgcgaacggacggccgagatcgacttgatccaaaatggacggccgagatcgaacggtccacgaccggctcacggcagacggccacgatgacgtcagcggtgacgtcgtcaatgacgtcagcatcggcggcggctcggcggctcgggcgcgcaaactcgccggcgaacggcggcgcttcggcacgaacgaagggcaccaacgggtagcggacggcacggcgaacccaccggtgaccaaagaaacggcggaggagcaacggacggcgacggcgacgaggaagaagcggcggcgaccttcggcttgacgacggcggcggtgctccggcggtcttcggcggtggcgaaggagcggacgaggacggcgacgacttggcgaccacgatggcgatcttcccgagcgacgacgacgaccggaacggcgccggcgcacggctggagcgacggcggcgacggcggctcgaggttacacggcgctagggcgctacggacgacgagagtcgaaggcgagggtggcgacgggtagaggagacaccggggaaccttttaaaggggctaggaggcggcggcaaaggcccacggcggccggcgacgagatggaagtttagggttcggaggagagagacgaatccgattcgaactcgaatccatcgatttccaaaccgatttagccaaagattccaaaagagaaaaggtagaggagatcccgaagatcatttcccctctatcaattcggccggagaaggaaaggatcggccgaatttggaaggagacgacggcggcgcggcgctagggttcgggcggcggcggccggaggtagacgacaggcctgacaggtgggccccacctgtcagcgagcgcgggcggctacggactgggccggactgggccgaagagagagagagaagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctgttaaaatcatttctaaaaaattccaattaaacaacaatttatatattttgaatttttagggcgtgacaaatcaccacggatggagattctttccccgccgcttgccagaacgccgcgctcctcgccatcggcactcttcaccagcgctatccggacgagctgtagcactcgccctaccgctaccaccctcgtcgaggaggagcccgcgattacgccaccttcagggatgctagctcggaggatgacgctaccatcatgtacctggcgcgcatggtggaggagtacgacgcggcccgtatcgacttccatcatatggtgcgccgcgggttggtcgagaacaacatgaagatcctggagctgcgtcaggagaatttgcagctgaagaaggacttggacgcggtggaggcacagttgtgtcagctcaagatcgcccagggagaggtctgtcgccccaagcgtcgccgcgtctgccgcagcctgaagatcactgcccacaagagtacctccaggcctgagctggttcgtcagtccttggcatggacttgcttcgtggagacccctcgcgcggagcccgcgcccttggttcctcaggaggaggaagcctctggcgttggtagcacggaggatgtgctgttgctcaccttccgctctggcccgtcgcagaagtagacgagcagctagtaggctcgcgcgtgtgttcttctcgtttgtttttctgcttgagtcgtgtggggcatggttataccggtgtgtggtataactgtgtcggagcctgtctttattttatttgcataagcaacttgaaccttaatgaaccaatttaatagcagaaataaattcaagaattatggtagtcgtgggtggttagtttcaatagtcagctctctctgtttgctagttctgtgtgggattttcagatggtgacaaccaggagaagcgctgctactggtgactggtgagggcagtcatcctgaaggcagcaaccacaacaaccatggcagcccacctccacctcctccccagccaccaccaccgccacaagacaccaaccccatcctcacccaaatcctcgcccagcaagccaacatgatggttgctttcctccaccacatccagaatccgccgcaacacaatgctccacccccaccaccacccccgcagcattctaagcttgccgagttcctccgcatccgcccgcctaccttctctagctcccataaccctgttgatgctttggattggttgcatgccgtagggaaaaacttagacaccgtacagtgcaatgatgaggagaaagtcatcttcgccgctcaccaactgcaggggcccgcatctctatggtgggaccacttccaggctacgcagccagagggacagcctatcatttgggcccgtttcgccgccgccttccggaggacccatgtgcccgccggagtcatggcccttaagaagagggaatttcgggagttgaaacaaggcaactgctccgtgatggagtatttgcacgagttcaataatttggcccggtacgccccagaggatgttcgtgaagatgaggagaagcaggagaaatccctagcagggatggaccctgagctgtctatgcgtctggtctccggggactatcctgatttccagcgcctagtagacaagagcattcgcctggaagccaagcacaaggaattggagtcgcacaagcgtcgcttggcgaatttccgcaaccaacagggggctaaccaaaggatccgctacaccaatccctatccagggggatcctcctcgcagcagcagtagcaacaacctcgctccgcgccccgacctcaattcgtggtgcgcgtcctacagccacagcagcaacagaatcagcaagggacccgtgcaccccaccctcctgcaccagccgtgcagcctggacaaggccgcagggatgctcaaggtcaacagcgtctgtgcttcaactgcttcgagcacgggcactttgcggataaatgcccaaagccgaggcgccaacaaggtcaagcgcctccccgccccaacaacggtggtaaggatgtcactcggggccgtgtgaaccacgtgactgccgaggatatgctgacaactccagacgtcatcgttggtacgttcctcattcattccatccctgctaccattttgttcgactctggagcttcccactcatttatatctgtgccattcgtggggagaaatcagctgggggtagaaaggcttaggaaccctctgctcatcaccacccctggaggggttatgacagcaaagtattatagccctgccgttcctatagaaatccagggaattcctttcccctcggatttgattcttctagacaccaagaacttggatgtgatcctcgggatgaattggttggctcaattccaaggagtagtggattgcgcaaggcgcactgtcactctgtatcggggccctgatcaaccggttgttttctttgcacccccaacttccgccggcagttcagtacttcatcagctaggattgccagaaatacccatcgtcagtgagttcggagatgtgtttccggaagaactacccggtatgccgcccaagcgagagattgagttccggatagatcttgctccaggaaccactcctctgtacaagcgaccctaccatatggcagcaaatgaactggccgaagttaagagacagttggaagagttgaaagaaaaggggtatatacggccgagcacttccccctggggtgctcccgtgatttttgtggagaagaaagacaagacaaagagaatgtgtgttgactacagagctctcaatgaagttactatcaaaaacaagtaccctcttccccggatcgatgatctgttcgatcagcttaaaggtgccactgtattctccaagattgatcttcgttccggatatcaccagttgcgcatccgtgaagaagatatcccgaagaccgcattcaccacgcgatacggactgtatgaattcatggtaatgtcattcggtctaaccaatgctcctgccttcttcatgaacttaatgaacaaagtgttcatggaatacctggataagtttgttgtggtctttattgacgacatactggtgtactcacaatcagaggcagaccatcagcagcatctccgtttagtgttgggaaagctccgggagcaccaattgtatgccaagctcagcaagtgtgagttctgattgtccgaagtcaagttcttagggcacgtgatatctgctaaaggagttgctgtggatcccgaaacggtgaccgccgtcactgattggaagcaacccaagacagtcactcaggttcgcagctttttgggtttggcaggatactaccaaagattcatcgagaatttctccaaaattgccagacccatgacgcagttgctgaagaaggaagaaaaatttgtgtggagccctcaatgcgagaaagcattccaaactctcaaagaaaagctggtttcctcgccagtgttaatcttaccggatactcgcaaggaattcctggtgtactgtgacgcttcacgccaaggattggggtgcgtgttaatgcaggaaggtcatgtggtagcctatgcctcacgccagctacggccccatgaaggcaactaccctacccatgatttggagttggccgctgtggttcatgctctaaaaatctggcggcattatctcattggaaatcgctgcgaaatatataccgatcataagagtttgaaatacatcttcactcagtcggatctgaatcttcggcagagaagatggttagagctcatcaaggattatgatgtgggaatccactatcacccttgtaaggccaacgtggtcgcagacgcgctgagtcgaaaaagccgttgcaacactcttggcgtccgtggcattccacctgagcttaatcaatagttggaagccctgaacctaagcatcgttagccatggattcttggctacactggaagccaagcctaccttgctcgatcaaatccgcgaggctcagaagaatgatccagatatgcatgggatcctcaagaatatgaaacagggtaaagccgttggtttcatagaagatgaacacggaaccctatggaacggaaatcgtgtatgcgttccaaacgacaaggaacttaaacagttgatacttcaggaagctcacgaaagtccttattccatccaccctggcagcacgaagatgtacttagacttgaaagagaaatactggtgggttagtatgaagcgggaaattgcagagttcgtggccctttgtgatgtgtgccagcgtgtcaaagcaaagcaccaacgaccggccggacttctccaacctctccaagtaccagaatggaaatgggatgaaattgggatggatttcatcaccggagttccaaaaagccaagatggatatgattctatatgggtagtcgtggatcgactaaccaaggtggctcggtttattcctgtgaagaccacctatggagggaacaaattaactgaagtctacttcgctaggatcgtgagtctccatggcgtccctaagaaaattgtatctgataggggaagtcaattcacctctcacttctggaagaagctccaagaagagttgggtacccgattaaatttcagcaccgcgtatcacccgcaaaccgatggacagaccgagcgtctaaatcagatcctagaagatatgctccgtgcctgtgttctagattttgggaagacctgggataagagtctcccctatgccgagttctcctacaataacagctaccaatccagcatacaaatggcaccttatgaagcgttgtatggccgcaaatgccggacaccactattgtgggaccaagttggggaaagccaagtgttcgggacggatatcctgagagaagttgaagctaaagtcagaaccattcgggataatctaaaggtggcacagtcccggcagaagagttatgcagataaccgacgccgtaacctggaattcgcagtggatgattttgtgtaccttcgggtcacgccattgcggggtgtacacaggttccagacgaaagggaacctcgcacctaggtttgtgggtcctttccgcatcattgctcgacgcggagaagtcgcttaccagttggagctgcccgcatccttgggcaatgtgcatgatgtgttccatgtgtcgcaactcaagaaatgtcttcgagtgccgtccgagcaggccgattcagagcaaattgaagttcgcgaagacttgacctatgtagagaagccggtgaaggttctggacaccatggagcgcaggactaggaaccgggtaatccgtttttgcaaggtccaatggagcaaccacgccgaggaagaagctacctgggaacgtgaagacaagctgaaggcagcctatcccgatctcttcgccagttcttccgaatctcagggtcgagattccgtttaagggggtaagtttgtcacgtcccaaaacgaccctaaaatatatcctttaaattatgcctagaataattaaaatcctcgagaaagcctccaaaaattaaaatgtgcaaagtaaaagtcaaacaaggcttagaggatttttttatatttcctaaaagcctaaaatgtgtaaataaattttagtggaattttcagagcacaaataataattattaagaaataaacaaagttgaaaaggttttataaaaagaaaaaccctaaagaccctccctccctctcttgggccggcttggcccacttccctccccctctctcctcttccctcgcggcccactcggcctctcttcgcgcgcgcgccgctgacgggcgggcccgcccgccaccctcgctgacgggtggggcccaccagtcatctctttcctcccgccgctcctgccgcctcgcccgcgcctagcgccgccaccaccgcgaatcccgccgcctcccgtcgtccctgcgtgaaatcaatagggggcaattactccccatgatcccctctccctttccccccatttttccctctctctcgcattcaaacggccagatttgctcccgcaaatctcgccggcgccattgatggcggccggacctcccggccggtttccttccttccccggccgccctctcccccttccaaccctatttaaaccctcctcgcgcctccctcgcccgtttccgccccttgccgcaccgtctcctcaccggaatcgagctcgcgccatcgccctctctctcctccgtcgccgacgacctccggccggccttctccgctcgccaggaccgtttcccgccccagcgtcgcctcctctggcttcgccgcaccgtcgccgtccccgtccaccccctcgtcgagctcgccgaccgccggagcgccgccgtccccgtcgatccgagccgcgccgctgccttccaccgctccggccgcctttttcgtcgtcgccgtcgacctagggtgagccgtggaccgccgcctcgtttccccctttccctcccctctctcggctgccgctccgccgtgcctatggccgccgccggcgaccataggggcgcgggcgcgccgcctcctgccggccgcgccgacgtggccgccttcgggcgcgccgagcggctgccgcgtggggcccggtcgtcagccgcccgcgccctcgggtgtggctgacgcgtggggcccacggcgccggccggtgtgagcccgggtgcacccggtccaccgtggaccgtgaggctgccgcgtgggccccactcccgtgaacccggtccgcgcgccctctcccctcggctgacgcaataaatccttcttaaattaaaatttaaatgaagaaattcgcaaatattcacttaaagagcatataaacttcaaatggccataggttggtcatttgaactcggaattggaccgttcaagtctctaattttttcttaagaagtcaagaacccatttttgtgctttgtccctgcttgttatatggagtttattagagtaaaagcctttttcctttccgttggtcgtgtagacgctgcagcttcggaagatccgctctacgtggaggttgaagccgacgtttgggaaagtgagcaaggcaagtcacatcatccttgaacatattgaatccccgtttataaaattgttttgatttaaattattgcattatcgctttatttaaattaccgcgttatcactattttgtttagccatgcctatttacctttgttatgaccttataattgttatcattattattaccttgttcaccctagaataaacaaaaccccaactagtgggtactctattcatggtaccactagtatgaatttaggtagatgcttcgctgtttaattaggcaacattaggtggttttacaactctagactttgggaatattcatgtcacctagacactatggaatggttggattattgtggaatcggattcacacctccccctctattcaaaatcctcaaaatggttttaggctgggctcggggtgcatggttttgatagtagcacctcggccacataaggaccggtcttcgggcctctgttgaaaagcactaccgtacttccacatgtctagtgggtaaggcttagtttgtggctcagtctggttataaacaaaagtacacggatggagatggacgaagtcgggggtcgatggacatttctagggcaaatgaaggctacacgagctgcggcccggtagtcgagatgtcatggcacagggctggtgtcctgctgctaggggctcagtcctgcctacctgtcccggaggttccggccgtaggtagggttgggtcggtactcttgtctatggctaggatgggttggaaactatgtcatgtcttccgttcgtatgccgtggtggtatgtggcacgtggttacacgtgaggaagacatgtcttgtgggtaaagatgtacacctctgatcagagtataacctattcgaacagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtccaaatcatcgtaggccttgggttaaggtaggttcgtgttggttcacggccttgattaataatattgcatagctctaggatcgtgtttacaaagtagctttgagcaactaagtgacttttaatgctgtttactgcaaaccctaaccccctatattatagctcccttgtactcccttgcatttattctgcacttattggtgtgtcttgttgagtacggtggttgtactcagtcttgctcaatttttcccaatcctagaagaggagttcctagaagatgaaggctttggtgtctagctcgtgcctgccatcaagcgcctgtggtcgtcgccctagtcttccgttgtttttcgtttgtcttcgtgtgtgctgggccctcgccgcccatgtaataaaataactatttacgcttccacttgttaaactctgtattgtatcaacttttggtgtacctcgcctcctgggacaaggaataatacacgcacgtaaggaacgcccgttgggttatttctagtcgtgacaggctgatcctgcagaacgactccagaaccgtcaacgaggcatgcacaccgtccaagagacggaattacttgttgccaagctggacctcctcatgaaatgattggatgaccacgagaaacggccacaagacactgtcaaggccttggactctcacgtcacgtgtgaggtctacggcggcacaggtcattctaggaatgactgcccgaaaacctgtgaggaggcgatgtacatgggcaacaacaacgggtaccgtccacaaggaggtcaggggtggagccaaccacgcccatattatcaaggaggtaacaacattggtaacttttctaaccagccctccttgaaggatgtagtttctgcgcaggctaaaaccactgatgcgctaagcaaaaagcttgttgccaatgacaagatcggggtgcag

SEQ ID NO: 73107 - DNA, 8612 bp, Oryza sativa
cccacgctacagcctcgaacgtcgtcgcccgcccgccccgttccctcgcgcgcctgccgcctaacgtgccgtcgtcacccgtccctctcggcgttttttttttctctctctctctctcaagtctgtgtgcagtgatttaatccgtcgcggcggccactttacgtggtgggtacgggccaagcggcggccggctttatcggcttgcgcggctgtgcgtgtccactggacgtcacgcatcgcatcccgctcacgccgcgccgacgaggcggttggagagatattgtatgatctctctctcctgacgacgtgaggtggtgtggtgtgggtggacgagacgacgggcgacgcgggcaggtccgcgtcgcgtgccgtgcagcgccgagtagagactggagagaggaaggggcggcgggggccacgtgcctgtgcgcgcacgcgggcggcgactttggttgcccccacggatgcgaatgccgcccagaccgcggctcgggacgcacggatcgtgatgcgtcgcccctgtccttgcgcgggtcccacgacgcccgtgacgtgctcccacaacgtgccgttgtacgcacccgcggcgggccccgcgagcggcggctttgatgcattttgtttatgggatgggaacgaggagacttcgcagtccagtacctaaaccatagcaatatcacgcgacgatccaataacgtttacacaaaattaacgtgtttttgggaaaaaaaaggcagaaaattaaatctgcatcattaacaccatttaaaataaattgagacattactttttttcccatgagaaaaagaggcttaactaatacagtattccacctctaatgacttatcatcattttcgtcaaatgcaacacaacacaatcatcctattgtcttctcaatctcaaataaactactggcggttatcatttgccatcacctaaccacttaccattgtgttcatttggtttcattagttcaaacattaaagatgtttttttcaccgatatatgtctgtatctaattcatcattcccctaatttcattcccattgcactatcttcggcctcttcgttgccaatgatgcacaagctattaaagagcacggtgttgttaggcaaaacacaaaccttggcatttgttgttgccattcgccaccacatatcacttgtcttaccactaacaacctatgttgttctcttcgagccccaccatgatactctatactaatagtaaaaagtagtctgaatcgttaatttcatttgatgaaatggtttaggtctatttatactaacaccttagttagcagtagtagaaacatgtagagatactgttgttcaaaagaatagatgcggatagatataatcatcatttaacaatgactaaaccttttttcttcttttttggattttttccatggaatattagcgatgccaacgtaatggatgatgatagatagttttagatgggaaaaaacataaataatagttactcataatcatgttattgtaaattactaatttacctataattagttggactctagctctagcctttatctaaaagttgggttacctgtgaacttagagtgatcctatcccagttctttaatgaatatttttagctatcgcttatattagccgctacccttgtttctcaatgaatatttattcgattacatagaaaatacaaacacacatacattcctaagcatttaacgacaatccaaaaccacaaaaacattacctaatgcattttaaaagaggcatgaacctataacaacttcttgactgtactaaattccgattcggaatttcactaacatgtacgcacctaatggtataactatgcacacacaattttaccacagtatagtcttgcatatttcaccgttttgttgtcgtcaattttaaaatacctgaggatataattttggtacaatccatccgtaagaaacaagactacaattcatgaaaaataataataaatgtatatttcctttaagtaaaaacctctccggactaatacaaacacatttctcctggtttcccgtttgccggggctgaaatgcaactgcactctacaggttcactcacgcgcaattagctggttttgatgggtcaggaggaaaaaggcgcctgccgaattgtaatgccgccacgctaaagacgaggggcggcggcgcggacagtcaaaccgctccctgactgcgccgagttttattccctgccgctccaccacccgcccgctcgcccatttcctctccctttttaaccccccacctcctccctcctataagtccctcctccccaccaccccctcatccgcaacaccgcagctgcacccgcatccgcaccgcaccatcagcgcgcaccaagaaagaaacacggagaaaagaaagatcgccatggcgccgagaacgtcggacaagactatgtcaccggcggccgcggccaccggactcgcgcttggcgtgggcggtgtcgccggagccgccgccgtgggcaccggccagcacttccgtggcgtgaggaagcggccgtggggccgttacgcggcggagatccgcgacccggccaagaagagccgcgtgtggctcggcacgttcgacacggccgaggaggccgcgcgcgcctacgacgccgcggcgcgcgagtaccgcggtgccaaggccaagaccaacttcccctaccctaacggcgcgcccgccgccggtgtgaacagcggcagcagcaacagcagcaccgtcgagtcgttcggcagcgacgtgcaggcgcccatgaaggccatgccgatcccgccgtcgctcgagctcgacctgttccaccgcgccgcagcggccgcggccgccggcgcaggcggcatgcgtttccctttcgagggctaccccgtatcgcacccttactacttctttggacaagcggccgccgccgccgccgcctctggttgccgcatgctcaagattgcgccggcgccggtcaccgtggccgccttggcacagagcgactccgactcctcgtcgatcgtggatctggcaccatcaccgcccgccgcgttggcgaagaaagccatcgcttttgatcttgatctgaactgtccgccgccgatggaggtctagcagccggagtttttacatgatgaccgctagttcatttatttctttttaatttttagtagtagaaaaattccgtgtacctcttatgcctagaccctcttgcttaactgagggaagacatttttgtaaatagtttttttcgccggcgatgtagtttaagagaagatcacaccatgtgtgtcacctaagacatatcctgccggcgttgttatggagcgggattatatatgtattattattattttgatagtcatgagaaactatgtagaaacccttctaagaaatcatcttttcactctgttttgcttataagctctagctcgtgataaatcaggagcgttaccggcaaggcggttcatttattggtggcatgtcgtctgagcgtttgcacttcgaacccgtctcttctggtctcttgcttgcgatccatgcaacaatcgccgttatctttgtcgattaatgaacactcagtcgtctcgtcgtgcatgggcatcccacccatacagtctacaccactcacgtgtcgactttagcaggcaccggatcgatcacccgtatcagcggcgatgtcattttaaccccgggtagttggcagcacgagtgaggtggaatcattgtcaattcttacgcgtgtagagggatgaggcctaccgacgctacagtcgccgttgccgacgcaaagattttttttttacccgttcaacgcgggcactcgccttgcccgcgcgcggtcgttttctgaccaatggtgtcagggaaaccggagggaggaaaaaggagagaaaaaactattgccgctatagtacgtgttgctgtcaaggctggggcagcggcacaaggaggcgacgacgcatgtggataacgaacgcgtaaatcgaatcgagccgaatagaaaaaaacaccggcgcgggggcgggcggccgccctgagcggcgtgcggtggggcgggtggatctttcggctccgcgtcggtgtgcgcccgcagctgtcgtacggcgtgtggatggctaccggcaacgcgcccgcgtgctgccgggttggttcggttggttggtgggttggttgcgccccgcccccgcctgtgcctgcctttcctttccgctcgtgacctcgggagtaacgtgagcgtgtgggcgacgacgcccacgcccacgggccacgtgtgcgccgctgccggccactcgcagcagcagccgggccccccgggatcgtcgctgcggccgcgcgggcggtgtggcccgatctgcgggcggccggcgcgtaggtggaggcgagtttccgttggctggattccgtggtgcgtgtttggcccccgcgcgcgaggacctggcgtggtcgcggcagacagggggcgtgggaccacccgtcgcccgcgcgggggcgtcggggcggggcgcagtgattcgcgcggcggccgtttcgccatcgcgcgcgcggggggcgtgggccccacgcccgcatcgggaggtcgccgctttcgtcgcggcgcccccaccgtttgctcggctgtttctttacggcttctctccctttcttgttttttttttctcttttttcttctggagcggctggaattgcggggcggccggctgctgggtgtgcgtcgtgctggacgactgtccagaattcggcgtatggccttttctgcgaagccggtctgtcgttgccgtcggggagacgattttcgggcgatccggtcgatgtgaggtcagaagtgacgagcggtgattcgtcgaaattaattatacttggaaattcagggctcttcattggtgaatccaactgtacttccgtgtgatttgtcctatcctatactggtggacaaaggtggcgaagctatgacctgtgaaggcgaattcttatcttatgcgccagtactattgctgcggcgtgccggcgtggtgctcgtcgtcggtgcggcgctgcagcacgtgaagccgcgcatcattcgcaccgcaaaaggtgcagcgccctactcctacatgtcactggtcacgtagcgtgtactagtccatgtagcccaaaatactttgagctgggccgccaatcccaaggaagaccgagaaaagcgaagcagccggtcaaaaggtatttgcggctgcggcatgcgattcacttttatgcttttcgtctactctatcgatcggtccagcctctgcttgatgccctctttgcgatagctccagtgaaaatgtagagtgtaataccctctccatctacttttgatagtcatatttcatcttggcacacagatcaaagataaataattctacttatcattcatttaaaatacgctactagttattcctcgtaaacaagcaatttattgatatttacgtttctcgatgtatatgtaaccaatcttatgtggaagaatggagagtcatgcattaaatccgagaaaattattaagatgatagattgttgaagttaaatatgtctatcaaaaataaaattttcagatttggaaatattactatcagaagtagatgaaggggaacatgagaaaatacatttgaaaatacatttggtcgctaatgaagtgttaattctgagagtatcaatgataaaggacacagttgtctcattttcttcgctacacgtaactgctttcagtcaacatctgctgaatagcgagtttataaatggtactttatctccgtactaaaataaaattatttttatatgcttctttaatgatcgtgtataactaaacagaaagagactattggctaaaacagtttctgcagcaataatcaactgctacaaaatgatatttctaaaataatccataagttcccaatgtgttaggaattaaaaatgtattgtaacacagataggtaccaacaatatgacctaaatacaactatacggaaaaaaagccttgcaacaaaggatagaattccggacagataacactaatatagaacaccaaatatgtgacatcttgtatgtgttgctccaattaaaactggcgcatgtaagacatttgccaattcggaatcggtactactctaactctatatattgtgacgttaatatggatgctatatcaatgccggtcattttgtaaatcagcataaagaagaaacgagctaaccgaaccgaaccacccgatagcacggggatctagatcgattgatatgtcctctccctcaccttcactcttgttgtcaatccctttgtccctgcactatccgtctctccagagtccacccccctcactttgctcagcacggcaacggcttctcctctgcataagattgggatgagggaactacacgagatggaaagctgataggaaagtcgttgttgcagagactaaaaacttcgaaacataatcaggcttgtggtagtggaaaaaggaatcgaattgctagcaatatggaagttgtgtgatgatggcattcaatccgtcacgatgtgggacgacataacaaggtaggggtgggtagaataagactaaaccaaaaagtccaaaatttattcggctaattccgtctgtggtcttggttaaccatagtgaccgatataaccataatgtcatttgtgatgtattgtatgtcgtatgaagttgacgactaaatgcatgatgcttgtgagttgatttattcttactacttgatcctatcatgtaatgtattgtttggtgtctgatgttgccttgtatatatgtgatatataattatcaaaagttgtcttaaaagaggtaaagttctgccaaaatttatcttctaaaattagcacagttcagtcaaaactgagactgaattaaccgatcctgacaattttgcattgttattcggttttcactttacaatgatcgaactgactaaatgactgaagaccgaatatcgagaccgggatttggtctgaccgaatacccacccctacaccacagtctaagtagaagtactataaattttcataacagtagagaaaaaatgttatgttcccacacgatacttttttttattattttgttgtagggagaagccgagtactagtgttttattctccacttagtacccgaaacatgtaaataacattatatgtaacattttgatctaactaattaaacatactattacctcggccccagaacataagaagttttattgttggacacagtttgtcggtgacatgggaccgggagtatcatgactagaggcttgaggcagacacaatcgcccacgtggcctgtcaccctcggggggcgtcgggcccgagggtgatgtgttcgccctcctctttgtctccccgaggggtcggaccgctcccgcctcggccccgagggccgaggtgccccgaccccttgtgggttttgcgccgcgtatatgaggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctgacactggtcatgtcgtcagcagacagccatgttcccacgtcgcgcctgcttccggcggaagtggaggtaggtatgggccgtcccatcagaaggtcattcggacggcaatcatacaaatctccgtccatttatgaaaagataggataagtccccacaaaaaagagagagatggtgcatgtggtatccccttgaggtataaaaggaggaccttgcccacttagaagggggatggggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaaggggggcctgcgcggtctcccggtgaggagccccacgctccatcatctggcgcgccaggtagggggctctgcgagtgatcttctgagctctcgcactcttgcgtgtgcgccaagcttttcctgttcagcccaatggccgaacaagcaaaggcgcacaacctctctccgagcgttagcggtgacgatgggaagtcaaacccacgccgtcgagctcgtactccatcgccccctccacgccaaagtcctaggagggaggaggtgctcgagagggtcgaaggatccgcgacttcgacatccacgggtgatggagaaggac

SEQ ID NO: 73108 - DNA, 26122 bp, Oryza sativa
cctcgctccgctcctgcgaaagacggttaattaccaaaattctaaattagcgttcggtcaaaggaaaaaaaaaaccttctctcctccccacgaataatcctcctagcaacctcccacctcatcgatctacaacacccgaactccgttgcacgtcgcgcgtcacccagatctcggcgtcagggtcgtggacgtcgatttcgctcccggccctatcggcgtcacaatcaccggcgatgatgcatcggccaccacggatcaccgccgacaagagcagcatccccgtccagatcgtcagccggcagcaaggtgattgggttggtttttcttttatttggttggattctgcattttgaacgaaagctgtcaaattcttctttctttgatttggttggattcagaattgacaattcatcataaatctgagtaaaattgttaagcgatattacattctccataatttaattattgcaattgctaatcatgctctaaacaaccataatgttaatcgtgctcagccataatgcaagcaactaataataattcctaaactgacagtagtacctttgggtggcaaaggtctcattgatcactgatgactttattagaaagccgctatgctgctgaacaagtataaagaacaaaatagacacatcatcaaaaaacaaagaatctaggaaacacagtgaaaatctgaattcgagtgtagttccaagtcataatgcaccgttcctctacagagttaccccaacatcaaattaaaagtccttcaaactatctaactatatgcagtatattaccttgacgatagatcaccaaaacaatcacgaaatctgaaaaagtgtggaatctaatttaataattacaacattcttaattaacatttttttataccctcaattagtgttttgttagtttaactaggaagcaagcccacccagtaggcgaacaatttatttactgtttatacgtaaactcgcctatcaccattcttcgtaaatatacgagttaacatgggctagattatacatctaatttacttatgcccatgcattgtgtaatatacaaaggaataattgtcaaaagatgatatcactaatgacgcaaccctcataggtgccggttgggaacgggccttaggtgtcggtttcccagctgacaccaatttgatggcaccttttccccgggcataaccgatacttatagagatttaaggtgtcggttcatatcccacaacgattcctatagtattcaatgaataaaaatcagctcgatggagccgccatcaccgaatctaggcagcagaagaagaagtagaaccaataaagcaaagtccaattacgcatctagtgccacggtggcgtagtccgacgtggctcaccggccagtgccaccaccattgttctcgacatgtgacgagcggtggcaggcgaagacctggtcgtggaacttttcgaggcgggtgtgcttggctgctcactgctccgccaacttctgctacttgacatccccatcgcgacgaaggacggacatttttttctcgttactctgcctcctccctcggtgccctcatcttcgcctcaaactcctctgcgcctcttgccaccgacacgccctctccgtctccagctgcatctctactctcttcaccctccacattgcttccttctaatactctctgcatctctgccgcacatgccctttgcttttcctccatctccaccatcacctccccacccgccatccacggtgtcaccgctatcgccgtaggtgccataggtggtgtcgtggtgaccgtcgacgcgaagctaagggtcactgacggtgagggtggtggtgccacctgagatgatgatatctagggcggtaacatcggggaggccatgagcagcgacacgacatcggggtgcccttccttgactagcttcccagtgcaattatcgagcaactagccggcctgccacacactactatgtcaaatggacaggaagatggggagggagatgcaaaggagggaggaggggagaggcgaatggagaagagtgtgagagagagagagagagaaagagagaagggcacgggggtgggccaggggagtggataaggtggatggggtggggtgctggctcgactcgggaaccgacacctctagtaaaaaagataacataactatacttacggtttttatttagaattggtacctacaagataagtatgatgggtcctataggtgtttaatcaatacctataatataagtacggtatcttaaagatattagagcgttatgttggaacggtctactctgactattctttcactacttggggcgttgggccgttacgatccatgatgacttatttgtatggttcctggtcttatgctttacatggtagattattattatgttatgatagcctacccataacccagtgacaagtgaggtggttattacaagtgaggtggttatttggcaaagtcggcgttagctaggggtggatatcgagccggctcggctcggctcagctcgcatcagctcgttaagataacgagctaactcggatcggctcgataaggaaacgagccaaaactacagctcggctcggctcgtcaggaaactcgagctagcttgtttggctcgcgagctggacactgctagttgagaaccttgaggtgggaggaaagagggacatcaaaatcaaattaagaacaccacgagaaaagaagcattgaaatcttcaagaacacaaggtcaaagaaacgttgaaatggattcttacagggagaaacgatacagtaaaagcaagattcaggctgacatctcgacaacatgcatgagcacaacaacttttcagaaccttaattaaatccttaatcgttttgatggacagcgcaatctcaatgacgcgccatggatggcaaggcccgcgctgcttccatttcggccgctgatgaggtgagattccgtgtcgacgagagcggcgccgcgccggaggggatgagtgcgacgtgcagccggcggcaacgacgatgcagcggggcttcgagagaacgagagaaggcggactgacggaggagacggcgcgtgcgacaactgattacatggataatggagtcggagagcttccactactggcggcggcggcactaccgctcgatttaggaataggttgagaggatgagagtacgacacaaatacttagggttagtcaatgtctgttggagatgggccaaatgggctttctttcacttgcggctgctgctgcttgctagctaaatgggctgctgcttcctacttgccactatttcgttgcttccatgcggctcgtagctcgagctgactcgttatgtctaatgagctaaaagcttagctcggctcgttaacaaactcaaacgagtcgagccgagccgagccgagcttctcgttcagcactagagccatcagcgccatagtgcgagcttgaggacaaagaaaggcggaaagaagctgacgtgctcgagagcgcagcagccacgaaggaggtcgagagagggcgtcgtcgcgacgaccacacatgagcttgccccatgtgttggccggccaacctcctactggctactactctacagctatgccatggaactcgccttctgttgagaaaaaaatggagaagaagaggggaaaaaaaacagaggggcaagatgggagagaagcactttggatggaatgctaaaatgagatattttgacagtttagtgttgacaccgaatttcggcccactcgttccaaatcccagaacatccttgaatggaacgggcgcccctcgccgttccccgtcatgcagtgctccggccagtttcccggtgtcagtagccataacgagtgaccaacaagtcaacaaccatatcagtacgactgagagtgtcacgtcacgtgggatctgggtgtgtttagttcacgctaaaattagaaatttggttgaaattgaaacgatatgacagatggaagtttatgtgtgtaggaaagttttgatgtgataaaaaagtaaaagtttaaagaaaaaatttggaactaaacaagccttatgtgtctgtcttttattccatagattttttttcttttgcgatgatattttccgtacaagttgtaggtttgtaactaaggcatcgctcctgctacatatatactccctccgttttattcaaaaaaatttgcttgcagtgtttgaccactcgtcttattcaaaaaatttgtgcaaatataaaaaacgaaaagttgtgcttaaagtactttggataataaagtaagtcaaaaaaataaataataatttcaaaattttttaaataagacgagtggtcaaatagtgcaaacaaaaactcaaaatcccttatattatgggacggagggagtatacattttctacgttgtgggatatcagggattttttttacggagttgctagaaatatggcgccatatgctacagtcaattttttttcagccacttacatattagttacatctcatttacaccccacttacatatgtaattagtatgtaattttcgaatttacatatgtcattttagttacttacatatgtaattttgagacttatattgtaaatacactaaaattacatatgtaatttagggcttacaatgtaaatacatgccgactattttttgatgaaaaacatggcgccataaatatagctacacccttttatttttatgtacctacgtgagtataaaatcccttatatattcaggatagaatatatagttctccgtatatatgacaaattgacaatctatttgtttgataaatgatttttgaggaaaagaattttcctttatttctgacctttttttatatgttagatacatgtccatgcggtacgatggaacataattacatcagtagaagctattgtctttttaatctgttatatgggaagaaataagtagtaatgtcttctcggccaattataatgcacgataacgtgtgctagctctagccggaaggttgatattaaaaggtgggatgaaaatcttctcaaacccacgaagggacttgagcaagccagtaccgatttgcattcaaaggctgccaaattgagtggagaagtgggactgctcttggattgtctgaagaattatcgatcacccaattagacgtctatttcatcattagttactttggagcttaatttacttcatatttattgagtggagcagtgaatgtttaaaagtgaataattatttctgggaatgctgagaaccttttatcaaacagtcacttctgaactttctatttatttttgtaaacgtcggatgcttatgtctaaaatactttttgtattattatttttgtaacctgataatcttatattattactttttatttattcccctgttctgatcatcctctaaaggtgagtactctacagctgcaaatttctttgctatgtatttcaggactttgtggaatgttattacttttattaatatttgcacacgtacacgttattttctagtacaccatacaccaaatacatgaggatctagagagttttatcgtgttaacttattaattatcaatatttgttgtcatttcaagaatgtacaattttaggctagtaaggtctttacgttccccctccccccccacacacacacatatatatatatatatatattaagatgtttttgccaggaatttcgtaagtcacccatatcaagtcggtttggtattccgcacacgctacgccgtatcgtggaacgagcgtgggacgtcggattttcgtgggccggctgggcctcctgcatgcctcctgaatgcctgctgcccgtatggctgggcctcctggttgcctcggacgatcatgccccacctgggctggatcggtctattgtctccaaatcgagcaagtgcaagttgatgagatgttgttgagttgataatttctcctattttgattatacatgagtatttctatctcttctcttctctactatttgtttcagttagcaaaaaattacattagcactttctgttgattgactttcttttgatcttgtttccgtaacaactatttgtatgggagaggagacacgcgaatcacgctagctagctatttctgtgatatatatatatatatatatatatgtttcttccatctccgtctttcattgatctgacggctacagatgtagcccgcgccatagctccgtcaccctctcaacgctgcacggcgcgtaaaggcctgattgctgcgtgcggcaagggatacgtgaaaaaggagcgggcccaattaaatcgcgcagtccgcttgcgagtcatgacttttcaatgaatgttacgcgtgacgaaaatcggatacggacaacgtacaatagctttaataaaaacatcttcaatttttaaatcgcggacgagggcaacgcagtccgaatcagacatgcggcaagggcaaatcgcccgcgcgagggcgtcacaggcccaatcgggcatgcagaaaattgcacgcgcgagagcattgagggcccaatcgcggtggcgcgtcaaggcgcgtgtggaaaacgtacttaggcatgggcccaatcattgcgtgcggcaagaggcgcgtgaaaaagaatgggcctaattaatttgtgcatgtcttggataagagggacactctggcgtaagaaaaaagaaaagaatttgacaaaaacataaaattaaaaccgattcaaacatagatgatgtaccaaaattctggcgaaaacattttcaattttttaaattggttctacccgttgcaacgcacgggcatcttttatagtatatatacatatgtatatatatatacatatgtataatatacatatatgtatgtataatatacatatatgtatacatatatatatatatgtatatatatatatatatatgtatacatatatatatatatatatatatatatatatatatacatatatatatgtatacatatatatatatacatatatatatacatatatatatatatatatatgtatatatatatagtaaatttgtttggtgctccatggtgcccggacaccatgattgaaattgagtatataccaaattcaaatgagtatgaatttgtgtatgccccatatgggtgtcatatatatatatgcatgtgtacggctttttgtccgcctacagtttaagctcatgcagtggtggagcatatttagccttatctttcgcttctatacgtactttacaatctttatattgcacagtttaggcacttgagtgttggtgcatggtttcatcttggttcaccttgttgtgatcagtgcatgatgtagacgttatactcgacgatggcgtcgtttttcttgaggtctaaggtgtgcgtcttcaactgggcgtagcctcgggagaaacggaaagtgccggtgccgccgatcactggcatctcccggacattgccaaagggaccattgcggccgagcacggtgaccacgctgccgttgtaggggccatgggtgaacaccaggttcatgacctgaagcaagccaagcttggcgaggcccgtgctcatgtacatcccttgggcccggcccacgggctgggactcaggttcaggcccctcggtcagcgcgtcatccatgacatacaactacccaaataatgactctgaaattgggtccaccgagtccaccacccttacagatgttggggacggcttgctcaccttgtcgttgaagtagaagtgtaggtgcgtcatcggctcagacgccaatccacggcgggtcaaacccatcgtggtttctttcgggcgggccgcacctgcagccgctgcaagggagagcacaagggtgatcaccactactcccttggcttccattgttgtgcttaattagtgtgtggaagctaggttctttctatatcttgtgacttgcgagtatcacttggagtgtgtgattcaagtggagctcatgagctacatatagtggtggcatgagcactcagcgtgcaatggaaagcggcatgtggcaagcggcgatcgctcaatcggcctcaaaggctggtgttctttctttttgtgagaacaggctgatgatccatatggccgtgtagtggaagcaagtgaccacaggtggtaggtttgatgggcacagattagggttgatcggcacagatacaatggtttgactctggatgggcaaactgtgaaaaaggaggaagatcgaagtggcatcgattggtaggttatggttgtgaagcaaacactggaaaagtattggctggtcggctcctagattgtgtcagagaaactcatcaccagttagctagattgttgatcatatggatgctactaccactggtggagaaatcatcttttgtcggtcggccgaattctataatagtcccagttgcaattaaaaccgggactaaagatgatctttagtatcggttcaaatgcagtcaggacttgtcaggcccccctgagatctttagtcccggttggtaagtcccacccctatatatatatatgtcttcttcctccttcagcccgagcaagctttaaaatttcttcaaaaaagaggggaggtcatgccaaaatttctagtgaatttattttggtgattatatacaaatcggaggtgcgtagaaggttagcaacttcatactccaatgttttttttgtcatattacatttggagctatgttttgcacacttttttgtctccaaaattttgttgtaagttgatgagagagaaaatttatgtagggaagaaagaatatattaatttagtgaaagttattcttaaataatagaaaacaaactaaaatgaaaactaaaagaagtacaacacattaatactagtttaaaactttagaaatagtaaataagaattatttggtgtaatattttataatttttgtatgaataatgatatgccaatactgtacgagtgttgaaagagtttgtaattgttttatcattattgtatgactgtcattactgtacgaataattatttgtgtacgatttttttttatttcatgtagatggatcggcaatggatgtacgctgaccggcggtccaaagagtttattgacggcgtgcattattttttgagagtggccaaagctaacaggcataagggttttatttgttgtccatacaataagtgtaagaatcagaaggagtattctgcatccaggattattcatttctacttgtttgagtcggggttcatgccaagctataactgttggacatcccatagagagcaaggggttgaaatggaagaagatgaagtggaagacgacaatattacggactttgctcagtacgctggattttaaggaaatcaaatggatgaggaggaaagggatgctgatggtaacgacattgtggatgatcttggtcagatgttgcaggacgccaaggaggattgcgaaagtgaaaagggggcccataaattggtgttaccaaccgggactaaagatcgatctttagtcctggttatttcacctaggactaaagatagcgatctttagtcccggttggacaaccgggactaaaggggggttacgaaccgggaggaaaaagggtttctccaccagtgtacatccgtttcatatcataagtcattttgatttttttctagttaagtctttttaatgtttgatcaagttcataaaaaatatatcaatatttcaaataaaacaaacataatattgaaatatattaaagtttatatatttaatgaatctaatttagtgttgtagatattgctaaatttttctataaatttgatcaaacgttaagaagtttcactaaaagaaaacttaaacaacttctagtatagcacggaaggagtattttacacgtgatttttttttccgagagaacatactgcgagggctttgcctagctttacaagtgaaatttcagtaccactaattgcagagggaccagatgatatggatgcagctactgtcgtacgaatgtacgaatgaaataaaatcagattggtacttttttcttgttgatggggacattggacatattgtgctccttatggtaggggtgaaaacggatcggataatatcctgtccgatccgctccgaattcgtctgaatcgaggatatagtataggattttagaaatccaacgtatatagtataggatatggtatctctaaaatccggtggatacggattatccgataggccgttttccagataatccgaaatagccaacacatgtgacctatctattgcatataacaaaagttggtctatccaatggcctaattcatcatttaattaacctatatttcttagtctgaggcttttaccgtctcatgtcacacttgcgtagctgtatttttatattatggatatcatgtattcatgttgtttagcacttaaacacataattattacaacggagacctgttttataggtgtcggtttattttaaaccgacacatatatgccttttcccatcttcacacggtggaaaaataataaccggcactttttctaagatgcataggtaccggttcttattataggtactggcttttaaaaataaaaaccggtactagttgcaacgagactcttttaagaactgtttcccttttataagattggtaccgatgtttcttctttttttctctcgttggtgcaattttttattaaaactcatagatttactttcggcataatttttttttattgtctatagtaaggtgattgtgtgttgtgacagaattgagtggtgacgactcaatgctcctagactaaggccgagtcgtagggagaagcttacaacgacaactttctcgttctacgtgagtacgttttccaaatctctaaacagtgtgtttcatataaaaattttctatatataaatttctttgaaaaattcaagtcgatctttttttttcaattttataataattaaatactcgattaatcatatgttaacggctctatcgtgaaaaaaaaacactcccgtaatttacctttgattacatttgtacaaattttatcttcttctaatataattaatatgcaaagctgttacgggttcgaaaaaaactcggtgttttacctttgacaaatgcttatcaacctttgagaaatatatcttgacatgagccgtatatacgtttgtattcgcatccattgagtatgtgtactctcatggagaaatcccatcagccttgttgttatgcgcagttcatatatgtaccgattattttttttagataatggaataaaacatcccggcctttgctcatcagagctacagccaattattacagaagtaacacccaaacactgagtgtagttcaaatgaattaaacacacccaacaaaataaaagatcaaactaagataaggagagcatatttattctagtctatttatgaatctccatccatagtttgcaaagagctgcatgaccgttgtctcaaacctacgacatgcaaccttcataagctctcgatcatcttcacacatttgcagctgtgcccaaaatcggagccaatatgttgccctgaaaattacctgcatatatgagatagatggtgatttgttaaaaaccatatcattcatagtcaatcacagagcccaacatatggcagaagctcttacaagtatgagtttactcagcttcttgtctatccccaaaagccaaccatcaaacatattagatatggtagtaggaaggtataaatcaagagagaactgtactgctctctaaacaaattttgcataatgacactctaaaaaaagatgttgaatagtctcatttttcatacaaaaataacatcttaaattgccattttaatttcgtcttgccaaattatccttggttagcacaatctctttaagcaagtaccacataaaaatcttaatcttaagtggcatcttaagcttctaaataatcttatttctctcactataaccattattaattaaagctagatacatcgacacaatatttcaacatatatctatcaaatatcaaatcttatatctcttcttcattcagtttgatttagaattgtatttttttagaaaaacattaattgaatagtaattcattagttcttttattgcattttgtgctctaatatctgtcggtttatttttttttcccttacaaatgttgtcatatattagtttccctattggactatgtgatattgccctttgcattacttctactaatcttataaagttgaacgcaaaaaatgctgttctaccttcaaatttttgtcatagaaatatatgtaatttatactacactaaaattaaactagaatttgtaacacatcatatgtctcgtgtgttagatgtctaattcaatcaataaaatcccacaacaacgcgtgggatatcatgtagtatttgctcatgaacgtagccttttcttccacatattttaattatataccaatgtttatcatgaaaatggggccagggcttcaactttgctaagtatagacacggcagtggtacagacgagaagaaaatgaatcaggtttaccacccaaaacatacacaaatacgtaatacaaaccatttgtgttcgagctgattgatcacgttgtattctccaacatgaacggtgaagagacatgcatgctgctagctggcacaattggctcacacatgtaatccgttgtggaacaaaatccaacatgattagatgaagctgcaattgtagtcatggtggagacggagatgcgaaatcaatcaagcgaatcaaaataagggtggcgtacgtgcttgtgtttctctataccttccaagctgactcttgtcatgaattgatgaagaactagtttataagagttttagtaaatacaccgtaggtgttcaattgttggatgcaatatgtttatatacttagatgttatatatatatatatatatatatatatatatatactatagaaaaaaaacccatgcatgcgttgcaacgggtgaaggctattttaatcttattattgttcaccttgaaattcactatgaaaatttgcttcgatatatatttttctagaaaatcatgtaagttagcatgcgagtttttttaagatatttcttatactgactccttctatattttcaaaagcggacgaacttaaaacccgactcaaatactgatctgtatttccaaaagtaaacgaactgtattttccaatatggttaaaaacctattcatacacggataacgtaccaaaatatcggtaaaaacatctttaatttttataatagtagagactagattcatagaaaggaaggctacatacagtggcggagggcagctaggtagcgtctgtaccccaaaagtggtttttacacaataccaaacatataattttaatactacaaaaataaaaacaattcaaacacaaacaagaaagctgttcaagaaagttagaaactcatttgtattattagattttaacttccacaaatctataccatacaaattaaactagtttgataatttattgataaatatcattatttttctaatcatcccatctaattcagagtctgaaccacatgacgaaaattaatcctggctccgctaccagctacgtagccacttatgtcttttcctcacagagatcaagtccttgaaaccaatatatcaagtagtaatgctaccaatttggaatttatcccgcaaagggccatattggtgtaaaaagtataaggaactagatgatgccccgcgcattgctgcgaaacttcgtagttagaaatggaggatattacatgtggaggtggcagatagatgtaatagaaagcacataggaaatcatattttatttcagcaaaaagtagccattattaattcataggatgaaatctatgaacataatcaacattagtatagttaggtacagaatatctcaaatagtaatagcaatgcaagagactcttttttttttatgtaagacatgctagtcatgactgctggtaggagcatgagtgttttaaatggaactgggaccctaatgaaaatttgtaaaattgaacgaatataggtatgggctagagcaatggttccaaatgaatggtaggcaacaaaacagaactgagaagattagtggctgcagaaatttttcatgtatacagtagcttaatttgtgtaggagaggttattcgtcgagctaagtaattatgtgtaacctactaaaagacaaaaatattttgtctcgttttgattcgtatcagttgaacttcaactttgttgaaaaaaaatctaaagaggttaaaagttttgtcatggtctttgggtcgggcgtcctaggctcattggatagttaggatttgttaggattagatgaggtttgttaggattagattaagtagtcatctatctatataaggagggatcctatcccaggtcaattaggcattagatcaagatttatcttagtgcccatcggcctgtcttctcagtgcgacggagagcgtcacgccgtttaggttcaggaccgttcctcgatattttatctactataatccaatctatctccattcatcccgattcttgtccacaaaatcctttcccgtgacaagttttgcattcatgctaatgatctaggtggcctttggctaactttatgattcctcttcccctaaactgaatataagattaacattgtgcaatccctttaccataaaataattttatttatcttgtaacaaaatacagttgccatgtctaaataaaccataagaaatttccctatctcataataacattctctttcctgagaatactaaccacttgttagagtggaaatattgtaatgatggaaacaaaataacttgtataattctggactgaaagaattcatagaactgaagataaatagttgcactaacctgatgaatctcccaatgtttcggagaatgtttaattgtgctgtgacaaagaacatcctttatactttagttaattagaaaaaaaaagaaatttgaagaattaagttacgtcaaccacaaaattgtatcttataaacctgaattaaagtatgaacatcatatagcaaacaatgattagcatggacagatccagggaacaatatgtacctgaattaggttcacttctgaaataatcacggtattgacctttcaatcaatcatagtcaattggtgaaaatctgatagttttgttatggaagaaattacttacaaagcaggtatcctaggataggcatatataacaatggccctgtttggatccaagggatattttttagccctccctcaaatagcccaaatagctaaaaagatccaaataggtgagctatttgagggctatttggaaatagcccacccaaaaaaactatcccacccaaaaagtgctaattggggctatttcaggtggggcctactgaaaaagtgtcttttctctctatctctctccatgaaaaggtgcattaaaagccaaatagctctcaaaatagcccttggatctaaataacttagagctattttattgaaggactatttccttatactaaaaaatagctctcaaaataactcttagctagttctccaaacatgactaatatctggaaaagctagtgaccatgaaccaatgtgaggcaattatgcattactgaatatattgttgatattttcttgacagatgtgtcatattggtggaagtacatgtatgttgtagttgctgatttgggtgggaatgaatgccctggggattgacctcagcggtagcccatagctgctgctacaatgataataggcaatctactaatagcaatgatttgcaaccggaattcagaaataaaacaaaaaataaaacaaattataggtgcagcaatgatataaaattggtatgcatacatgtgatcttagtgttctgatgccatattggctcatctaacaaaatttaaagatcgaatgaatttcaatctgtttgaacagggacagtaaatacctgaagaagaacccaaatcaaatctcttcaataatcttgggacaacaggaacagatcaatttatcatcaatctagcatgactaacgaaacacagaggtcctctcaaaaaaaaacgaaacatagaggccaatagattgaatgaacatatacggtttaacaagagtaagaagcatacctaggaatatatacacatgagatttgttggaggtgaggaagcaggtgaaggtttgaggggagggagaggcagggagcactacactggccaaggtcacctgtgacgggtccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttgctagtccgtcataggttatgttacctttgacggatttttgttccgacccgtcacggatgagttaattccagaaaaaaaataaatgctaaatattggctagcctcaggatttgctagccatgccctctgaaaaatagaaacatcacagatatattctagtcacagatccatcacagatacatcaccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtccttttttgttcattatttctgcaagaataaaggcgcacaattcgcctctgatagcgggggggttgatgggtgagatcttgaagccagctctatatttctgtttaataaataagaggttaattagcacgttttgaatagcaatgtagatattgaaatgagcttatgtcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacctttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatagcgacgactctcgatccaacacaaccttaaaatatttacgtattagaactaatttaattaggagatatagtccagtcatatcacaagtatagaagatatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttagcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgagctactgacaatgccggtccacggggagcctcaattgatagcttacacttgggaggtgtaagctccgtcggtcgacttggacgaggagtcatcttcacaactgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttctagggcacatcgctaccaattccccgagttcggctaggatgttctttggttccgagcgcctttgtgaggatgtcatcttcgcgcctcttcggcgcggactcaacctcgctttgtgaagcttgttcagcaaccaagcccaactagaaaagaagatagtagtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggtgaagaggtcgaggcggtcggcggtggtcggggatcccggcgtcggggaggtcagggtcggggaggtcggggaagtcgatggacggacggcggagaggacgaccggcggcgagggcggcggtggagacggcggcggagatggtggtggagaggacggcggagatggcggcagagagggcagcggagatggcggcggagagggcggaggagaggttgaggcggcgacggtggagatggcggtggagaggacggcggcggtcgagagagtgagtgaggaggcggcggtggagaaggaggcggcgagggcggcggagagggcggagatggcggcagagagggcggcggcgaggagggcagcggagatggcgacggtggagatggcggtggagatggatggtggcggtcgagagagtgagtgcggcggcggtggtgcaggccggcgtcgggaaggtcggcggagagggtgagcggcagtgaggtcggcagtggagaggtcgaggcggtggtggggaggtcgaggcagcggtggagaggagggcgtagagggtggcggagaggtcgagagggcggcggatttggcggcggcgaggacggcggtggagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgaggtcacttgtgacggccctacagatagagcccgtcacaggtgagtttgcctagagcaattttattttattttattttacttagttcttttattttccttaacatattttcacatacactacatattttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgctaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgttgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgaacctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgatcatggcaagcataatgtactttcttttgaaacacaaccagggaggaaggttatagttaacaagcagaactgaccatgtactgtgacgactgctcaaatcaccaaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccgggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccatcactggtatccgctcacctgtgacgggctagaaatgaaagccgtcacaggtggcggcccatcacctctgacggcttctaatgtatcggcccgtcacaggtgaggggataccagtgacgggttggaagaaaaactcatcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtggagaaatccttatattctgggacggatggagtagtagcaatgaagtttg

SEQ ID NO: 73109 - DNA, 26586 bp, Oryza sativa
ccatgcggttcataagtggaaccgtacggaaaaataaggggaccggcgcggggcggtcgcccacaagggaaaatcgattttcccgtgcagacctcctaatccgaccgcacgagataatcatcattatcccgtgcgatcgatctaagtggaccgtacggaaaaatcgattttcccgtgcgggctttttaagtgaaccgcacaggaaaataccacctcgtttccctcccatccacttcaaatttttcccatcctctctcttactttttcccttttagtctccctcaactacccccctttctatctaccttatctcttcctttctctaccttatctcttccgccacttaactccctccacaccatcccctcctccccttcctctctgtcgggccggcgagacgtcgagcggaccgcggcgacggccgggcgaggcggcggctgggcgaggcggcgagcaggcgaggttacggccgagcgaggcggcggccgggcgcggcggcgagctggcgaggcggaagctgggcgaggcaacgagcgggcgcggcggcgagccgggctcggcgacggccgggcacggaggcaagcaggcgaggcggcaagccgggcgcggcggcggacctcctcctggtggttgtccttgacgtgcacgtcgaccgcttcctcccatcccgtgcggcgacgaggcgggcgcggcggcgagcgagcgagcgaggcggtggccgggcaagacggcggccctcctcctggtggtcgtccttgtcatgcatgtcaaccgctgcttccattcccgtgcggcggcgagcgggcgggcccccgcccagatccggccggcggcgattttcgcattttttttagttttttttttgttccgtgcgggcggtataacacgaccgcacaggataatcgattatcctgtacggtcgacccgcccgcatgagaaaatgccgattttcccaaacacccggttacagacgggccgaactaccgcacgggataatcaaaacgcccacatagaaaaatgggtattgtagtagtgtactagcctctaactaggtcctgaagcttcctgcatgtcggtttatcaagcctataaataggaagccagtgtatgcatatcgactgatgtattcatccatcacttgaggaaagcaaaacaagcaagctagtagtaaagagctgtccaatcttgcatcacatttgctcctcttccagtacttcctctgcttcagaacgtgctgaacaaatattgcagcaccaacacgatggagcttgatgtggatttgcggagaaagaagctgaggagagttgtcctcattagagctgtcccaacccatagtgtctataagtagtttctatggtgccatatcaacaagacatcacaatagaaactacactctacaacccatggttttcttaaagtgggccattaataaatatatcatccctcttctctaccaatcatatttattcttcatctattatgaagacactattctctcccaatgcaaaacttgatagtgtctagtgcataggttctcgtgttaaagctgtgtcttgcatgagacccagtttcttcctctcttcactctctctcttaattaatatagtgccacataagttaaaagttctacatggcaatgtagttaataccatagacaccatactaggtggagggttgggactgcccttattgtcttcatgtcagccatctaggctgctcgttggtggatgtcggcggattccgtttcctgcccttgagagcaggtacaatagcaagctataagccaactaaaatcacatatcgagaagaaaatagaagagagagaagaaagcggctatagatttgtagccggctgcaacacagactccaagacgttaagtgtgtatgagaggtgggaccaggtcttaatggtgtagtatatttttatagttaactattgtatgaatgagctattagatttgtcagggttatggataccatatacctaatagtagttgactaaatctcggtaggatccaccacataccatgtcttatacggaaactgacctcgagggagtttcggataaggaaagacaaccagagttctacatggaaacgacaaggactactcggattgtatccatattagtttccctagttctacttggacaaggggacacctatgggtataaatacaagcccccctaggaggagaggggagacgaacaatcgacgttcaacacgatcaacacggacaacacagacgaccacctcaatcaacacacctaccacaatatacggaacaacagaagccagaacatacaagccaacatactccaagacaagacgccggatatcgacttcagggatagccatggctattcccctacggtgtctccggataccgtcaggagagacaaaagcgctatctctaatctcgccggacacggattcgaggaggagggctaccctgttgtcgactacaagtcagaacttcagaccgccatgtcgacaacagttagataggctatcccacatattgtactggtgtgattacggtgaataaaagcaataccggctccggccaacaggatgtagggttattacctgacaattcaggggcctaaacctgtataaaaatccctgtctccatctcttttacctcagtctcgcgtatatcctagcaccaacgatccccatactatccaaataccgtagtcgtgacatcaaacgtcgacagtggcgcgccaggtagggggattttggtgcttcaggatttcgacgagataggttcaagagatggactctctgacaacaagctactcgacgatttcggctgtggagagatcgaaatcatcaccatcgactattcgatccggcgagatcgaccaaacttcaagacgtcgccacagcggagaatagtgacttgatattatcaactaggaggtctccgatctccatctcttcggaagcgacatcatcaattgattttttgtaacctcggtaatgccgctgcctgctcagaacaccggccatcgaggaaccaaaatcaacatctcgatctattcactagattcttttgggactcggatcgttctcacaccccgattaggatccaaatttttgacccctgacgcatactgagaacatccatcccgacatcatgtgttccagggattattgatcacggatgtctaccaaggtatcgagagaacaacaagacaaagatccaactaatatgcttgctcctgacgtgtacacatgcatatgcatggactcagtacgtgcttaggcatgcatgcattagttggccgacgtgtacctgcaaagaagaccaacatggctgtctaagttgcaacgtgttgactattcagataaatcaacggccgcccgtgatcaggaatttagtagattgattttttaaaaatcggtctactaatttcgtagatacattcggcatgtatctacaaaggtacgcaatattttatatgcaatttatcgtacctatttagatcatacagcattatcagatctataatttattatgtttacctagagcatgtttttatacaatatctattgtgtgagtgtttctgatgttaagtcaactatggtctaacgctgggggctcgctctattttcttctgtataaattatgctcgtttacggtttacataatgcctgatacttacatctgctcgttatatcctgatagtactagaagatccacgcagtttttgagtacatactcaatattctctactatatgtcttgccttctagaaaatatttttcaggaacatttgagcactcgagtaggttgtagtcgagtacaccccactatcgagaacattctcgacaaatgcggagtcgtcgcacccaacttaccaacgaagaccgacgacctatctcatagcaccggccatcgctggactactcgagaaaaggttgttaacggataaatcctcgcgaacgccgtcggcttgatcacccgacatgattgcgaacagacatccggttataccacgagttgggtgtgtgagtcatgctggccacatgagacacacatgtaataaaccaactctagcacttccattggtgctcgagagataatcctactcgctcgctggttctcgcaccaagacgtagcaatctctcgcaccgcaacttccattggtgctcgagagataattctactcgctcgctggttctcacaccagtacgtagcaatctctcacaccacaacttccattggtgctcaagagataattctactcgctcgctcgctggttctcgcaccaagacgtagcaatctctcgcaccgcaacttccattggtgctcgagagataattctactcgctcactggttctcacaccagtacgtagcaatctctcacaccacaacttccattagtgctcgagagaaaattctactctcgctagttctcgaaccagtacatagcaatctctcgcgccttaacttcagatggtcgaggtacgattacggcggcgtagcggtcctcgcaccatgacttcagatggttgaggaacagctacgactggtcttcgaccggcagcgtagcggtcctcgtgccacgactccaaatgatcgagagacacctactcaccagttctcgaccagttgatcgtagtgatctctcatacatttgcttctagtggtcgagttacgactactgcctggtcctcgaccagcgatgtagcgtctctcccactacttcaactttaagtggtcgagttacgactactgcctggtccttaaccagcgatgtagcgtttttcccactagttccactttaagtggtcgagttacgactactgcctggtcctcgaccagcgatgtagcgtctctcccactacttcaactttaagtggtcgagttacgactactgcctgatcctcgaccagcgatgtagcgtttctcccaccagcggtgtagcgactctcctactacatctatttcagcaaagttgataacaggtacacaatatctccaagtgttttacccagagatcacttaccacgacgacacctagcgttgaaacctatcctactgtccctttacgccgtcttgataaggcctccgaggaacctaagggatattcggctggggacgcccagagccgataaggccttgtcagatcctgtagagacaaaataccatgtaagatctgatcgtgtaagagttctcgccgtgcgtattaaccaagccgtgtaatcggaaactgagctttccaacttcacggctgggggctaggatcagtgcttattcaaccaaggcaggtcaagggtccaagagccttatcccctgagaacaattctccgacgacaaggttgggggctagggagagtgtatgactctataaactgactgatcgaagtcggtaagagagaagacgctcatacacaaaacattggtcggtaaatttaattcattttcaatttaccatacatattataacattgtcaccctttgagcgttcgcttaggggctatttctatttgatattcttttctgagcgttgatttcaggaaaattctattcaacattgtggaagactccatgtccctatggttctacaccaagatcgactaagacgagtacgacaaatgtcgacaaagctccgtcgcagactctacgccttctcgatcgctcgagaacggttgctggatctcgacaaggaatatggaatgaagaaatggtgtacacctagacatatagcacataaaagcttagctaagagcagagaataacaggagctacattattataataaaacaagggcatctgtataaagaaaaaaagtaccatgtcttgaagtcttgattgtgagcacgataatagaacaaatatattagttgtcatacctccaaagcatcgataatgaactgcttcgaatcttcatcaacatgtctccagtcatcatgattgagagggaaacccttagttcttacaagtgtaccaacaacatgtggaaactctttagcagctttccctactggctgatcaaattcgttgaactccatcttgatcagtggctcgtcttcttctctaaaccatatgttatcctttctagtgaattttcttccttctcgtttctttggttgtgctctgttggaatctgaaatttgcaagtcagttaattagtcaatcaaatatatgaattgctcatatttataaaaataaaagaaaaccatacccccattctgttcagcagccacaggttgaggaccttcatcttgtccttcaggaccattagtacttccatttcttggtagcctagggtgcagatcactatgtcctacatgctcatttgttgtatcaattcttgctagtctggggcgtagatttcgaggttcaattggcacagagctaatgcattttctcttctacaatatcaaaaaacttgttaaaccactatgattttgttaatagcaatgcatcacaaaaaaaataaaaacatatcagcataccttgctagttttcttagcttgctgtgaagagctagctccttcagtccttatagactttagcatagattctagatttagaacttgtatcctgcgcttgttctcagcaacattttgatccctcctcctgcctcaaaacatcctcaccagaaagaggagaaggtgctagtctaaattctgttgtgccatcaaatgattttgtatctgatctaaatctatgatcagcatctaaaaacctgcgatgtgccatgtaagaactcttgctgccctttgatagccttgtataaccggtttctatgtggcaatcagtgcaagcaacttcacctgaagttgtgcatccatgaaaatatcctaagccgggatagtctgatatggtggttaatactgcagcacgcagttggaaaaattcacccttagaagcatcataagtcctaatgccttcacgccaaagagattccaaatcatctattaatggttccatgtagacatccatatcattaccaggggcagttggaccaggaattaacagtgataggatgaaattaggttgtttcatacacatccagggtggcacattgtatggaattgcaataacaggccaagtactatgggtagaattcaaggatatgaagggattgaagccatcagtagctaacgctaatcttatattacgactttcattaccaaaggtaggatggactgtgtccaagtgtttccaagctggagaatctgctggatgtctaagcaatccatcttttgtacgtccttcatcatgccacctcatatttttggccatctctgggttaatgtatagtctttgaagtctttccttaattgggaaatacctaagaacttttctaggaactttgtggaaacgttttccatcaagactctttctttccatcttccatcgagaagtattacattttgggcaagaagtataattttcatactgtttccaaaataatatgcaatcattttcacaagcatgaatgttaatgtagccaaaacctagagatttaacggccttctttgcttcataaaaatttttaggtagttctgcaccttcaggaaatgcctctctaagtaagtccagtagcatgtcaaagcttttatcactccatcctcctagaaattttgtatgcagcaaacagactaagaaatttagtttagagaaggtcttgcaaccagggtacagctcctgacttgcatcatctactaatctataaaaatcatcgacatcattattggcatcccctgaactgccatcagcagcacccccctcccccatttgatctaaaccatatgccatatctctaagcatttcaggaatttcatcacgatcaactgccctctgttctacttgaacttgttcatgtgtagtgcaatgtgcagaagatgatgcttccccatgaaaaatccacagccggtacccatgcttaaatccatcacatatcaggtgttcaattacaatgtttgcttccaaccatgaacaattaacacacttcttgcaaggacacagtattttatttccttttgctgaatgagtaaaagcaaattctatgaagttattgacaccacgtctgtactcagttgtgctcctgaaatactatattattagagtttggacaaatgaagatagtgaggctaaacaattccatgctagtaattgtgtgtttgtacctaggcagatccatccatctcttatccatgcttgccttttataatgaaatactaaatgtctgaatataaaatgcaaatatttgttatgatactgcaaaaacacaaatggttgccatagctctcaagctcaacaagcattctagtcatacattcaaaaggcaaaacatcgtgtaaaaaaaaactaaagtatgtaaaagtagttagtaaaccacatagaagtaagaaaaactgatgtcaaagagtaagggaaacacatgtaccttttagttgtgcgtttgcttgttaatttgttctggtttgcttccaaccttgttggtgtctctgattactcagcaagaccttctacatttttggataataaatacaaaattttaaatgcaacctctgcgatatattttgctcttgtgcaatgcaattgaaaaattaaataatctgagtgacaatcctcaggttcagaaaagagcatctgtatttctttttacttaagccactgaacatttgtattttcagatgaaataccataaacaaaatcaagtagtcaccctgtttatatgcagtacaatgggttagttagataccatatcacttaaggtaaattttgttaattgttagcacaaataaaaaggcagctatacacctaaatccagacaaagaatggatgctcgcatttgatggtctgctgctttacttacataattagaggagccccctagtcataaactaataaacagagaaggagttccacttccatacctagctaaatatgtcagggaggtcaagtagacaagaattaagcaaattccaccataactactgaagatagatctgcaatggaaaaggtagaaaattggttatgccagggtgaaataagcacacatgagtagtaacatctcagaagggatgggacaacaaccaattggaaaaatattccttttacaaagacagtaagaaccatcatctatcatttctaccccattagtaaaattaaaaatcttagcacaagactgaacataaaacagaactgttggtaaaatttatttttaccaacagactgtgtgacaggatattttccgacagacaaagtgacatctaaatttttttctactgacagacgactgtcttctttttagtgttgtggtgtagtgtgtactcaccgagataaaatttcttgacttcaatccaaattctcgattacagcaagacgggagacttagtcgtacgctctgtactttctcggtcgacatcaaagattgacttagacaaaccctttcggtacccgcacgaggctgataaaggaagtctaacgttatctctaaactcaccgagaacggtcacgtgagctcgataacagttcctccaaagtctgcgtattgagaatatgaactcgtttatttgcatcgaagtcgggggctactgtcagggttatggataccacatacctaatagtagttgactaaatctcggcaggatccaccacataccatgtcttatacggaaactgacctcgagggagttctgaataaggaaagacaaccatagttctacatggaaacgacaaggactactcggattatatccatattagtttccctaattctacttggacaagttgacacctatgggtataaatacaagcccccctaggaggagaggggagacgaacaattgacgatcaacacgatcaacacggacaacacagacgaccacctcaatcaacacacctaccacaatatacggaacaacacaagtcacaacatacaagccaacatactccaagacaagtcgccagatatcaacttcagggataggcatggctattcccctacggtatctccggatactgtcaggagagacgaaagcgctatctctaatctcgccggacacggattcgaggaggagggctaccttgttgtcgactatgagtcagaacttcataccgccatgtcgacaacagttagataggctaccccacatattgcactggtgtgattatggtgaataaaagcaataccggctccggccaacaggatgtagggttattacctgacaattcaggggcctgaacctgtataaaaatccctgtctccatctcttttacctcagtctcgtgtatatcctagcaccaacgatccccatactgtccaaataccgtagtcgtgacatcaaacgtcgacaagattagctatagatgatttggagccatcaatgggctatactattaaacttgctctcaaaaggcgagcagcctaggaggtagtgccgagccaaggagagggagcggagcggccaggcaaggaatcgtcgggggaggaggttgaggaatcgctgggcaggggagacggcgcggctgaaacgggccttgcggcgcacgcgcacgcgtcgggaggtctgtgaagagggtgggcgaaaggtggcgggatggcagcgagaagtggtgcaagaggagggccaccccgtgcatgcgcgtgggcatgcggcgcggccgagacgtgcgcctgtgttcggcgtgcagtgtgacgcgttggctcagagaaaacgatcgatgctttggcttggagtagtgacagggagaaaaacaatctaatgggcttttggcacatggatatgggtctctccgggatggctctatcgtttcgctccgtgtcgcttcagcgttggtacgataggcaacatggatgaccatccagagctgatcaaacggctgtaaatcaagtagatggtgtggcttatccacagctcagtaaattgataataactggactaagtagggatcacttgtataatattataggattcaaggcgtgctgggtgcctatatatggtagcgcccttaccagctccctgctatgccaattgctaataaagaatgaagaatagtacaactccaaaatatgtcaacaaccttcaacacaatctctattttatttggaagttggaactagtagtatacttggtcgttcctcggccgtgtacatattgattatagatctagaggccaggttttaatcccttattaaaaaatatatagcaggatatttaacactgtgtagtttttggaatttatagttctgtgattctgatcacttcaaccaaaactattcacataaacaatcttttgggcacacgtttttttttcttgtggaaaaatttgcccaataatacaatccatttcaaactactgaagtaatatgaccagaaacatgttgacctggtcatccctggagcatgccatacatgcatggcagtatttctagacatgacagggctttcttggtagccacctgcatgagacacacaagcaagtctgcatcagacatccgagcttgctctacttatccctaataaggtgaaagtggagacaacatttagctccatttcacaattttcactcagggaactccagatgcctccaactcccagtcatacatgccacactggtggagaaaccatctttagtcggtcgaccaaaatccacaatagtcccggttccactaaaagccgggactaaagatcatctttagtcccgattggtggctacagtgggtatatttgatctttagtcccaattggtaatagatcatctttagtcctagttcgtatgttgtccggggctgtcaggccctcccgtgatctttagtcccggctggtaacatcaaccgggagtaaagatcaccgtgatctttactcccggttggtgttaccaaccgggactaaagttaggatttttagtcccggttgttaaacaaccggtaaaacaaagcctctatccacgggtgcgtatgcaagtcgcctattaattccatccttatctcctcctctcccatccagccatcctctccatcttatcttcttctctcctcctctcctcccatccttctcttccttcttctctcaccccatctcctcccctttcctccccctcctctcctcccttcccttccggcagggcggcggaatggaggccgcggcggccctgggcggggcgacgggatggaggccgccgccggcggcccggcgcggggcggcgagatggaggcgacggcgggctgcgtcgagggcggcggcggttggctacgtcgggcaggaggcggtggccggcgctggtcgggagggcggcggccggctacgtcgggcgcggggcggcgagatgggggcggctggcgccggtcgagagggcggcagccagcgccgggcgggaggtggcggccggcgccggacgggaggcggcggtcggctgcgtcgggggcggccggcgccggtcgggaggcggcggcaggcggagaatttttttttctcttctctgtgctatctgatgaatgctgatttcctttctctgttctctgtggtaaatgctctctcttttctctgtgatgaatgctcattgttctgaagatgttgtagatctgaataagtgtaaagaatatggatgctttgttgtttgattttattcatttgatctatgatttaggctttgttgttgattttattcattcgatccacgagcgaaagctaaagaacaatcaaaaaaagaaaaaaggccaaccggatgaaaggaaaagaaaaaaaaagaaaaccaaaactttttagtcccgattagtaacaacaaccgggaccatatttttagtctcggttggtgttaccaaccgggactatatatcgatctttagttccggttatttgaaccgggactaaagataacaccaaccaagactaaaaattgatccgggactaaagattgtgatctttagtcccagattcatagtcccggttagaaaaccaggattacaaagggttaccaaccgggactacaaagcgtttctccaccagtgccagtatgccactaaaatgcatatgcatggcagttctcacttggcaacagctagctatctactggtcgcaagcggccattgtttttatatgccactgatgaatgacatgtcactttttttatacttggtagatattgcatttactagttggatacttactccttatttattttgttgcaagagacatttacaccttctctatttgtgtttaattacaaacatttggaataaaatagatcttcgttaccaaaactctgcaggtccacgttagtattggctaaatgcctacgattgtaagatgagttaattttttacggtcacaactatatgattgcatccttcgcattttacaagtgttgactaattcgattccgtgctcattctcctataaacaaatttgaggaaaaagaaagaataagcatgaatagccatgtacatacatccgggactctagactatataaaaatgtgtcatgaacccataaggctaggcccataggcagcccatcctagttaaatttgagataggattattagttagagaaaggataagattaagtattttctcgattaaacaatggatatcaactagtctaatctgtctctactattactattaatgttatcattactgctgtaaatatacacaagacatactaacagtaccattcttcttccgaaaaataatgtgtccatgtgcatttggtaatgttacttgaccttattactgattaaccggctgtaccactgtgcctatagctagaagtttgttgtgattaaggctaagttctaaactccaactccaaactgaagcttcctcgattttcgttaacacgtttttttctaactagtaaacaatgtgctttgcgcaaaaattttctatatagaagtttttctagaaaatcaaaaaatatatttttcaaatttataatagtcaatacctaattaatgatgttttcatgagccatcatgttttacgtgctgctaatatgctcctccaatatggagattcaaataagccataagactgcacgtctgaaaatgtttaccgatgttaactcaaagctaagcaaaattgtataaaccaccccaacggagtagctgctatatattaggcccatagaaaggagtgctatatagctgctttgtgttttcctcatagtactatctatcgagactgtgagcaccgatgtttcctttagggtttggaggcatacgggatatttctgtcattgttaaccaaacgtgtcgtagtacacgccctgccgtacgttggttcctcacgtaatgatatctatccacgtctgcaatgctgctaaattggatttcatgtagcacagggcatcggtgtgctggttttcgatctacgatgtcaccgttttcagttccatgtgcaaattgcaaatactgaatgaaaaattctagtacatgacgatggcaagctttcagaacaatctttatttcttttggacatagcaaggtgttcagaactggtcgtagtctttcaaaagcaaattttttcactgtaagcaaaaatgttcagaaaaacaatcttttgcgcactagtactagagttgaaatggcgagtgctttgaattactgaatatagtaaaacacattcatatggccctatggaccatatcaaacctgtcagtttcacacgcatttttcctccatgtgttcagcctcgcacgaatcagagaaaaactcgcatgttatttatcatggagtaaaaaggcagagttcaacaatccaaaacaaaataaagcttcaatgtactcattcatgatgttgtttttggggtatttagaatcataggcacaatgttgattttcttagtttgccctgtttcttgtccgggttggccactagatcaattgaggacgctgcgctctggacggaacgcctccgtagtgaagacagaatcattgtcgactcctggaaaagggctctttctctccccctctgatctaatgtatcctaaactcactgtactttcctcctctaatgaaattcaggtagggaaaccctcccctccggtggaaagtatgaaaaaaaaactcattcaccttgtgtctgcactctgatgaaacattttggaagaaatatctgccatgaatcaagagcaccagtttctacccttgtcatctttgcaagcagttcaacgggagatggaaggacaatgagtgatcttccttatttatatgtgcctacagttcactttacaatgcatatttttcaaagcaagtttagctgtaaataacacatttatctcatgatctaattccaagcaggcctgactgcattattttttttccacgtccctaacaaataaaaaggagggaagcccgttcctttataattttatttataagaaaacagaaatgtttacaaagaaatagattaaaggatttacaatgggccagctttaacaatgcaatttagtttccaacctatttacattgaaacggacaaccggatcatatacatatagctctcatgttctcgcactctcaactctacacctgtgactcatacatcacaaaggaagcccgatggtagaccttacaattaattactctttgtgagaactctcctatctatcccaaataaagtatccggtgtcataggtagcacaatttcacaattatcgaaattccagacgactcccactcccagtcatatggcttggcagaacatgcatctgcatctgcatggcagctctcacttagcaacggctagctatctatcagttgcaaacgtccatggtttttatatgccaatgatggacgaccaaccacttttttcagacttaatatcgcatttactatatggacacttacttctatacttggcttttttgcaccaaaaacctttcaccttatctatttttatttagagatagttagaataattctagaacttgtcacgagcagtatataagcggtccattgttcttctatttattagttttagttttgaacatcgctaaactagcgctactagagaaaacataagagtatttggacgtaagacattacaacgatggcacatatgaactctagtccgcctacatgccttgagtagaatatatgaattatacaacaaaatagtagttgacgcatacataatacttctcaatcctacacggacccttagctaagactgaaaaatttagttcaaattgttactttgatagtttgcatctccatccattcaaaaactatgacagcaaaaattaagggcaagtcggggtccttggtagtcaactgcgaggtttttgtgcttttgtactccttttaaagcaagccgtggtggtggtgtttgccgatgctagcaccacacctcaaaaagatgattgttgcatacacaccccctagtttatcgttggcgggctaaaataacgtccctatgtaaaaagatttggaattgtttggttaagactcctccgcctcctagtcacgcgctctcccgtccagtcctttttattttcctccgcttccctcttttattccacttcccctccgcctcccactctcgttactcactactcctttccccactcttccaccttacttcccctctctctcccaaacagccgaccagcgtcctcacttctccgggcagtgacggcgagcttcagaattgaagcagaggtagcctctggagcccatgggagcaggagcggtgaccacaaccgtggtggtgatgtgctagcacagaagcagcggatgcgccgccggcaggcttgggaagggcagatatcctgttggtgggctcgggagcggttaatccgccctcacgtttggcggagaggaggcgggtggtaccgtggtgacggcgtcaccgaagcagcaaccatgaccatggtggtggcagcgtgcatgtgtgcaggagtggcatatccgccgctgacgtgcttgtgaccaatggatcctccctcacgtgcggtggagatgaggcgaaaggcggcacggcgaccacaaccacggtggcaacgtgcggactcaggagcagcggatccgccaccggtaggctccagaatggtggatccaccgccagcaacaggggaagagaaagagccgaagagagcactttgcggttgcactgcccggtgaggaccttgctagggtttttatttttaagacaaactataaatcatcgagttgatggtccaccaatctaaataagttcacacatatttttcatgcttttacaactggacagaggaggcaccgtacttctgttctggtacatgccgtcctgcactactaaaaggttcaggacaaatatttgctcaggattgtaaccttttcttcagattttatcaccaatcttaattcctcacagaaagagggtttcaactgaacctactatatacatggcagtagcatagatgagaagatgctcatctgtttctgaacctaaaacaaacacacgatgaaaattaaattaaccgttcgttcgagctgatcgatcacgctgatctccagcacgaattgtgaagatatacttctaacttctggtatgtcgtctcacacttgcaatcagtggccagaacttgcataacttgcaagcgcaattatggtgaaaacggagatgcagaccatctaacgaaccggaaattaaaagcacagcatgtttgtattcctagtgcctcccatgccgacagtaaataaatacaaatgttggtgctcaagtctcggatgaaatagctttcgacttggaatgctactgcctctatcccattatatatgcgtaactgattttggctcaaatcccagaatatagggcggcacctgctaggctccgatttatacacattcaagcattgatgctcccttcagttcccttgcatacatatgcacgcattgaagacatcagcaaatgaaacgctttcataaaatttctcctagaataaatactttaaatatttgtattagaaatatatggagaccatatctatagattagtattaagataatactttaataaaattatacatttattggtatttctatatattataatagaaaatagtggttaaaattgttttttccttaaccatatccttcaaaaatgacaactattattaacccggatggaataagagcctgtttgctaggatcctagctcctagattcacctttgttggagctggagtccaatcaaacggtccatctctacccaaaaaaaatagagcagagccaaccagattgctgcagaaaatataactaactggatggagtggccttaaggtcgctctgcaactccggctctagcatttttacaaaactttgcaccgtaattatccgccaatgccattggatcatgccccttcgtcctcaacaccacaattggtgagtagcgactcctctcgataggccggcttggtgatagggttggcggcacccttgaaagagttcccagtggcggtgcacatggaggagcaggcggcagcacaacccgtcctcccctcctcttgcatctccttctccacacctgccccgaatggcggtagatctagcggcggtggcgagcggactcagaggtattagcggcgggcggtagatccagagatgaagaacgccagcagaaacttctcttcggttgaatcaccattgaagaccctagaactccacactccgtcacttcaattttgcacctgttttgtgattgatttgtagaaagtgttgtacccccaactccctccattcaattttgcacccattttgtgattgatttgtagtacctccgtttcaggttataagactttctagcattgcccacattcatatagatgtaaatgaatttaggcacacatatatgtctagattcattaacatatatatgaatgtgggcaatgctagaaagtcttataatatgaaacggaggaagtagaaaatattgtattaatcagtggggatgatttggtacgaggcttttttttctgattttgcactgatactgacacttgttgctagaaatagtcacttgttttagcatgcagaacgataaattagttagttcctaagaaattgctctaacataattattgtagatcgtacaagaacaagagccctctgcagagaagcttttcttgcactgtatctcgttatacttttaacaaaaggcagaagttctgcataagagaaaaatagttccgcagacttattatacaagagccatcagagaaacttagaaaatatattctatgtaagttagggctaaaagtactactctttgattattatcttgcgtggctaggaaggccacttgttcttcgctttacttcatcacaactatttcaatttctagctgataaaggtttatttgcagctaggccaccgcatcacggaaatccgctacagccatatcctagatgacaaattttatcttcctaatataactagaaaaaatacctatgcgttgcaacggtaaaatattttttatcgctatacacttttcagtcccaacccaccccgctatcttcctctacttggcttgcctctctttgatgtagcccaaaggggagctgtaggctccgcttgcatggtcgactgtcatatccaacctccggaagacagttctgtgtccgtacgatgccagaactgatcattcctatcaaatctggttgaatctttctcgatttcccaaaattggttaaggccttttgatacactcaatctcctccttttgtttttatcaaaatcgaaacggatctgcaattggttgagggattttgatacactcaatctcctctttccgtttttatcaaaatcgaaacgaatctggaaaactaggatagaatggtgacttttaaatggtgattaaatccaataaattaaagcggaattgaaagggaaaatcatatggggaaatgataagggagtagtggggaatcgacttttgcaatcaattggaggaaagaacgtatgaggaggtagatcgacatagcggcgatgttagggtttcgtcctatgaaaaaaaactgagcagataaaaaacaatccctaccagcctaacgatagaaaattcgtgcaaataaagaacaaatcattaccgtttgcgcacgtactcttacgcatgttaaagaacacgacataaaaaacggacgaaaaaaacacagaaaccttgcgtatttttatattaggtatagatatagatatagatagattaacgagcaaagctgttacgggttcgaaaaaaacttccgtgttttacctttggcaactgcttatcaaccttttagacatattttgacatgagctctgttacgtttgtatttccatccgtgttgatgagtatgtgtactctcatggagaaatcccatcagcaggctgcaagcccatttattgttacgcccagttcatatttggccgagtttagtttcaaattttttcttcaaacttttaactttttcatcacatcaaaacttttatacacatataaacttccaacttttcagtcacatcgttttaatttcaaccaaacttctaattttaacgtgaactaaacacaccctttataccgatcgattacttgctgcatgatgacaactaccgccctcgttacttcgccatcaacagcagtggctgatcaaagctatatagggacagttgctagcacatttccccagctatcacacatgagaacttcccaatatgcctcctagtccaagcaagtcctatagctgccacctttgctgttcctgcgtggctcctcgaggcacaactagttttgctagagaaaatgccatggccggttttatatatatgcctcagagaaggacatcaagcaaatgaatttcattgcataaacacttattatattttggggtccattggatttatgggattctatataaatttcttagattaagtgcaagctatatacgtactgagattaccagatactccctccattccaaaatataatgtacaatcacccttaacccaaagaccaagaaataattattattatattgtagtttggatcatcctaataaatataatgtacgcatccaataggattagataacatgggagtggaggatttaaaaaagtaataatttaatggagaagatgttatagttaattgcatgcttgcatgcatgccttatagtattatggaacatctaagaaaagtgtttgtgtcttatattatggaatggagggagtaatttctaagatcaagttgcaaattggagtactaattaatacaggtagttactctcggttaaatagcgtacgtgcatacacactcaaaaaagttactcaaatctatacattcaatatatttacataaaaacatgacacattatcatttattagcaactgatacattaattttaacatgcaaatctgcaatttattacaagcaagcataacaaatcgtccttacattattttcataatatttcaacatatttctatcaaatatcaaatcctatatttcttattcttcattcagtttggtttagaattgtatttttttagagaaatagtaattgaatagtaattcattagttcttctattgcattatgtgctctaatatgtgtcgggttttttttcgtcttacgaatgttgccaaatattagtttccctattggactatgtgatattgccctttgcattacttatactaatattgtaaagttgaacgtaaaaattattgttctagctgaatattgatcacgttgtattctccaacatgaacggtgaagagacatgctgctagcttgcataattggctcacagtaatccgttgtggaacaaaatccaacatgattagatgtaactgcaatcatagttatggtggagatggagatgccaaatcaatcaagcgaatcaaaacaaggatggcgtacgtcttgtttttctactaccttcgaagtctgaactctgatgaaacattttggcagaaatatctgccatgaatcaagagcaccattttctaacctagtcatctttgcaagcagttcaacgggagatggaaggacaatgagtgatcttccttatttatatttatatgtgtctacagttcactttacaatgcatatttttcaaagcaagtttagccgtaaataacacatttatctcatgatctcattacaagcaagcctgactgcattatttcttttccacatccctaaaaataaaagcagggaagcccgttacgttataattttatttataagaaaacagaaatgtttacaaagaaatagattaaaggattttcaatgggccagctttaacaatgcaatttagtttccaacctgtttacattgaaacggacaaccagatcatatacatacagctctcctgtcctcgcactctcaactctacccttgtaactcatgcatcacaaaggaaacccgatggtagaccttacaattaattactcttcacgagacaattctcctatttgtcccaaatgaagtacccgatgtcataggtagcacaatttcacaattatcgaaattcctgacgactcccactcccagtcatatggcttggcagaagatgcatctgcatctgcatctacatggcagctttcacttagcaacagctagctatctatcagttgcaaacgtccatggtttttatacgccaatgatggacgaccaaccacttttttcaaacttaatatcgcatttactagatggacacttactcctatacctggttttgttgcaccaaaaactttgcaccgtctctatttttattcggagatagttggaataattctagaacttgtcacgagcagtatataagcgatccattgttcttctacttattaggtttaatttgaacatcgctaaactagccctactagagaaaacataagagtatttggacgtaagacattacaataatggcacatatgaacgctagtccgcctacatgcctagagtagaatatatgaattatacaacaaaatagtagttgacgcatacataatgcttctcaatcctacatggactcttagctaagaatgtaaaatttagttcaagttgttactttgatagtttgcatctccttccattcaaaaactatgacagcaaaaattaagggcaagtcggggtccttggcagtcagccgcgaggtttttgtgcttttgtactccttttaaagcaagccgtggtggtgtttgccgatgctagcaccccaccactaaaatcttatgaagaaaataaaacgttatagaagttcgctatcaaccagatacaaaacgctctacagaatcagcataggtgagatgcaaatcacccagacggaatggatggataattgggtatatagattgatgaattgctctaatttgttgaaaattaatcccaacgatggtaaaacactataaaaaaacgacttttgcatacacgccccttagtttatcgttggcagactaaaataacgtccccatgtaaaaagatttgggtagtgtttggttaagactcctccgccacctagtcacacactcccccatcctctcctttttattttaatctgattccctcttttatttcacttcccctcctcctcccacttgcctcactcactactcctttccccactcttccaccttacttcccctctcactcccaaacggccggccagcatcctcacttgtccgggcggtgacggtgggcttcagaattggagcagaggtagcctctggagcccatgggagcgggagcggtgaccacgaccatggtggcgacatgctagtatgggagtcgtggatccgccaccggcaggcttgggaagggcagatctactatcggtgggctcgggagcggttaatccgccctcacgcttggcagagaggaggtgggggggtgccgtgatgacggcggcaccagagcagcaaccatgaccatggtggcggcggcatgcatgcacaggagtggcatatccgccgctgacgggcttgtgaccaatggatcctccctcacgtgcggtggagatgaggcgaaaggcagcacggcgaccacaaccacggtggcaacatgcggactcaggagcagcggatccgccaccggtaggctccagaatggtggatccaccgccagcaacaggggaagcgaaagagccgaagagcgcactttgcggttgcactgcccggtgaggaccttgctagggtttttaacttcttttgttttttttttatttttaatcgtttagtcgggtatccttactgggcgctagcaaaaaaaaaaggatctttgcaagcggccttctcgaaaatgattttttgtatgccattgtggtggcctcacatggaaatgccaattttcgcatacacttggtgccaggctggtggagcacccacccgcgaaaactagttccagccgtgtacaaagatttctatagtagtgtaatttgttttccacaaatatacattatagcttacactgatatacgcagtcaagaaaagtagttcctgtctattcaaaatattactccctccatcccataatataagggattttgactttttgtttgcactgtttgatcattcgtcttatttttaaaaaaaatggaattattatttattttatttgtgacttactttattatacgaagtactttaagcacaacttttcgttttttatatttgcacaatttttttaataagacaagtggtcaaacagtacaagcaaaaagtcaaaatcccttatattatgggacggagggagtaacttggaatgctaaattctcagcccagcaaatccatactaaaatttggctcccaaatttatttttagaacaaactataaatcatcattgagttgatggacccccaatctaaataagttcacacatatttttgaagcttttacaactggacagagaaaagggtctatttggagaagacaccgtcctgcactactaaaaggctcaggacaaatatttgctcaggattataaccttttcttcggatttttttcaccaatcttaattcctcacataaagagggtttcaactgaacctactatatacacggcagtagcatagatgagaagatgctcatctgtttctgaacctaaaacaaacacacgatgcaaattagattaaccgttcgttcgagctgatcgatcacgctgatctccagcacgaattgtgaagatatacttctaacttctggtatgtcgtctcacacttgcaatcagtggccagaacttgcataacttgcaagcgcaattgtggtgaaaatggagatgcagaccatctaacgaaccgtaaatttaaagcacggcatgcttgtattcctagtgcctcccatgccgacagtaaataaatacaaatgttggtgctgaagtctccgatgaaatagctttcgagaatgctagtgcctctatcccattatataggcgtaactgaatttggctcaaatcccagaatatagggcggcacctgctcggctccgatttatacacatgcaagcattgatgctctcttcagttcccttgcatacatatgcacgcatttaagacatcagcgaatgaaacgctttcataaaatttttcctagaatagatactagaaatatttgtattagaaatatagagacgtgccgtgccgggcggcccagctggccatgtataaaccagatacacatcgaactgcttccctggtctctgcgtccagggtagttaagccgtaactaatgggatgaacggagtatatattaggctcgtaggaatgaatgctatatagtcgctttgtgttttcctcataaagagcaagtcgtccttgaaaacaatattgccagtagtatctatcgagattatcagcaccgatgtttcctctaggattggaaggcgtccgggaaattttctgtcactgttaagtgaattgtcttaaaacaccttctgccctatgttagtatgttggttcctcacgtacatttatttaacctcatttccaatgctgtcaatttggaactcacgaagcacagggcttgggtgtgttggttgccaatcaacttggagttcttgatttgtgttgtggattgggattacgagctgtctgaagggggccactcgaagcataccaacgtctcctttttttttaaattggaaagagtacataggtgttggttttattacggccaatgatgctgggacattgccgctggatgattggtgacggttccaaaaccaatacctatatcgggtttgaaactgccacctattgcataatctgcgagaatgtgtattcaatagtaatgatatctattcagtagtgtctattaggtgcaactggcacctagctaatatcttgcattagaaactcatagatataaaagtctcatacaacaaatttctatacttcaaaatttatatgtttttatattgtaggccaaaatagatttttttaatagaaaggataccggagaattttacaagagaaatattttcatgcaaaaaattcttgggggaggaggcgccacatctgttccaatagaagccatcactgctggagggttctgacacttatccccaccttcgacacagtctcaaaataagcaatgggtatagggtggaaactgactttgtttagtttgcagttgtgccactgatatgtgggtcctactttg

SEQ ID NO: 73110 - DNA, 1602 bp, Oryza sativa
ttaaggatataaaaactctatctttacatcatcactttccctgcagaaatataaatatgatattcttggaatactcctaggcgaaatacgacagcgatatccgtgcgcttgcagatttatctgtgatcataagaaataccaatatctcctaaccgtgactccttgatgttaaatattttctctccaacttttctttgatcgtcccttcagtaaggaatgttggagcacaatgcaaattcagagggacacacagctctggaactgaggccatgcttcatgctgctaaccctacttttcactactagaaaacacattttcggtgtcgtaggggttccattttcgcaggcgggtatgttattcggagacaaaaccccgccggcgaagacgatacccggggtggagggggctgtccgcctgcgaagatcgatctttgcaggcagaccatataagcgtcgcctgcaaagatcgatcttcgcaggcagcaggcgacgtgcgcctgccaagattgatcttcgccggcatcgcttatatggcccgcctgcaaagatggccctatatagtcttcttcctccccgagccctgttcattctcccgaagtttctctctcctaaagtgtcttaaatataggggggaggttttgaacttcaaaccttcggggatttttctacagtgcttagatctactcatttccaccctaggtatgcatttttttaagcttttagacctcaatttgtgatgtatttatgcatgcaaaattgtgaaggaaaagctccatgttttttaatttactttcttttgatatgttgatgctagatgtatgtgtatgcctcttgttgtagtggtttaatgtggtaacataaattctctttttttttattttgctatcacatccacctcctagttctagatctagatcttgtcatatatagagagagtataaaatttttaatgtctatttatttggtgcaatcaaaaaataattatattagtttgtaatatgccgatgatatgattttgttagattttcctaatatactaatttggcaggtctgtgtaaaaaaaattgaaataaactttgtttttttattaatttacaattaacctttatttagttttgaatagcgataagttttttcaataaaccctacaaatttggtattagttgtacaaatattttatgttcatttttttagatatatggaaagtcgggaatggatgtatcattggccgaggtttttatctccatatagaaatgaagtgtctaaatttattggtattgcgaaggcacacgctgagaagaacaatatgaggaagataattgtccatgagctgactataagaatgaaatagcctgggacttcgatgatgcttttaatgtgaaggagcacttagtaactcgtggatttatggacaagtacgaaatatggacacgtcatggcgaagaacaagtggaggggcctaaaaatgagaaggttccgacacaagttgaagacatggtgcatgacgatggttctgttgaggacaaaatcgatctagaggaaatgttacgtcatgcataacccgaggtgctaatggagtcggctagaagcttaaataactttg

SEQ ID NO: 73111 - DNA, 7557 bp, Oryza sativa
cgaaccctggttggctcccatggcccacatctttcttccggatgctgacatgtgggccccacttcatgatgctccatgttttggcttcaaatgattgcacattttatatattgtagcttaaaaccatgtgagttcatcagagcaaaatatatttccattctttatgctcattctctcccaattttggtggttgatcacttgcatactaatatgcaccaacactcgtggaaattgttagaaataaatcctaccactatgttggatgtttcacatttatggttttatgtaggtattgacggcgttatttgtgcacttaacagctgtcaacaacctacctcaaacgtactgtgggatacacagcaattactagataacaataaactaaacaccatgtctcagcaattaatatctactttagtgtttataattcaccaaagcaatcactatattttagttgattatggtgaacaataattgtaacgccccgattttcgttcgggatttaaaatcaattaataatgtattttctagaaattaaataaaagttaaatcaatttaatcaagtgaaatattgagggaattaaactttcctttaaaaatcattggccgagaatattttgcaatattttttgtgccctgatatactaattttcggaattttcggagctcaatatctaattttaaaagtcacaaagttcatttaatcaattaaataaatctccccttcctccttgggccatttttggcccatgatcttttctccctccttggcccgctcgcacctctctccttccctcctccctctcgggccgacaactcccttctcggcccgatcgactccccctcgcgcaaatcgagccccactccgcccacgttgagctccgcgtcgccggccgttgccgccccaaattcgccactccccggcctccccgtgctctccttatccgtttcccccatttttcccaagcccgccacgccctccctcgctctccccgcgccgatccccatcgccgcccctcgctggcgaccttccatccacacgccaccaccactggcatcaccgcgctcctccacgccccgtcccctactccattttctctgttagcatccgaaacaatgccgccacgcgcaccacctctctccaccgcctttgccgactccgacagcgcgccacccctgccatagccactgctaagccgcgccactgccaccatcagcttcgccgcatcgcgtagcaccccggcaaccgctcctctccctcaaaccgcctctggaacaaccattccaccgcatcacccgagctccaccatacgccgcctccagccgcgtgccgccctcgccttagccatcgccgcgttgctccgccctcacctcttgcctacagcgccgtgcagcacctcggtcaccgttgttcatcgccggaaacccaccggagctcggtatctctcggccaccggtgagccccaccattcctcaactctccggcgtggtattctcgccgctccggttgcctattttccttcctaaccactccatcttcttccccaggaaatcccggcctccatccgccgcgggccgtcgttgaagcaccgccatcgccaccaccccggggagcccgcggccgcctaatccttgccgctggccgcctcctcgtcttcgtctcgccgccccgttcgcacggtgagaaccgcctcctcctcctctcccttttgccgccctccgcgcgtcgtcccacgtcaccggtggccactcgccggccggctttgagccgtgccgtgccctagccgggccgcccttggccgttggatcggctcttggccgatccgagccgtcggtcccatggaccagtcccgtggtccgggtccacggtgccgcctaggccgcggtgggcttggtccaccgtgtgtcctccccttggagccgctgatgtgtgggcccgcctgtcgacgccggccctttgctgacgtcagcgcttaacttgtcctttgagaaaataaataataattgcgcaataaatcattaataattctataaattcatttaaatggctcaaaacatctaaacttcatttctaattcatacgaactccgaattgagccattcaacttgcaaaattcatctaaaatatagatctacatgtttgtttactttttatgtactgttttcttggtgtttattagtgtttttccttgttttgcgtgccagcgtgtagcttttgccatttcggaagtccgcggtcgctaggataagtgttcggaagatcaaagtgaagaagcaaggcaagtcacacattccccttgagcatgttgatcccaatttataaatgttttaccgtttgcaaataaatatgcatgttttgccaattacatgggaatagggtttacctatctgctcgcttgtgccatgtttacttgttatctgtcctttctcaacccttgggtgataatttatctagctcgtgatacttatgttgatcttgctagaattatatgtatgcttagccttgcttaattaccactagctcacaaaatgggataattacatcattagacatttagtttcttgacgagctgcgtgctcgagacatctacccatgtttcatggtcgtaattattgtaggatcgagatgttgactagaggggggtgaataggcgatttaaaactaaatgacacctaatcgaaactaacctaagttgctaggcttggtgagggtcaactctaactaagtaactaagttatgttttgcaatcctagggtgatagtggctctattatatctctaggaaagtaaatcacactcctatgtcaatgtttagcaatcctagggtgaaatgatctctagaaatgtaaattgcacaaatgtaaatgcaacaagtaaatgagacaaggagacaagagatttttcaccgaggttcggcaacttgccggtttcctactccccgttgaggcgatcccaactccagtgctcaacctcgaagccaccgcacgcccccttcgtcaaggggtgggcaaggcgggagccggcccatggagaggactacccaagcctcgatcactagggtagttcttccttcactccgaaggtggtgtactccagaccactcacaaatcggcgccgggcctcctccacaatcttctcggagaggtcaccgggcaactcctccacaagccgtctaggaggcggcaacctccaagagtaacaagcaatgacccggcgtggagatgatcaatcaagtgccacactagctctacaatggaagcaaatgcacttgactcttggctagaacaacctcaaccactacaatggatgaacactaagctcaagggtgtgtgagagaggtgcaagggatgtatgcaattgaattaggtgccaagagagcccccttgctgctggagggggagtatttatattcctaccaaccaaaactagccgttgggggcgaaatcccccaactctgtgctctgccggtctgaccggaggtatgtggccggtcagaccgtgctactctacaacggctagaaaactagccgttgtagccctgtcagagggcccatcggcctggccagtcagaccgacattgagtggctagtcagaccggcctcggctcggtcagaccgccatcagctcggtctgaccgaatacggctccgtcggctctgtatcagccaccccgagtagcaccatcccggcctccagcgggctggtctgaccgcgcatgtgccgccggttagacttccgtagtatggccggtcagatcggccagggcacacctgtcagactggcactgtgtggccggtctgaccgcccctgtcaggccgaacccagtgaaatgaaaagtgattgagtgtgtgagatgaaatgtgagcacaagtctaaatgcataatgacctaatgtggcaattaaaatcatccctttgctaggtcattacccctacggcgaaactaaaaataaactagcaaatttaatcgccctacacctcgatcaattcaaaaattaaagcactagttttaccgtcttctttccctttgctttgcgccgtcaattttaatccatcgataatcatccatgcgcacatatgacgtggacctaacttaaaatatatagctcaaagacaacggttagtccacaattagtgcttgttattaattaccaaaatttacaacgggggcctacatgcttcaatctccccctttttggtaattgatgacaaacaccacaaatatatataatcaaacatagaacacatggacatatattgcaatgacaatcaaaagctccccctaaacgtgtgcatatcaatcatagacaacaaatatggagccaatgcacacttcaatatcacatttcaacaagcacaaacacataagcaatatttcaatgtgaacttcaagaaatattcatccatgagcataagatggtcacatatatatcaatatcacatacaccatccatcatcacacaagttcacatcacttaaccattcaaatcagataagtcacaaatcatcctaaaagggctcacaaaaaaacataggctattacaagaccacgaagggtccaaatgacatagagtccaacaaaacgataaagaacacacaatatagagtaatagcccatatccatacataatatagcacaaactaccttaacctattaaatatgaggtgactaaccttactagcactagtcccaacccacaagacataaagcacacctaaggacatctttctcctccttttggcatcatgtaccaaaaaggtcttcattcttgtggaggagaaggaggacgcgccgaagaggaaggatgaggagcatcaggaagacgatgatatagaaaagcttgggtgctctccaacatttggactcgagaatccaatgcacccactctagtgtgcaatctccccatggaagcattcaagtctccaacatcggtgcgcaagccacaaacatcctcatgcaatgcttcttgcccggtagacaagcgttgaatgctttcacttagggtattaatagccccaagtaccgggttgaagtattcattgggttgcgttccaaagtaagcaaactgtggatggaagaaagcatttggatcatactcaggaggaggaggaggtgctgagcttgagctagctccaggatgagaagagggcaccgtcctaggagcacggggagctccaagctgaaggcggggcttgtactgcttgtgcttcttcaaattttgcccagcagccccaagcttgtcttgaatcaacctcatgatgtaaggggcataatagattccctgagtgaaggtccccttggagatggcaatctcttgcatcatgagagacacaatgtcgaactgacgaccctgaatgattgcatcgatgacgtgccaagccacccccctaatgtcatcattgttgccaaggcgaggaaggatggtagctctcacaatcctgttaaccacactgggatagtcctcaagccggcaaccttcccatgtgtgtaccacactcaatcttcataaaactgagagagatagtctatggagagtgaattgtgagtgtgctcctcatgcaaatcatctccaaagtccaagcgaatattgaggagccgccggaattgcctccgagagatagaacactggagggtgttggacatccacttcatctcactatagtctccagccacccacactgtagcatagaactgccggatcaaatattcattgtagtcttgcttgagggtcacaatccggtcaataccaacagtcttgaagagatcctgcaagctctcaaactctggagtctcattgatgtctctccaagaaatccacttatgctttgcaaatgctttccctgcataaacctgttcatacacagtcttctggaaagcggtgtgaaaacggggatccagggtgtctcgaggcctcaagaactgatcatgatgcctcaagatggtatactgcgatggattcctcatgttcaccacaaactggatgaagggatcaatgtgcatatcatcatttccttcatcctcatcctctccacttccactgacatcatctccacttgccacctcactagccccctcaatatttgcttcaacctcttcatcactttgagcgtaatcctctccgctcgattcctcagtctcactcacgggatccggagtgggcgtacggtgaccatggcgagtgcggggaggcatcactgtcaaagaacaaaggatgataggatattagcaataattctagaaacaatttggagaggtaaaaatttgcctacatcctgtggaggggtggtcagaccgcagccagtagggtggtcagaccgaaggcatcaggccggtcagaccgcccatggtggccagtcagaccgacggctgccggccggtcagaccggcggctgacccatggtcaaaccgcttgtgtctccaggcagacctcctcccacaagtttaagcatccaaatattttcatatctacacatttgagtctaaaatttgctagaacaatatagcacaggattggaacatgaacatcaaagggttgaacctatttcatcaagattggaacaatgggaaagtaccctaaaccctagagattgaaatagaccgatttgagagcaatgcaccagagggagagagatttaccggttggaggagttgaatcacaccaagaaactaccctctattggtgcaaatcgaagaacacctcgtgcttcacctagggttccatgccatggatcaaaaactcaacaaaaatacaaaccaatccatggaatagagagtggaagcggaggagagtcacttacagtgtaaccggagagaaatccacggtcaaaccgaggggatttggtggaggaaggagttagggtttgaggggaggtgagagagagttagaaatttcgagatggggaagtgaggggatgagaaggagagaggtaggtgcgggtagaaaaagagggggaataaaaattccctgggcccacctcggccggtcagactggccctatgtggccggtcagaccaccacagctggccggtcagaccgcgcatatagcgccggtcagactgccaggcccccagctggctgtgcacagcccttgcacaagccggcaacccccacacaatgaaatttaataaaaatttgatttttggagcaaattttgaaatgtgtgagtttaaatattgtgaaccatccataatatttgaagattatgatgatttgcaacaaaactcacttaagtgctaggaggtgaccttttatggtctataggggtttttgcgccaaattggttttcaaataacttttgattgatttggtttttgaaataggtttgaataccaaaaacatttcaaaacctcctctctaccaatttttttttgaaacttttctcaaattccttctcaatctcaatttggggataaatttcattttggccagaactaagaatctagtgtcttcaaaagagggccaaaatggcattttcattcaaaaataatttttcttgcaatgtgaggcttggaaaacatatagggaaccttttgaaacattttccaagagatagttttc

SEQ ID NO: 73112 - DNA, 2956 bp, Oryza sativa
ctcaccctgagtccccggccgaaccggcaaagggaggcctgcgcggtctcccggtgaggagccccacgctccgtcacagttatttagaaagtaggtaaaattaaatagggagatgttctgattagttgagaagtggagataggtgagaaaagtgaatggttaggaaaattttttggtggagagattattatattttaggataaatcctgagtgctaaaggttgttatgtcttgagaaggagggagtacgttcttacatgaacagggcatggtgtgctcatgagaaaagatgggtaaattgtggcacgcttgacgctagcaaggaagctatgcgcagagctcgtccatctcccgcttccctcctcgacggcaatgcaacgtcggcaacagtgaacacataggatggatcaaagctgacgtcataccacctcttgttatcacaccgtcatacatccaccacatgctatgagttgattcagacgaccccgtcaactcatagcaacactgaacgacgctcatcatcgccatcagtgatgcacgaggtggtgaggatagagtttctcttgaattgcgcagcagcagccgctgcacatgagacgggtgaaatatgaggtaaggggaggacctgatttttcgacacccgtcaattgtctccaaagcattttcctaggagttgtagtaacaagtggaattggagctctgaacccttagcagcgtaccattttacaaaatggagtactccctcagtcctaaacggttgtttatttgaagttcaaatttatcctatattacctgtattttaaaagtgctagtatttgtcaaatcagtcatctccaatttaaatttctatatattttattctcacaactcttttgcttccattcaaataggggttaatatagtctttatttctcaaagcttaatttgtgctaaacagtataaaaatataagcattgtgtgacggaggatgtattttgtgcggagccgcggagtatagagccgtcaggccgtgcgtttaatcaaatcaaacctaagattagcgtactgccatcgctcgcaacgaagataacctagctactcccccatctacgcgacacgacgccgctgtctccccacgctgcacgagcagtcgttccctcgtcagataccaccaacgccaccacgcgccccgtgcgcacgctgctgctagctccagtgttcgtggtggggtccgtcccgtcgtccgatgcacgcaagggctaaacgctactgcatggctctactcctactgcacctcgacgtgctagcattgctaggatcagtagctcgtgtcctccaatatgtcttgctcgtcttggctaagctacgtccttttcacaataagttcttatttattccattttataaacaattttaaaatatttttaaataattgttaaactggagttcgtgaaagtacatgataaatatattaagagtagataaagtgaaaataaatatatttgagatctgacatagtaagaatattttaatcctttttagttttttttaatttttttagtccgtaatattagtaagaaatgaatttattttgagacctcgcagtatggcaaggcgccatgaccgtccgcccccctttttacggctgatgacctgatgtagcgtgtacagataataaactctagtactcctaccactggctactgctcatctattgctccagtacgcagctatgctagcgccgtagtgtacccagcagttactaccactccactcctaccgttgatttggtctgtgcttccgtcacactcacatggtcgtgtagtggctcagcggcattgagcagcgaaaggtgcaccgtggacggtgccggccttgaggcgccgtgcgcaggcagccgtccggaacatctgaacatacgtgtggtcgaacggtgcgcggtagaattgatttgaggtgacgcgagttgtgggttgaggagcaagcggccgaccgtcgagtttaaataaataataatttataaattttcgtgtcacgacccggcttgtcgtatctaaatatataaataaatgtatccgctaatcaaaccgacggattacgcattatttttatctataaacgggttcgcgggtaaacctacttgcacccttatatgtgggtgaaacggagaacgggcgtactccaaccccgtgccgttgatcgtgttaacttgattgatcaacggccaatcacttgattgatcaatgaccaatctgtcaacgccatatagtagtgtagtactaaaagcaaccgagtcctactccaatatcagcaatttccgtggaaaaaaaaaacttagtcctactctctccgttttaaaataagtgcagttttgtactattcatgtctcatgttttaccgttcgtcttatttgtaatttttttacgattaatatttttattattattagatgataaaacatgaataatagactaagggtgtgtttagttcacgccaaaattgaaagtttggttgaaattaaaacgatatgacggaaaagttagaagtttgtgtgtataggaaagttttgatgtgatgaaaaagttggaagtttgaagaaaaagtttggaactaaactgggcctaagcctaacttattttaattttcttataaattttttaaataagacggacagtcaaacgttggacacggattctcatggctgtacttattttaagacggagatagtattataatacttgtctctctggaatttaaaaattgtcctaaaacaattgtcacttggaaatacttattgtcacatcaaccacttccaattcaaatttctcccaatcatacccctaaaccatcatgccacatctacctatataatattttattaagggtattatagtatttttcttttaaccttagacctataatgacaaaaatattctgggacaaaggttgtaatcaattttattacgatacactagtac

SEQ ID NO: 73113 - DNA, 4126 bp, Oryza sativa
cactggcttcataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtagagattgagaggggaagcatacaaggaaagaatagaccagaactagggataagaccttaaaggaactaactctttttgttgatgtgttgtttgttttgcttattctgcaggttgattaagcaaacaacctagcatggttacatcaccacccaccgatgcaatccacgcgctacacacacaagcaaggaaacacacgacagacgaaacactagagggtggcttaggttctgcgacgggttctccaagatcttcactccttcacagctggcttcactgcttcctgcacttctgaagcggatcctccagtcttccggagcttcggcaaacaattggcgacatcttcttcttcgcaaagctggccatctagtactagttgaaatttgaagaaggaagaaaagagtaaaccttttgcaaatagcattaggggaaggagaaaaagaggaactttcgcaaatagttttatttataaaatatgtccttaggttttatccacttggcttaacctacagtcgagatggctctgataccagcttgtcgcgaccgggaaaatttcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataaaataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcacagctcgtcccaagccaaccgaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggtcggaacctccgggacaggtaggcaggattgagcccctagcagcaggacaccagccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccatagtgtccaaatgatatgagaattcccaaagtctaaagttataaaaccacctaatgttgtcctattaatcagcgaagcatctaccctaattcatactagtggaaccatgaatagagtacccactagttggggttttattttcctggggtgaacaaggtaataataacaatcacaataataaggtcataacaaaggtaaataggcatggctaaataaaacagtgatcacgtgggaatttaaataaagcggtaatgcattaatttaaattaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgacggccgggccccacatggcagccacggggcgcgcccgaaggcggcctcgccggcacagccgacgggaggcgacgcgcccgcgccccgatggtcgccggcggcgacctccggcgcgacggagcggcggccgagagaggggagggaagggggaagtgaaacggcggtcctcggctcaccccgggtcgacggcgacgacgggaacggcgaccgaagcggagagaggcggcggcgcggctcgggtcgacgaggacggtggtgctccggcggtcggcgggcggaacggaggagtggacgaggtcgacgaggacgtggcgaagccgaaggaggcgatgccgaagcgggaggaggtccggggcgacgacggcggcgaaccgaagctcggcggcgacggcggagagagaggacgacggcgcgagctcgattccggcggagagagagagcggcgagtggcggaaacggaggagggaggcacggggagtgcttaaataggggtgggagtgagagagggcggccggagaggaatgaaatcggcgcggcgatctcgggctccattgatgcgccggcgaagatttcgggagggattccaaacgaatccgagggagagagagggaaaagaggggggaaagagagagggaatcacggggagtgatttccccctctttattgcgcgcggggacggcgggaggcggcggaattcgcggcggcggcggcgctagggcacgggcgcggcggcgggagcggcgggaggaaagggatgacaggtgggccccacccgtcagcgagggtggcgggcgggcccacccgtcagcggcacgcgcgcggggaggaggccgattgggccgcgggggagaggagagagagggagggaggtgggccgagccggcccaagaggggaagggggggaaaaagaatttttagggtttttctttttataaaatcattttaactttgtttatttcttaataattattatttgtgctctgaaaattccactaaaatttgagggctctttttagaccaaggagaatttaacaaaaattctccgagccacatttgaatttttcttgtacgtattttagtgtttgccaatttcttttcgaattttaattaattcttttattccttttagcgaatgatttttaattttgggatgaatttatcaggacgtgacaaatccaccccccttacaagaatctcgtccccgagattcgaggaggctagcaagaagataggttgggcggtcttctcttcttggtggacttctttcgtcgcgtcttctataacaaacttgcctagca

SEQ ID NO: 73114 - DNA, 9218 bp, Oryza sativa
aaattctagcacaacatgtggcgtagtgcagtggtaaagcgcgccacttgtgacgtggagttcttaggttcaactctcaagcgctgcactgtttttttgaatcagacatttatcaaagaaatggctcgtggccacgtcagcatgccacgctggcacccaatatcgcaatggcacatcatgacgaaactaaaaacgtcacggatttggttcagctgcgcaattgtgacgggttcttgaatttcgtcacagaacctaggcccaattttgggcttcaagagacccatgtctggtttaggtaatccgtgacaaaaaaaaatctatcactaaaaactgtcacagatcaaccaaattcttgtagtggatggataggggccacatcccagttggttttttctttttttttttttgctgcttgtatatattatcccacccaaatccacacaaatcatccacaaaaaaattatccacaaatcatgcacaacaaaattatccgcaatacatacacatccacaatccacaaatcaatcacaaaatcatccccaaatcaacaaaaaaaaatctccaacaaaatatacaaatcattcactacaaataattcaaaaaataaaaaaaaatacatagtcgccagcagccgccgcccggccgtaggacgacggtcgccttccgcccggccgccgcctggccgtgtgccaccttgcggctagccatcgccgccggggcggccctccacgcacgatggccgccgccctccgcgctggcctccgccgctgccgcccggccgcctcccctcccgaatttggcggaagggaggccgccaccaccgcccgattgcctatcgccgccgaatgccgggaggtgcggcccgccggaggggaggagaggggtgagaggaggagagttaagaaatgagaggtgagaaggaggagaagagagaagagataaggttggggaccgcgctcgggcaatgttttttttcccgattgttaattatgactaatggactagtggagaaccagactaaaaaccggtttaaacggggattattgtgtattttgggcaacggaccaaaagatgatttctcaagcaagggcgggctgccttcctatttaaggttgaattggcgaggtgggattattctagctacagtaccgcgatggtattgagggctgctgctgctttgcgcgctctctctcgctgctctgcttgctgcactgctgcttgcatgcttggctggtttttgctattgggccggctagctactgggctgcataggctgggctgcatacctagctttgctctttttttttctctctctcttctttctctttttctttttctctaattattgcggcgcgttatagttaccaacaccatctaccgaacacacccttagtcgagttggcattgcagttggtcgagatgctcgtcgagcaggaagccgcacgtggcggtgaggttgccattgggtggagctcatccttcggtcccatttagcgcgcctcatgattcgggttctaagggatttgggtagctaatctcgtacttatgtcatcatcggtgtacggggattttcttcctttatatgtgtgtgcgctaagaggatgaggggcgagtccatagcgtggacagcaagtccgatcattgcgtgtaggaaaggatcgtgagtgtggccagcctcacagtactatggaaagtatcattggtgtcagttgagaatcccatataggggccagattttccaaccgacagcagtcagatggcactaaggactaaggaggtgcctaactagtgccggttttataaccagcaccacctatagggtgcaaccttttttcatttttacagacttgaaaaaatccaaaaaaatatttattattttactgggcatctatacacagttccactttggattaaattttggatactcgtggcacacttttcaaactgctaaacggtgcgtttcgtacgaaaactttctatatgaaagttgttctaaaatatcggattaatctattttttcaagtttggaataattaaaactcaattaatcacacattattacgacatcgttttgcgtgaaacacttaatcttcatcttcatcttcatctttaggacattcaaacaccacctttgtttccaacagctcccaagataaaatatttgctattttactagcatctatacacagccccactttgtttccaacaactcacaagatgtttgcaccattttcacaagaatatgagttgaagctagggttcaaacccgcaacctctcttcagccgaagtctgcttaccttgtcacctaaaaattattttctttaaagcaaatacttttcttttgttactactcttatccaaaacttataatccatatttaacgtcatagataagcccaaataaaatttttgttaataacaaagttataaatacaactttcctatacattttgttcacatccaagatagtttagaaattttaaaaattcacttctccaaatagatctgagaagttataacatatttttagacatccaaataacctcaaatcaaaacgtgatcaactacaaggttgtagatatcgtcaagttctacaaatttaatataagtttattttcgtatgacttcatatgaaaaaagttatatacaaaacacatatatgagtagtgtcattattggtgccgtttttattccaatttttattgagaaccggcacatgtgaaaactagatatgtcgttttagataaaaaaatcatttactattgtgccacactcataggtgccggtttattacgagaaccagaacctatatgatgtccattggtgcagctttattataagaatcggcaactgtaactattggtgccggttttttatggacctacacaaatgagtggttttgggtgtcagtttttatttatagatgtatggaaaggtgaggaaagtctcatatctatcggttttttactttatttctacgtagcagcacctatgatgctgtctcctttcagggtttcttgagtagtttcgtcgataagtgcgcattggcatggggtgggccaagctcatgtgtgtttgtctggttcagcggccagagatcaatctaacacatgtttctcctatctcctctttcaaatagataatcagttattctttgtcctaattatgttatgtagtgtgtatttcaaaggaataggggtgaatgtgtgtttatgtgtgcctacatttatactatgtttccaaatgaaattttattgtggactagaaaatccaaatacaagttttgaaatttactatctaggtttcaaactttacaatgtaaattaatgtaaccgtattccttttattttaatgagaaatattacaccacaaatataactagctagtacagtaggcgaaggcagttattggatatgacaaccaactttcgggctttattagtacttttctaatactcccactatcttaaggcatatttcatttttttaattttccaaatgagataggcatatttatcttaatattccttggttgcatacgtgcatgcatataatggatgagttaattgttccttgatcttggtaacaaaagaaaaatatgtctcagatttttaagatgaagagagtaatgcacttacctaatctaaaaaataatttagattggggaaagtccaaaacacccctgaactattgggtgagtatgaaatactccttcagacgcgaaaaacaagatatctttcatcatcaacaatcaatactggatgaacccccctccccagcagctttgcaagtggttttgatcttacgtggcagtccagtcaagaataattttattaaaaaaactgatggagcccacctgccatatctctctcctccctatctatttcccgtctcacacctgtcactctcgcgtgcgcgcatcaaatgctgaggaggagccccgcacggtggcggtggcatcggcggttgagttgtgccccaagaggaagcagcagcaattcacatcgtcgtggcacactgcgtagtagctctagttggaggcgatagccagcgcggggaatttggcagcaatgtatggggcggtgatgttcatcatgaactccacgccggcgagaggtagcatgcagcagcaggccgacctgtgcttcgggttctcgtcgacatcatccgcgctcaccgctgtctccccggtgcacatgtccaccaccgcgctgctgtagaaggcacgcggatgggcgtgacgcagagctgcctccgtcatcctgtcgtcctcggctccccctccatcgtccccacactgcctccgtcgtccctgcccaccaccaccactccgagttgcctccctcgtccccgctcgccgtcgccgtcctcggttccccctccgccatcccgcctgtcaccgccgctccaagccacctcccccgccgctgcccgctgccgccgtcctcggctccctctccgtcgtcgccgctacgagttgcctcacccgctgctgcccgccgccgccgtcctcgactatccctctgtcatccctgccaccaccgccgctccgagtcgtgtctcccgccgccaccatcctcgacaacctttctgtcggttgctcggtgtagagagagaggggggagccgagaagagaagagatatatgattgggaaagagacagagatagaaaggtgaggggaaagagatatagaggatgagactgatgggtggaacccattgatttaaaaagaagaattgctgactggactgtcacgtaggaccaaaaccactccagtttgagtcggtggggtttttcatctagtattgataattgaaggtgaaagatatatgcttttcgggtctgaggggtaatttgtacttacccaatagaggaaagagatatagaggatgagactgaggggaaagagatatagaggatgagactgatgggtggaacccatcgatttaaaaagaagaattgctgactggactatcacgtaggaccaaaaccactccggtttgagtcggtggggtttttcatctggtattgataattgaaggtgaaagatatatgcttttcgggtctgagggtgtaatttgtacttacccaatagttcagcggtgtaatgcggacttttcctttttagattaggtgaaactctacaagttgagaaacgaggaatgcaattttcttaataatctgtcgctataagtatatctaataaattcgtgatgctctagaacatttaataaaattaatttgaagtgcaataattacttctactaagcctatgatcattcggtgattttctgaaagggaaagcatttaaacccgttttctgtctgtgggtcaaatccggcccactctaacatttccctttgtccttccctgcatggtcgctctggtagtctggtttgcctaggaacaaccatggttgtctgagtagagataaatgggaattgttatttcaacaaagtttagagcaataatttttatgtcaattacaaagatataaaaaacatattatcgaagcagtacaattattaccgagaagaaataagtgaaagaagagggagccaagaaggtactactccctctttcacattgaaagtcgttctgaatttgtccggtgccaaaaaatgtataagaatacaaaaataaatggcaaaacgaaaccaaaaggataacgtgttttatgggggaacaagaccaaagaggctatataaccaatttcagtggacaatgtggttcattggtacaagttccattttgaaagcagagaaggtacttcaaaacatcacaagagctatcagctacaaacattttacttcgatccatgcatagccattacagtggctccatttcagcagcagtggtcgaatcactggcgtagacagggtggagcatgtgcccggcaacaggatcaacatgaacccattttctgccagtcagcttgttgcgctcaaaacgcacgtgtccttatttgagacagaagagagtacgatcctttcccattccaacataggccgtgtttaattgttctggcaaaaaaaaaattgatgtatacggacatacatacatttgaattattaaacgtagactaataacaaaataaattatagattccgtctgtaaacagcgagacgaatctattaagcctaattaatccatcattaacaaatgtttattgtagtaccatattatcaagtcatggcgtaattaggctaaaaagattcgtctcgcaatttacatgcaaactgtgcaattgttttttcgtccacatttaatgctctatgtatgtgtccaaatatttgatgcgacggaaaagttggaagttcgaagggaactaaacacagccatagttcccaggatggaagcgggttcctcattggcggacgatgatatttcctggctccactttctgaaatagttcatgaaaatatcagattatattccacgtctttcgcataactagcaaaatgtccgtatgctttgttatgggaaaaaaacttatataataatagggataagtccattgacacccctcaactattggtttaaattacaccccccaactctaaaaccagatatcctaacaccctccaacttttaaaaccgtgcaataagccccttaaggtggttttgtgttgacgagatgatccagatgatccacatgttagggaacacctcttacctctcttctctctcagcctcgtctcttcctcggccaccgccaccattgccagactagagcgccccagagctccaatgcctagttgagctcgtgctctgtctttcctaagctccgcgtctcgaccaccgccacctcatagagcggcggtagagaactagcgccacgaccccacctgaccctcacccccatcaccagcgaaagacaccccaccacctcacccccatcacctacaaaggactagaccaacgaccgccaagaagagcaggagaccggtgaccagaagggtgcctgcctacaatatcctccagcacaaaacggatgaagaaatcaagctcaagctcacttgctcaccaccgacctccacgccgcccacaccaatctcccccaatccaatctttctcctcctcctggctagcagtcgagctctagcttcgctacctccaccaatatcttgcctcagtagtcgctagcgccgagctcagccactaacaccacgtctttccacatcaagctcgaggatgagggactcggtctcaagcacacctcgagcctcctgaccgggcagcgacgacggaaggatgtgctctaggggcacccacctccccgtcctcataccctgagtgcctcgtcagatctaggcagtatcgaagggactccggtgagctcctctttgaggtggtcgatgcgagatccccaaccactccacttatagctctgcgaggggaggagggagtgagaacagtggatgctgagatggagaccgggacggagggagtttgccagcaacctcacctcctccattgagcttatcaagcagggagggaggggagagggagatagaggggaaggaagaagaagacaggtggaagtgagtagtgggactccttccctcttgctgacgtggatttttaaagtagaggtggcatctgacgtggcatccagttgtaccaaaaccagcctaaaattgctaactggggtaaagtatctggttttgatatttggggtgttagatacccagctttacagtttgagggtgtgttttagacaaactgaagagttaaagggtgtaaaatggacttatcacataataatatgtcattgataaaatatatttatatatgctagtattgcttgtttacttatttgaatatatagaaaatctaataaatgccattgcaagcgtcgaattccaagaaatgtcatcgacaagtacaagctccataaaatgccatcatacaagtaactttgttttagaaatgccactacactggccaaggtcacctgtgatgggcccaaaccctcatctttgacggcttcacgcatggtcagtgatcagtggtcactggtgagtccagtcacctttgacgggtggccggccgtcacaggtgacacccatctctgacgggcaagttactagaaggccgtcagaggtgttggtctcctgtagcctagggcgagttgggactcgtcacaggtgactcatctctgacggccctttaaataaaggccgtcagaggttatggtcttcgtagttagaagctgtcataggtgatctacatgtgacggccccaaaagtaaaggcccgtcacaggtaggtcacctctgacaggcctttatttgctagtccgtcacaggtgaggtttcctttgacgaatttttgttccgagccgtcactgatgagttaattccagaaaaaaaataaatgctaaatattggctagcctcaggatttgctagccatgccctctgaaacacagatacatcacagatatattttagtcaccccccaatataacatcacagatccatttcaaacatcacagatccctaacaacacagatccatataaaaattgacatcattcacatatgcagttcaaatgccacaattttgcacagcaaattcacaccccttgaaagccacaatttcggtcgttgctcatagaaccgcatatatacttaccaaatggattaaagctgtaatgtcctcgacctccacaacctgtcaataaggaataaaaaggagaaaacaattgaatagtacaacgtaaatcgtagttgatcaaatttgatgacaatttagtaaactaccataaatattgcacatatgaaagtaaattacattgcactccataaaaacatatttttttacatcacaagaaattataaaaacatcttttttacatcacaataaattatctagccaagttcatgagtctatttgacgtgaaaacgtcctttcttgttcattatttctgcaagaatgaaggcgcacactgcgcctctgataggggggggtggttgatgggtgagatcttgaagccagctctacctttctgtttaataaataagaggttaacacgttttgaatagcaatgttggtattgaaatgagcttattcgccattagcaacaacctcagggtcgaaatctttcacctctcttagaagtgttgacatgttgtggcacacgtggaaaccacattggtctcggatctgttgtgcgcatgcgaacttggtgccatgataaagctcgtcctttccct

SEQ ID NO: 73115 - DNA, 25875 bp, Oryza sativa
agggccctggtcacttcgcgggctcgacatcagccacctttcgccgtggcactatgtctacttcccggcgagggtgcaggcgatggcgccggcggcggctggccatgtcgcggcgcacgtcgccgcgtcgctgccgtcgacgacgctggagctccggacggggccgagcgccggcgagctcccgttcgacctcaacgagccgccgccggcgctgctgttcggctcgtgatctcgacacgtacgtgagtagagcatcactgggtagtactaggaccaaggatcaagcttagagatcactagtagataggggtaaccgattaatgtgggagtggagagcactggtccggctgtgtacatacgtactactatttaaggaaagtttagcgttctcacattgcccctgttcttgtttccattttaagaactttttagcgtacagcttttcatctcttctgtagtataagacggttttctcactcgaggttagtactattactgacctgagaacttgcatggtgatggtggttgtggggcgagtgagcggttggttcggaacatttggttggtcaaaagctagtactacaaaattttaattcatgtaaaatactagtactggtattataagaaagatttcagttatacatattgatcagtaaatcaaatatacttaacgctctaaactactagtgctatcaatgcaagccccgttagtgaaaattaacagtatcaatggggtttcaaaaaattaacagtatcaattgatatcaatgcagccttaatttacttaactgtttaaactctaaactagggtttgtaaaaagacattcaactcgagatgaatggcacacccggcgtcccgagctcccggcctcactgacttgaccatctgcttaaaagtcccatcacaaaatggctcgcgagtccaccctgtctcgattgtcgtttcctgtagtattactagtacacacgttcgattatgcttctgtagttatgcgcacagcttattaactactccatgtgtccttagattttaaattagatattgtaaaataacttatgataaaaaatctataaaatcaactctaaaataaagttttaaattttataattttatttataaacaaaaacataaaacaaacaatgcgtccgctacagactgtgcccaacatttgatccatttagataactatggttttaatcacctatcaacagacgtggctaatgtctccttgccaggaaaccaaagtcgaatcttaccgataataaagtgacaagttgcccgtccaacttgcttacaggggaaaattcataggccttttcatctatatgaaaaacataagaaattcaatggatctcaatactatgaaaattatatttgttttattttttccgttttctcaaatcctgcattttatataaacctgcgatgcagatatcataatcagccaattccaagggtaatctgtaaaaatatccagttcacgtgcttttctacatccaccctttggaacatctcgtattatgctttactcggagtattatgctttattcccttcattccaaattgatctacatatagttttttttgaggttattactaaatgatctacatatttatgttcatttattaagtatattcgttatttgtgtattggagtaaatagacattagcccacatataatatcttgatttgctgttggctaggaaatattagagatggtgtatgcattaaatctatggctagagtagatatagtataagagagttattagctttttttttttgtcttggtgtacctataaaatatgtagatcaatttggaataaagggagtagttctcaacctgtttgtctacacaatctttcttatcatttggtccacgtgaacgcggggtaccagatttgtaacgcaggagtacgtagtattacaaataaacgacaggccttactgaattaggttgtgttcagctggggcatgtgatcacataccttacgttaacaaatgtcctttggtctcgttcatcactatacacgcacaattctaaatcaatttgttctacaaaagcttgataccgaaggaacctcggttccatgctggcaccacgcagacaacagattacatctaactcaaacttccgtagcacaaacactaaactaccttcatgctctccgcaaagcttccgggattgatggttatactcttggtgcaattatccgtcttgtagatgccaaccagcctatcagctagttcaaacatgttgtttctgagactgcagacagggcgacaaacgtgagattggggaaatttcaccctgcctcttagcacgtataaatatttcggttttaactttagtagcattacttttgtagatgaacaactaagtctcttgtatggatgaatgtttggcaaacatatatcttcgacagatctttgctcagtatttctcataaaattattttcagctggagtataagtggggcgtggcacatgcgggtagaaaaattaggaaaactaagctgccataagcatacctgataataatgaactgagcatctttggtccggtctttcacgtaatgtccaacgatggagacattcttaaagtctgcgagcagcaatgtcattaatgtattgaagtgttaatatatgttaaacgccaagaggacggccactaaacttacccaacgcagcatctatctcatccataacatataaaggagttggtttataatggtgaagagcaaacaccagagctagtgagctaagcgtctgcaagataaaaagcttagttcagtaacaatctactaaaaaagtgatattagatgagataacacatgcacagaacataatgccaacaagaaatgtaaaactcatattactgttgaataaggaaacaaggtatggagtagaaaacaagttctcgtaacgatattgaaaaccatctttgtcagtaaaataaggccatattaactaacatccttgcacaaaaaaaataataataattgcaaaaataccttttcgccaccagataaattggcaatgtttttccagcttttcttgggaggtctaacactgaaaacaacaccttctgaaaacgggtccaaggaatcaacaagttccagctcagcatcacctccaagcgtaatcatctaaaaacaaaaaggaattgctgttgaaatcatgttgtttagtaatagaggttgagtggtaaaagtatttcagattttcagttaattgggtaagcctgctcttatctcaactaactctttaactttttttggcttcctagacttcatttcttacaaagtgtggtcagacttcaaattgtaaaacaatggaagcaccatattacatgctttgatatatgtattcattatttcaaagtacctggtacatctccttcagtttcaaagatattatgttgaatcctgccatgaactcatctaacctgaaataatgcatatttgcatgtgaggcaaatagagcaacatggatagaaattcaaagaaaggaataccttctcttcctcaatgcatcgtattgctttttaagatcatcacgctcctgagtggtggcatttagctcatcaacgcgttcaccatatacacgagcctttgtgcggtacctgatccagccaatgtaagccagtaaggaaattggtggtgccaaaatgctactgacatgtatagatcattaattcatactctgctattgaatccaggttaggactcaagtctttaagcagggcttccaacagtgccaccatctcaactgcttttctcatgtcacacgcctcattgaattgctcgtcactcaatgtttctttcagtttctcatgatcaatagcatccttttgaattctgaaaataacaagatgcacattagtctgagaaacaatacagaaaacacgtagcagtattgaaaatagcatttacacatactgatccatgtgtttaacaagatttgtctgaatgtcatcaagctttttcctgaatgccttcaccttcatttcccactccttggcaagcttttttgtatcttgcagtttgtattccacatcgacctgtacatacatacaaaatgtaaatattgtcaaaaggaacaatatcatagtgacttaacataataactaaatataaatataatatacctcactggatctcagttcatccattgctttctttaatttgttgtattctacctttgttttgtcaagctcatctttatggttgtccatcatctgcaaaaaaacagattaacattttccattgaacaaatgaaaaaacaatccaatcactttacagcttgtaaggcaatacaactaaactacctcttgtgttttcttataatcttcttgaacagtaaaagctgccttctcaatctctttgaaaatagacatcatcttctccttttcagcaagaagcttttccttttctttcctagactcctcgatgcccttggttaattttttcaccaacttctcacatgtagtaattctaactttgtggcggttgatatctgagcttgttttgtcaagttgctggcggttgacgcacaaaatcttagacatcagataaccaaaacgaagaacagaatcacacaagcattgaagcttatactcacagattggatgtttgcaacttttagcttctgatccttgagcacttgtccccctgcgttttcaattttctgctgtagttctgatgcctagtatagaaagcaaacttaagtcaaagctatgtaacaaataatttcagttaacaactcaaagcatagaaaaatcaatatacgcaggcacagattcaaacaggagactgggagagtgagttctgaatgatggagcatttgaagtaatttgtgagttgaagcagacgctcactaaggcagattagcttatgaattggcatgcgatcaaaaagcctgtatagccacatacctgatctttgagcttgctggaacatttagcaagtctatttagttcagcttgctcagcagatatgatatcatccagctcttccattctgcgaacctcgtccgctttgggatgtgatgcagctttcagagagtcaagtcgcttttcattgtaactaaattgtgcattcatactctcaacctatttcaagagatgaatggaagctgacctcaaggagaaaatagaatctcacagcagaaaaagtagtttacatacctcctttttagcttttgccagttccatctcaaaacgggatttggcatcttccagggcccggtaaccttttttagcatcattaattttttcacgtaacctgttgagttgatcgactagcttattaagatcattttcagcatttgcaacagcctcttctgaaatactttcccggatggatgtgcccatcttgccacctcttggtttgctaccaccaccactcatggtaccagacttctcaaaaagtgcaccatcaagggtaactactcgacggaattcactggctgcactatatgcaattcgagtagcctgacaaaaacgattattgatgtcactgttataaaaaataaaaatataagcagcactgcaacggtttttgtatgaaaatagaacgatatgtcctcaattaagtaattctagccttcttagaagttttccataaaaaatgctagtggggcagtagagtactttgagaaacaaatatacaaggcacatgatagaacaagcagcaaaagaagcaaataatagaacgaaaacaaacaatacaattcaggtatatacctgatcaagatcacttgcaacaatagtgttccccaaggtggcaaagaaagctaacttgagcttctcatctttaacctttactagatcaaagaggcgtggaaccccttcaggtgtttttactttctcctgtagcttacgaagatgatgtgtttgtttttcctgtaatggtaagagtaccaaatcatgccaaaagcaatgaaagcaacgaaaagatagcttctatacaaataaacatgaaaacgctatgaaaaggatccagaattttaccagtatcataaaagttgcaatgccaagatttcttctgcgtaataactcaacacaagcttgagctgaattggttgtttcaacaacaatataatcaagcccagggcatgctgtagatatggcaacatcatactttgctgcagagcacaacagctaacacaattaagtgatatgcagcacaatccagacctagagtacataaataaaacaattatgaacttctcctagttctctagtatatttactcggagaatcagtaaaatacaataatatttgcaaagcaagtttaacctccagttctttccaaagtctaacaatatcacacactgactaatgactagtatctgttaatacgatgaatttggaagtatatattcatgacataataaaaacgggcaaatgtacagaagctggaaaagtcttcaggtccaaaggaaaaaagaaggcatggttgtttaactgcacacattctagcacaaattgagactacaacaattacatcttaccatcgattgcgccaagatcacctagcctgccataaatgccttctatttcctttgattccttagcttgcaaaattgctttcaagacagtgccttgattcttttcagaatcccttgtggttttaatctcagcaactttctgcctagctgcttgttcaagaggaataagtgactcttcctgttttaggcattcctgttatgcataccgagatattggaaactcaggatcatccacagcaaatgggaatacagtgatactgctcgagggaaagaaatggcccagagaagtctgcaaatgctttacctgttcaactttacgagcctcatttgcttcactatggtgtttctctattttttcttgaagctccataatatatgtatccttcgctttgatttgctctttaatgctttccatctggttttgagcagcagttaattctgctcgggctccatcatgctgaaaacagttaataacattcaagtgagagtccacaaaaaaagttggataccaaaagaggggctttcgtatcaatggaattgagaggaaatggacacgcgcgtcgactccaaggagagtcaaacgtgggtgggcgcgcatgcatgaacgcactctagccatctgtgctaatgcacagttcctagtgagaattcacacaacttgaaatttatagatacaattagttgttttcaaaaagaggaagaaagatgagcactcttgttttcgactatactccagcaatcaagaaatatcatgccatactcaattctccatatggcagatccaggttggcgatggcaaaactgtagcgtactaggaatagaagttttctagtgagtagtgacctcatgggcagtcaagtggttcgtgtagctgaatagtactggagaaaattgacaatggcctaccacaactttttaattagaaaagaaatacaaagcaggacaaaccttctctttcattaattttttctcagcagatgcaacatctaagcttcctttatgctcaattatttgattttcccatggttcaagttcagaccttacttgagtaagtttagaacgaagtctctctgtctcttctgtaattaccaaaaaagagagaagagagagaggtttggtcataaaaaggaacagactgcactagaagaaatttataggcacatgtcttgctctaaaaatcacctcgagagttttctttaatttgctccagcaccttctcttcttcattaaatttttcttgcaatttgggtatctcttcctctagttgtggaattaaactggatgattcttcaacctcttttgttgattcatcaattttcgatgtatcctgcataaaaatgaaggtggactttgttgctttgcttgaactacatatgggatcattttaaatataccttttcagttttgtcctccagcttcttaatcttctgtttaagatgcttcaaatcctccctatattttacatcttttctctcaaactctttaaattgatccttgcaagacttcatattattttcaaggtcctaaacacatccagagaataaatatacaaacgagcattataatctggcaatgttagaaagggagtagaaaatctgtcgctaaccatcttgtggggaaaaaagctctatcctgaacatctaggaataaacagctttcgagtcacaagtaatgttccaacaacacaatacctcttgccttttagcatgtttgttgtaaacagactccatttccttcagagtttgagaactatgctgaattttttccctggattataaccaaattaattagtgataaaactcagtaccaaaatatcatgttcatccacaacaataaatgacctttcagaggcaaggttcttttccaagtctgcaacattctcttgcagctgagcaacgtgtgaggtagcatcatcagaagccaatgtggtcgccttctcttgccatttcaaaagtaagagttccttcagcataaatgtttcagcctcatttttcgcactctacaggaaaatatatcaatcagtagtgtcattcaaccagaagaatcaattcatcaccctcagaccgtcacctctaagttatctctttccttctcagccaacttcagcatctgcacagatgctgtccgtttttcattgagcatttccaatctaatatgtatcagaacatgtcagatttcattacagaatggacagaaagcactcattgtgacaacaggccttaaatcagttaaagaactcactgcttggaagcttcttcaattttctcaacatactgatttgtcccaatgatgtcttccagatattctagaaacccctcatcatgtggaccttgagattttggtttcatcagggagatttgttcaacctcaccctgaaagtgcccaacttggaagttatgcagtgcaaaaccataaaatataacaccatatggatgtctgttatatccctcatagtcatgtaaacatactaaataatatgcaacatatgtccaaaattaaacttacaaaacacgcgcatttttcatgtgtaaatggaaaaagaaacacaaacctgaaggatcaaaaagcgattattatcaaggtcaactcctttgcccttcaacagtttagttacttcagtgaaattgcttccacggtcgtttatgtagtatttagaagtgttgtcacggaaagcaactcttgtgatgataaaatcactgccctcaacagccctgtagttcccatcatcctatgatggacatagagggagggaaataaattatgtggcactagctaagcaatatgaaatgctaaatacttggctcaagaaataccaaatcaatgatttcttgaaaatggacggagaccccagcactgtctagattctggtggttagaagaattgtgtatgagttctgagaccttgttcaggcgcatctacaatgatggaaaactggtcagaaacagtctatgatttgaaacaacctaaataggttgttctgaattaagaaaatatggagtagctaacaaatagcaagatcatctctcaagagcttaagttattcgtgaattttatagcatttaatccaaaacttttaaggaaaaacctttggaggaaatgggcaatagtaaacaggaaatacaagggccccattgtattcaagtattaaatacatttctcttcaataactagtttactatcatgaaagtaccattacactaaattctcaaaaacctttgggcagagactttgaagcttacttttcgccttgcatacaaaatcagtaacacactaacaaacataaagtagcagtttgttgcccagcctttaaaaacattgggaataacttacacttacatgccaactttggcatctagcactcgctgaatggataaaaaaatacaatgactttttgagatagaataaatcaatgattagcttaaatctgccactgagctgaccagaaaaatgttgaacatcaataaacatttacagttaggaagcaatattgcccacctgttttgcacgcttcccaaacacaaacagcatcgcatcaatgacattgcttttcccgctgccatttggcccaacaacagctgagaaactctgaaagcaagaaaaagcggttattcttttatacgatgcatggatcctagcgacagagtggtagacctatgttcataagagcttgaagcatagtgcactcatcgatagtacctataaacagtttataatgatattctgcacagaacacgatggttacacacacaagaattgtgaattctgcacaggtcaccataaaaacacgattataaagttagacggcatttctggaatgtaagatgtgttactactcacaaatcatagtcatttggccacttaaattgatgcacttgaaaatcagtaaaatttaaaattatgataaacgttgctttccttatatcttaggtactacagaacaagtgaaagttaaactgcagaaacgacattctgaggataaaagagttaggtctgaaatttcaacgtatgaaagggcaaattcagatagaagccatagaactgaataaggaacctccatttctgggtagaacaaatgccattaaaccatgtgacttactcttcataataaaatatctccaaacaaaacaaagtgaacccaaaacatactactgatggagtatgaccatgccactctaaagtttcagaacaaatgtaaaaccagtgcacaactcaaaaacctccactctaatctaacattcgtgagaccaaaactagaccaacaaattcagaacctaataaacaaaacgtcacataggttcagaacctagtaacaatgcgcgtatcggtatttcacttcataaactagaggccaggcagaacggccacactgaagataacacgaattcctaaaaatgctataacacggtttttaacttatttaggattctgtaggcactgggaaatggaaaactcaaatgaaagtatacgtggtcacctcctacgctatcacaattgaagttaaattgctatatccaactgccgtgcctagggttcaacgatcgtacaggtcaagtaaaaaaagcaagcccaccacatgacattgcagctggagggtcctgaatagcgccaaaaacaaacgaaaaccggggattggtagtgggggaatacgtcatctatgactatgagcgcgacgaattaagatatactgtagctagcttgcgcgctcgtgtcgtgtgcttgcgagtgagagagagaacgagaccttgtggaaagggccgatgcgctgctcccctgcgtacgacttgaagttgcggaggaccatctcctttatgaacagccgcggcctccccgccctccctggcgagggcgcgggtgacctcggcggggaactctccatgcctgaccgcagcagcaagggaggaccggaccgcgagagccgccgccgccgccgcccgcccgccggaagatcactcgcccagcaagggcggcaccggctgaaggggggcggctcgaggacaaaggcgaccaagcggtgcgcaactcgggacgacggcgaccgcgcgcgcgcaactccgagcgacggcgaccgggcggcgcgggtgctccgggcccgacgaaggccgcggcggtggaggcgcgcagatctcgggccgtcggcggtggaggcggaggcggtggcggtggggggattttggggaaaagtcgaagcggccgagaggggaatgtgggatttgggaattttgggcgaaaatttgggagggaaaactgaaacggcgagaggattttcttcctcccgcttcgagcaaatgtgtcagaccaaaaggaagactctggagttgggctggattacgagcgatgcgctgctttcgtgtgcgaacttatatggggctcatgttgggctgatttctggtcggccttctgcttcggagaaagttcacttcaggttcctcttcttgtcatcgagttttgaaattgtccatgaattggaaaaccagatatagcacatccctaatattataaaactgaggcatattaagtcccaagccagtattgataatgattttagttgatgtggcggctgagtcagcacggaacccacatgccagtggcccaatcttcttctacctctctccgcctcttttcacatctctctcctagcctccatgaggttggtggtgggcgatggccgaacaggagaggtgcggtgagttgacggggctgcaaggagctcagtgcggaggtggcttgatgcgtcggcgagctccctaccactgacaccacaacgccttgtgatttcacgcggctatgatccttgcaccgctgccaccacaattcacctttggagacacatcctttctctactactacggtgggtgtcccctctccctctcgtcgaaatttttcggcccttctccctccatcgtctcccctcaccactgcgcgcgtctcactcaaaccattcgccgtcaaggagtacctcgtcgacacctgcggcctcacccgagcccaggtatgcaagacttcagagaagttatcccacctcactaccagggaagcaccattgtagctggagacagcagccctacctcaaatggctcttccggcttggggtgtgacattgcagcaggaaagtggctcaaggtcgacgtcgcccgagtcatcgtcgtcgcagaactagagcgacatcgagatgagagatagtgggtgcggaggtagagacaagtgctgtggcagtgggcacggaggcggaggctggcccggacgtgggcactgcggtgatggaatcacattaggagcggagggaagagagggacggtgattattttttttatgacatgtgggttcaacactgactcagtcgccacgtcagcaaaccgctctaaatattgtcttgagacaatgagacccattgtaacccggttttaaaatattagggatacattataattggtattccagtttatgggcgattttgaaacctaacggtaagatgagtgaccaagtgaactttttccttctctttttggttgagatgcgcatgggctgttcggcccaggcagacagataatacatagaatggctttaataacgtctttacaagctagtaatacatagaatggtcctacaatatcaaaagtgtaaacaccaacactgtttggaactttggatgatctgaatcatttatctcacaatcacccagccatcaggatggatttgtcatgggggtggaggggcttgaagcccagactactgatgttgggagtatgggagccccctctaattttttttttcactctgtaagaaaacgtgataaagttttgtctaaggtggtgtttgaaactcatgtagatgaagataaagattaagtgtttttatgtaaaacaatgtgttaatagcgtataattaattgagttttaattactacaaacttgaaagataaagtatctatctagaagtaatatttagttttcgcacaaaacgtaacgtttagcagtttaaaaagcgtgccataaatatcaaattttttatccaacttttgttagagaaactaacggggtctaatttgttcaatttcgcctactgcttcttcctaaatccgcccccgcaacctcggaaacatccatgatcttgcaaattttcaaccaaaagaatattaaaaaaagcatgcagtttcttgaacaaacttcagaaaatctttttcgaaaagctacggcactcccaaacagaatattgacacaaggagaccaaaaacaaaacgaggcagcaggtcaatgcatccggcattccagctcgcagcaaggagtagtgtgtaccataatgacacccacttctacttgattaaagccctcatcctatctttaagcctgcgcatgatccacacaaatgcatacttatcctaaactaatcagcttaggaccatgtatatcattttagactgcagcaagaaatagttggcaagacactgtttgaaaaatccggtgtagtgcaaaatttgcgggtttgtcaatgagtttccttcgaataccgtggatagcaatgcactgagaaaatcacatcactttcagaaatctcactgcgttctcttgcgcattgattaaccctacacaaaagatacatgtaacttcgctggattttgaactgggtttagacctatgtgacgtactaacatcggacaaacagaatgtcactcaaatttcaacggaatttgccacagtaatctcaaaattattcttctagatggctcatatatatcaccatagagcttatgtttcgctgggttatgctggccactttctagacgaacattatgtaacgcaaagtaaaataaaccgtggacagtttgccttacaaatagaaagcaaaggcacatagagtcctggtccactataaaaccggtcgctaaaccaagtccacttctgttatcccaagcaaagccctcgcttcgattccttcttctgtcaagctcaccgttcgagcagcttagtaacacccaccatggcttctcccccggaggacgcgccagctattccttcaaatccatcggtgcctcaggaggtaggtaaccagctaccgcggcggtcgccgccgccgccgccgcggcttgagacggcggcggacgagatcggcggtgtcaggtgcggggtgctgtgctttcacctgccgagacgctccaagaagaagaagaagaagaagccgccaccgcccgtcatgcagctcgcgggcggcgcggccggcatcaagagcgtgcagctggagaccacggcgacggacgacgacgacgcgtcgtcggcgtcgccaccaccccagcgcgtcaccttcctggcgtcggcgtcgctctccacgtggtggccggcgtcgcctcccgctgccgccgcggccggcgggaggggggcgtcgtcgtcgtctttctcgcactggcgccggtcgctgtcgtcgtcccggcgccgggtcacgccgcacggcgccgccgcggcggcgccgtccgcgcccacgtcgttctccttcccttcgtcgccggcgtccgcgtcgacctcctgcacgagcacgccgaagctggtccacgggtgtcacgtcgactagctagctattgttcgatatctctacatctcgtgtactgcatgtccatgtatcatgtatacgtagttccagttccaatattgttcttgctttcttaatttctttgtactacgaaaaacagtactgatcattgtcagtgatcaactgatcatagtagttggcatcacatcaggatcgatcgtgtgggttactcttttgctgagatgtggtaaactactaattaaacaattcgtgcactttgcttttttttatatatatatatatatataaagaaaatctgacctggatgcacgtacgaattgaaggtcggatgaatccatcgacgtgatctagcactacggcctgcacggctacacagttacaataatatataggatgaaccagtcaatcgaatgaagagtccagcgtccagcccagctctagtgataaattaggactttcttttctcgacaaggattttctatatctatatgacatgatatccatcatttgcatacgacttaaatagttatagaaaaaaattaaaaaaaatagtaacatcgtttgtgatgatatatacaagtctatacacaaacatgcgggactaaatttgatctacaattggagaaacaaaaatagtaaaatcaaacggtgaatagtacccgtacagataaaatttgttatttttgttttttcatacccagcaatggcgttagtacaggtcgtcgccactgcaagctgcttccccatgcgccagaatgcatgaacgcgtggactatacaagttgacccggtgaaagacgatggcggcgccgacgcagcccttgtcctccggtggcgaaaagagggtcgcggcgaccatgacgatgtccgtgtcgaaggctggtctccccgtgaagtcccagcgggcgatgtcgggtaggtagaaccgctgctcggtgcggaggctgaggagcgcgtggcgcttgatctggccgaatgcgaggaagagccagccgccgccgtacgtgccgaagtagcgcgcggcgcgcgcgtcgtccgggatgccgaagcggtgtccgcggcagccggcaatggggcacgagaaggaaggcccgtctgcgccgcgcgggacgaggatccacgggagcgggcgctccagcgggtgctgctcctccttacggcggctcgaaattagacttgcatatttgtatagtgtcttatattattatggtctatcttattaaattttataaaatttttatataactatttaaattacatgcatacacctaggtgtggcacctaagtgtagaaaatactttcgatcgcgtccctgctcaaatccgacggcagcgaactctggccgaaggccttgccagcaaaagatggatccaggacattcggggcgcgctggggatacaggctatcctggaatatcttcaactttggtcgcgtttgcaatcattccagctcgaggattgcctggatcgttttatttggaagtgggagagctcaggtcactactcctccatttcagcttataatgctctcttctttggtcggatcccctttcagtcgaaacctatctgaaggtctctaccaccccccctcgatgtcgttatttcctctggttggtcgccctgaggcgctgctagacgacagacagactgcacaccaaagatcttccacatccggatctctgtgttctctgcgagcaaagcgaagagagcatcgaccaatcaatttctgggtccgttacgcgcggcagtttttcggacttcaatttaaattcactcatgaccgttgagcttcacctggcgttatcgatcactccttgtctctcggtcctcacaccgagaacgatgacaacctcgacatcagaagtcgcgatcggtttcgcgagttcatttaagcagaagtcgggggctactgtcagggttacgggtaaggtataccctctacccttcgatatacgtcacatatcgatatggtatacttgcgcgtatacggacattttcggcatacgttaaggaaattcattatggagttcacagatggaaggagtcctactcggatataactgggtcgtcattgtatcgtaccgggtccgatgtctccgagtcctacttggagaccagttgacctgcggtataaaagggacccccgggaggacctaaggcatcgaatcttaccgccaacacatccaccacagcctacgaagccggagcctacaggagccaagtcgccgggtgatctaatcgaatcaactcgactacgatctcgtcggtatcgtcgagttccactatttcctttgtaatctgtggtttccatcatataatcccatatcaactggattagggctattacctgtcaaggggcctgaaccagtataatctttgttttctgcctactagatgtcgtattacgtagattctcgtaccggcgtaccccaataccctctatatccgatctacgggtatcccccgtcgacagtggcgtgccaggtagggggacttggtgctcaaggttctactactatgacatccagcttcgtcgacaacaacgtcaacaccaacctcaaccaaggagttcctacttcaacaatgctggtaaggactcaagtcggcgaaatcgtcttcccggtttacaccacggtgccgatctcagctggtccatcaatggccggaaacgagaacgcagtggctacaactcagggcgattccatgttgaaggatcctcccgccgaagcggagatcagaacgtcgacgacatccgagcccgagaaggatcctagtgcggccaagccttgtctttccgacaagaatcacgagccgacgaggatgaattccgaggtgacaaggtcctggtgtcctatccacaaaaccagaaaacacaccttgcaagcatgctgggtttttctcaacgtccacgctaaaattcgtgcctgcaaagagcgtggaattcagcgtacttctccaactcgtgatgtctattgtcctattcacaagacaaagaatcacgacctctcaagctgcaaggtctttctcagcgccatgaagacgccacctcctaaggtccagcagtcacgtgtccccctcagggatgaggacaaggaacaaggagcgacactgatttcagatcgatttgttggggtaatcgacatcgatccccacgaaccatcagtcttgcacctgctcgaagattatggctcatcgtcaacgagtacgccgtgcgaggtattggctatcgacgagactggcacgtcagcgcacgctaatgcggaagcggagaatcaagtgactacaccggcccagcacccctacgatcccgttctgaacgacgatctcgcacgatggacagaacggttacgggaatcagtgaccaacctcagcaacgcgttcgaagaggccgctgctgcagtgcacccggaacagccaccaactggcgatgctaatggtgagaaccctgaacagtgggaatcgcctcatcgagccacccctccacctcgcggcaccagcgatctccgcgatcacctgaatggccgccgagaggcgtgacgcacacgagacaacgagaaccgctcccgacatcacgtctcttaacggcgtcacgacaacgaagaacgaggaggctgttcgagcgaagaccgagaccgtgttaaccgccacaaccgccacaatcacgacgattgcgaacggcgggtactgggcgatactggtcaaggacgtcgccataatgacgacgatgatggagatcggcgccgagacaacaacgggagacgacgacaggatcctcgagaacccggccaacgtcctcgtaatcatacgctggaaccaagcgacccatcgtcatcgtcatcctcctcctcatcctcatcatcagatagacatccacgaaggacgtacgattgccgacagcccactgcccctagcgctgggtgtagagctttcggtcgttcacttcgagatgtccgatggcctgaaagattccgaccaggagcaatagagaaatacgatgggagtaccgacccagaagaattccttcaggtttactccacggtactctacgctgccggagcggatgacaacgcgttggcaaattacttgccaaccacattgaaaggctctgcgcgttcatggctgatgcatctcccccctactcgatttcttccaaggaacttacaagcgccacgcgatcgaagacgacctacatgcgttaacgcagaacccggatgaatcctagagggattatgttcggctccttaatgagtgtaggaatacaatccccgagatcaccgacgcttctgtaatccgcgccttcaagtccggtgtcagagatcgctatactacccaggagctggcaacgaggcgcatcacgactactcggagattattcgaaattgtcgatcgatgcgctcacgcggacgacgcactaagacgcaagaacaacaaaccgaagaccggaggggagaagaaaccagtcaaggacgcacctgagtcaagcaagaagaaaaatcgcaagagtgggaaaaggaaagctcaagcggatgttctcgcaacagaatacgcagaccctcccaagtgcccagactcacaaggcagcgacacgaagaaaacatggtgccttatacacaagtcagacaaacactctctagaagattgccttgtcttcaaaaaatcgctcgcaaaacacatgacattggaaaaaggcaagcgagtacgtgtggtcgagaaggacgctgaggcggttactcaggaatcggactcagcatacccagactccgatctccatgtctcgcacatcttcggaggttccacggcatacttctcaaagcgagaatacaagaaggtggaacatgaagtctgttcgacgtagcagggggctgcgcccaagatgaagtggtctgagcagaagatataattctcagaagaggaccaccccaaaactgctgtcatcccagggcgatatccgatcgtggtcgaactcactattcagaatatcaaggtcgcatgagttctgatcaacggcggtagctcaatcaaccttctcttcgccagcaccttggacgcgatggggatcccacgaagcgagttgacacccaccgatcaacccttccatggaatcactcctcagtcatcgtccaaaccattgggcaaaattacattgcctgtgactttcggccaagcaaataacttccgaacagagcagatcacctttgatgtcgctgaattcgatacagcatacaatgccatcattgggagaactgcactcgcgaagttcatggccgcatctcactacgcgtatcaagtgctcaagatgccgggaccgaagggaacaatcagtattcaagggaacgctaagctagcagtgcaatgcgacaagcggagcctcgacatggtcgagcacacgcccagcccacccgacacagctgagccacccaagaaagtgagcagaacaaacaaaacgccgaaaccggacggcgcaatcaagatcgttccactctctagtgccaaccccgacaagaccgtcaagatcggggcatcactaggcgagaaataggaactcgcgctcatcaccttcctccgcgacaatgctgacgtgttcacttggcagccgtccgacatgccgggggtacccagggaggtgattgagcacaaactcatggtgcgacccgatgccaagctagtaaagcaaaaactgcggagatttgcaccagatcgaaaacaagcaatacgagaagaactcgacaagcttctcaaagctggtttcatcggagaggtactccatccagagtggctaaccaacccagtcatggtacggaaggccaacggaaaatggagaatgtgtgtcgatttcaccgacctcaacaaggcgtgtcccaaggatcacttccctcttcctcgaatagaccaactggtggactcaacagccggttgtgagttgttgagctttctcgacgcttactccggctaccaccaaattagcatggcgaaagaggacgaggagaagaaaacattcatcacgccgttcggactaataactgctggaaacactttccagcgcacggtccaaggtgcacttagcgaccaactcgaaaacaatgttgaggcctacgtcgatgacattgttgtcaagaccaagacaagcgactcattgattgacgatctgcgggaaacgtttgacaacctccgacgatatcacctcatgctcaatccagagaagtgcacgttcggagtaccatcgggcaagctgctcggtttcctcgtctctggtagaggaagagaagcaaatcccgagaagatgaaggcaatcgagaacatgaagtcgcctacaagactctaggaagtacagaagttaaccggatgcatggcggcactaagcaggttcgtcactaggataggagagcgaggacaacctttcttcgctctgctaaagaagcaagacaaatttgtatggacacaggaagccaaagaggcattcattgcactcaagcgctacctatcaaatccccctgtacttgttgccccccaacctaatgaagaattatttctctatattgccgccacgccatattccgttagcactatcattgttgtcgagagagagaaggtacaacgaccagtctactatgtcagcgaagctctgcacgacgcaaagacaagatatctacatatccaaaaactgctctacgcggtaatcatgacatcaagaaagctacgccactactttcaagcccacaaggtcatagttgtatcctccttccctctcggtgaagtagtgagaaacaaagacgttgtcgaccgcattgcgaaatgggtagtcgagctaagccagtttgatgtctgctttgtgccacgaacaaccatcaaatcccaggtacttgccgacttcgtagctgattgaactatgcctgataataggtcagacaaccaaatcgacaacgaaacgtggacaatgacgttcaacggtgcactcaacagccaaggagcaggggcaagattcatcttgacatcacctttgggagatcaattcaagcatgcaattcacctcaacttcagggcgactaataacacagccgagtacgaaggactactcaccgggataagagctgcagctgcactcggagtcaggcgactgatcgtgaaaggggattccgaactagtcgcgaaccaggtgcataaagattacaagtgttctagccccgagttatccaagtatctcgcagaagtcaggaagctggaaaaaaggttcgatgggattgaggtccgacatgtatatcgcaaggacaacatcgaaccaaatgatctagcacggcatgcatccagacgagagccactcgaacctggcacctttctggacgtcctgacaaggccatcagtgaaagacgcaggcggcgaagatagcccggtctccctcaacaacagctcgggggctacagaggcagagcgcgccgttgccgatatcgagaccacagacgactggcgcaccccactcatcaaattcataggcagcgaagagttgcccgaggacgacgcagaagccgagaaaatatcccgtaaagcaaaagtctactatatgatcggcaatgatctatacaagaaggcaccaaacggggtactcctaaaatgcgtcttgtccgacgacggcagacatctcctcctcgacatacataaagggatctgtgggtcacatgccgccggtcggacattagtcggaaaagcttttcgataagggttcttctggccaaccgccctcaaagacgcctgcgacatggttcagcggtgtgaagcctgtcaatttcacagtaaacacacaaagctaccagcgcaagcactccagactatccctctcacttggctgttctcgtgctgggggctaaatatactcgggccattcccacgaggacagggcggctacaggttcctattcgtggcgatcgacaaattcactaagtggatcgaagcgacacccacgggggaaatcaaggccgacaacgccatcaaattcatcaaagggatattctgcagattcggattgccccaccgtatcataacggacaatggctcccagttcatcagtgccgatttccatgattactgcattaggttgggagtcaagatttgcttcgcctcggtttctcaccctcagagcaatggacaagtcgagagggcaacggcatagtactacaaggaatcaagactcgcatctacgacatgctcatgtcacatgacaagaagtgggtcgaagaacttccatcagtactatgggccgtgcgtaccacaccaacaacgtccaacaaggagacacccttcttcctcatgtacggctcagaggccatgctcgccaccgagctacaacatcaaagtacacgagtacagaagtattctgatgaggatcaggaggagcaacaaaacgatgatgtgaatctactcgaggaacatcgcgaacgagttgccgttcgagcagctagctaccaacaggcccttcgctgttaccacgagaagcgcatccgagcacgcacgttttcaatcggcgactacgtcctccgacgggttcaaagccaagcagggtgaaacaagctctcacctaaatgggaaggaccgtacacgatcacacaagttctgcggccaggcgcattcaaaattacagacggcgatggtcgcgagttggcaaattcctggaacattgatcaattacgtaaattctatgtataagtcaatagtatccatacttgtaagacatcttacagcttcaataaagcctattttcaggcccagaccacaatcaaagtgttccttcccgatgatcccttacccatatgacacctactgttaaaacctatcctcatgtccctttacgccgtcttgacaaggcctccaaggaacctaacggaacttcggctggggatgcccaaagccgataaggccttgtcggatcctgtagagacgaaagaccatgtaagatctggtcgtgtaagagttctcgccgtgcgtattaaccaagccgtgtaatcggaaataaactttccaacttcacggctgggggctaggatcagtgcttgttcaaccgaggcaggtcaaaagtccaagagccttatcttccgagaagaattctccgatgacaaggctgggggctagggagagtgtataactcaaacgactgatcgaagtcgcgaagtgagaagacactcatacacgctacatccagagtaagaaagcttagttagatatatttcttttctatttcacaagtacttcttacaattccatcaaaatccaaaattatattacacttttttcctaagacatttatcacaggatacggagactaccaggaaggccaacgatagtccatcgactggaagaccttctccgccagcggcgccatcgacttcgccaggccatctatctccgtaggagttctccgagaacgagaaaacccttcgcggaggaactcgaggtgcagctgcggacgatgttctcgtatgcaagccaacacatgccccctggcatatcggcttgatcgacgacactcctacttcaaggcctcgtcgatacgttcaccgatgccttcgagctgggcgtaggccctattcagccacgagatgtattcggccgccgattccttgggatccccacggggtactcggagctctctacagactcttgacatggacgtgcagcaactcttcagatacgagttgaaccacacctcacgacctcagagtgtctctacggcctggtccttcttcacttccagtatagtcctctcaagttccgcgacctcaaacttcatcctccaatactggatgcgatgatcctggtcagtaagcgcactctcgaggtctgctcagcatggaaacgattaagtcaagctgctcttctctcccgagaatacaacaaatcaattcgatccagacggaagagtaaaggaaatgataacaaagacaaccaaccaaagggagtcgttgccatgctcgtttccacaggcgaactttgatctacattgccccccggcacatgtggctcgaacgcaagtgccggaacgatcactggcaactcaggctgtccgcgttgctagacatcctcgacatcaacatctctacaaacgacaacaaattaatcaagatcacaatgctaaagaaagctaaggtgatgaccgcacacacaaacgcagttggaaccaataagagttttacaaagcatgactaaagagtacaagagagctaaaatactactcttcaaaaagtgggaggacggactcccccagattgccgacctccatcacatccttgcgcgcatcgctagccgcccccctgatctaagatcttccgcaggtcgagttcaggatgcgccagcctcacacacgcaaggacatggcatgccctggtatagatcccgttggacgtctcctttccgatcctggccgcgtgcttggaggggatcgcctccatcgccgtcgccagttccgcaatcgaagacgtcagcgagaactcatcgggattcgccgggatggtggccttgacgccgcactccccggtgagctggtgcagaccggtgtaggtgacccgtagtgagccacgaatctccgacaagtgttctcaagctccgacatatgatgctcgagcccttgccgttgtcgctcattgccagccacaagctcccgcatcttctggatgtcctcgcgaacctccgccagatcacgtgtcagccggtcggcgcgctcattcgccgacgacgccgccgccgctgtcggtgacatggggtcgggggtatcgtggctagaggcttgggtagccgcggtcattcaagcgggctgaccccctcgggggggtcgggcccgaggg

SEQ ID NO: 73116 - DNA, 3195 bp, Oryza sativa
caaaaattctccgggccacatttgaatttttcttgtacgtattttagtgtttcccaatttcttttcgaattttaattaattcttttattccttttagcgaatgatttttaattttgggatgaatttatcaggacgtgacactcgacaacaatagacttatcatgcaaaaagaacacccaagtatagcgagaataatcatcaataatcacaagacaatgactatttccaccaatgctgctataggttgttgggccaaacaaatccatatgcaagagctccaatggtctagatgtggacatgatacttttagtagcatgagaacatgcaacttccttgccggcttgacaagcactacaaagcttatctttctcaaacttcacatctttcaagcccacaactagatcacgttttgaaagtttgctcaattgattcatgccaacatgggctagcctcctatgccaaagccaacccaatgaagtttttgcaattaaacaagttgtcaaatttgcttcgctagaattgaaatcaaccaaataaagatttccatatctagaaacaaaaacttcttgtgggaagaaagcacatgacaagccaagatcacaaatttgagtaaccgaaagcaaattgatatttagagatttagcaagagagacattatcaattgccaaatcattggagatagcaattttacctaacccaattagttttcttttgctattgtctccaaatgtcactttctcttattctttcccttctacttcaaatgtggtgaacatagccctatcaccggtcatgcgttgagtgcatccactatcaagcacccaatgactccaaccggtgcggtagttcacctacaaaagaagatcaaggtcttttaggtacccaaacttgtttgggtccttggaggttagagatcaaaactttgggcaaccaaatggcattctttttaccactgagtataggggaacccacatatctagcaacaatgctaccatcatgagccttcctaagcatataatgagaatcaaacatgcatgtcatagaaggcttaccaccggggcaatcattcaccaaatgcccaacctcacggcacttggagcaatacttaccattgctcttgacaaaacgagtggcacagtgagaaggtttcttacccttctttgaaatgaatccaagtccctccttgttaaggatgcaccgttgctcactcaaaatcttgtcaagagtgttcttatccttgaagcacctctccaaactcttgttgagcttggccacttgctccttacgctcattgttctcaacaacaagtgaggcatcacaaatagaaacacaagagctagagctagagctaggcatatccacatgtcacgaccggaaataacccaacgggcgttccttacgtgcgtgcattattccttgtcccaggaggcaaggtacaccaaaagttgatacaactcagagtttaacaagctgaagcgtaattaattaatttattacataggcggcgaaggcccagcacacacaaagacaaatgggaaacagcggaaggctagggcgacgaccacaggcgcttgacggcaggcacgagctagacaccaaagccttcatcttccaggaattcctcttctgagtttgggaaaaattgagcaagactgagtacaaccaccgtactcaacaagacacacccataagtgcagaataaatgcaagggagtacaaggggggttgtaatataaagggttagggtttgcagtaaacagcattaaaagacacttagttgctcaaagctattttgtaaatacgatcctagagctatacaagattattaaacaaggccgtgaagccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattactcggcttgcccataaccgagggcacggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagtccctagcagcaggacaccggccctgtgccatgacatctcgactaccgggtcgcggctcgtgtagccttcatttgtcctagagatgtccatcgacccccgacttcgtccatctccatctgtgtacttttgtttataaccagactgagccacaaactaagccttacccactagacatgtgcaagtacggtagtgctttgcaacaaaggcccgaagaccggtccttatatggccgaggtgctactatcaaaaccatgcaccccgagcccagcctaaaaccattttgaggattttgaatagagggggaggtgtgaatccaattccacaataatccaaccattccatagtatccaggtgatatgaatatcccaaagtctagagttgtaaaaccacctaatgttacctaattaagcggcgaagcatctacctaaattcatactagtggtaccatgagcagagtgtccactagttggggttttgtttaatctagggtgaacaaggtaataataacaataacaataataataaggtcataacaaaggtaaataggcatggctaaataaaacagagataacgtgggaatctaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactctatataacaagcaggaacaaagcacaaaaatgggttcttgacttcttaaggaaaaattagagacttgaacggtccaattctgagtttaaatggccaagttatggccatttgaagtttatatgctctttaaatgaatatttgcgaatttcttcatttaaaatttaatttaaaaagagtttattgc

SEQ ID NO: 73117 - DNA, 8150 bp, Oryza sativa
ttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaaaggagtacaaaggagttacactataaagggttagggttgcagtaaacagcatttaaagacattagttgctcagagctattttgcaaacacgattctagtactatacaatattatttatcaaggccgtgaacccacacgaaccaaccttaacccaaggcctacgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccacagtgtccaggtgatatgaatattcccaaagtctagagttgttaaaccgcctaatgttacctaattaaaagcgaagcatctacctaaaatcatactagtgataccatgagtagagtgtccactagttggggttttgtttattctagggtgaacaaggaaataataacaataacaataataataaggtcataacaaaggtaaataggcatggctaaataaaacaatgataacgcgggaatttaaataaagcgataatgcaataagttaaatcaacataattttacaaactgggattcaatatgttcaaagatgatgtgacttgccttgctcgctttcccaaacgtcggcttcaacttccacgaagagcgggtcttccgaagctgcagcgtctacacgaccaacggaaaagaaacggcttttactctactaaactccatataacaagcagaaacaaagcacaaaaatgggttcttgacttcttaaggaaaaattagagacttgaacggtccaattccgagttcaaatggccaagttatggccatttgaagtctatatgctctttaaatggatatttacgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggctgggccccacatggcagccgcggggcgcgcccgaaggcggcctcgccggcacagccgacgggaggcgacgcacccgcgccccgatggtcaccgccggcgaccaccggcgcggcggagcggcgcccgagagaggggagggaagggggaagtgaaacggcggtccacggctcaccccgggtcgatggcgacgacgggaacggcgaccggagcggaggaaggcggcggcgcggttcgggtcgatgaggacggcggcgttccggcggtcggcgggcgaaacggaggggtggacgaggtcggcgaggttgggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacgggggagggaggcacggggagcgtttatatagggttgggagggggagagaacggccggatgagggggaatcggccgcggaagatccggccgccattgatgcgccggcgaagttagggggaaactttccgaacgaatccgagggagagagagagggaaaagtggggggaaagagggagggaatcacggggagtaatttccccctctttattgcgcgcggggacggcgggattcgcggcggcggcggcgctagggcacgggcgaggcggcgggagcggcgggaggaaggggatgacgggtgggccccacccgtcagcgagggtggcgggcgggcccgcccgtcagcggcacgcgtgcgcggggagggggccggatgggccgcgggggagaggagagagagggagggaggtgggccgagccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacaacgactcttgatccaacacaaccttaaaacatttatgtattagaactaatttaattaggagatattgtccaattatatcacaagtatagaaggtatgcacttacaaggagtagcattttagaagaccagtgtccaacttccggatcctaaaaaggtcgaagaggtcatcaaagcctatagttatataggcaggcgacgataggaacggctagtggtcgtgatgtccaactatcgatgattccctcattttccgcttggcattgcttagcttcatgtattgcttatgtagctctcggcaagcaatacccatcacggctaacacattgtcctccaccaatggcatgcctagctcaaattgggctggtgccctcacgaccttccccgctttgttcagcatcgacgtcgcagccttgcccctttttggctccggcgccaactccctgaccttccccttgctgcgttcacgcttctggcccttgacaagtggtggggagctatcggcctttcttgtggtctttattggagccaagctttgagctatatctgccaagtccatatcagctccaccaggagaatgaggtagtgacaatgccgatccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcattgggggcacaggcagcggatagcctgaccaggtgtcctttactgtatcgatggacaccttggcatacctagctagcaggtctgcgccatggaccttgtctgcaaccgagggcttgaaagccatgccctcagcgattttgggagcgaaagttgggtggaccctcgccagtaggacacactgtgctacgccctgcatatgtgaaagtttgaatttaatattggaacgtgtaaaggtttttttattagatacggatcggataacatcaattacctctatgtggtccactgcacctctgtggatgcacaattactcctatgctatgacggactcacgtcgtgttgtgcacgaggagttggatgcacagtaggtgttgtgcctcggggtatattcatgtcggcgaggaccttattaaccctttcttccaccctagcgttcgtgctagcttctagttcttgaatgacctcaaccttaagttcagccttcaaacgagcgttcctctcttccttggagactttccgtttcctgtattgggagctgtactgcgggagtccatgcttccagggcacatcgctaccaattcccctagttcggccaggatgttctttggttccgagcacctttgtgaggatgtcatcttcgcgcctcttcggcgcggactcaacctcgctttgtgaagcttgttcagcaaccaagcctaactagaaaaaaaagagtcatttatacgaacttctactttatacgaacggaaattagttaggttaagtagtgaactcaccagttcctgatagacgacagcatcacttttgttctcaaatgtgacagagccgtccgggttgaccttaccccttgcccgtgcccagttgcgagctctttgttcagggatgtctgaaaacggggcagggacatttgctgctgcagcggctacatcttcttgggcccatattgcctccttgccgatgtactctgcggtgcccagccgatgcgggtgctcattccgctgttgcagtaggcgatgtgcctcgcttgattccctagactcttgggtgttcttgagagagcagaattcctcccacaccacttcggttatttgagggtattcatcaaacggcgtatgattgccgggcgggttgacaatctcggtgaagagcttcaacttccaattcttccaagctttgcccatcttctggaatgccttccgcttgagcctatcctttgcttcagccgggaatgtgaaccatttctccattgccgtccaagctcgctctttctcggcttctgtgaccttgccgatatctttatggaggatcccgaagttctcacgtgccgccagcccgcagcagttagaccatcttccaatgacagtcctgggcgctgtgggcctaccactagcgtcaacctctcttataacttgcactgtggttggccatatattttgtgaccggggatttctacttgacctacttgcacttgtcccgcccgacatcgacatatgttgttcctgcggcaattctgcagcacaaacagaaggcaacatatgctaaggggtgctagctaaaatttatgtggtcatgtggtgaaaatttatcctataaattaccatgaatttcgggttgttcgaccgccgttgtcgagggatgaccttcggcaactgtctccgtggctgggtttacttcttcctggatcctcgcaggtgttggggagggcgggttttcactgggcgttgtcatggtctaattttcgcgaaaaagcttataaatttcctaccattatactaaatagcattagatccaatgtaatacggggtatactatgaaacatatggcctcagttttgctcagaaattatgcatcaattaccatcatttccatgaagggaaaaaaagaggaaattagctactaggagggaaaccaacccaaagtaaagcgtaaaaaagaaccaagtgtagatagtctcctcttatcaatccaaaaaaaaagaacaagtgaacatgaaaaaaagaacaagtgtagataatatgttcttatgcattaaaaagaacacacattctataacagcagcagcagcagcaacatcaattcattttatgacaatcatcaaaattcatcaaaatcaggcaatcaggggcaattcttatgcataaaaaaagaacaagtgtagataatctgttcttatgcagaaaaaaagaacaagtgtagataatctgttcttatgcattaaaaaaagaacaagtgtagataatctatgcacaaaaaaaaatgaataaggggcacaggggcaataggggtagcagcagcaacaacaattcatcaaaaaagaacaagtgtacataaaaaaaagtgtagaaaatctgttcttatgcattaaaaaaagatcaagtttagaggtatttctgttcttgagcattcatcactttgagcattcatcactggccatttaacataaggcaaccataggcagcagcacacaattaatttatcaagcaggggcaagtgtagataataaaacagcccacaataatttatgtggcagcagcagcaagggtatataaatcatgtatataaacaacaattcatgcaactcacctattcatagacagcaagggtatataaatcatgtatataaacaaaaattcatgcaattcacctattcatagatagcaagggtatataaatcaacaagtgtagataatctgttcttatccataaagaaaagaacatccactgcagcaaaattcatgctaagatcctctaataccaatagaataatttctctaatactgcattcatccaaaatctagcccctacattcatccaaaacatccacagacaacaaatcacatttaattcatctatacagcagcaccaacaatcgaaataacaaatcacatttcattcatctaaacaatgcaattcatccatcgaaaaaaggaggaatgggggagggtggcggcgtacttggagaagcggcgtacttggagaaggcggcgcaggccgtagtcgtcctagatcccggtggcggcgaacacgagggcggggaggcagcggcgaagaggtcgaggtggtcggcggtgcaggccggtgtcatcaatccaggcgttggcgaggtcgggaaagccgatggcggcggagagggtggcggtgtagaggtcgaggtggcagtggtggtggcgatggcgacagaaagggcggcggtggtcggggatcccagcgtcgtggatcccggtgtcggggaggtcggggtcggggaggtcggggaagtcgatggacggacggcggagaggacgagcgtccgtgagggcggcggtggagaggtcaaggcggcggtggagagggcggcggagagggcggagatggcggcggagagggtggcggagatggcggcggagagggcgacagggagtcgaggcggcgacggtggagatggcggcggagaggacggtggcggtcgagagagtgagtgagtgagagtgggtgccagatctggatcgatctataagaggtccaaccctaggtcaaccctagtcaaactcacctgtgacgggcgccaacgatggggccgtcacaggtgatgtcaccagtgatgggcgccaactgtggagccatcacaggtggcctcacctgtgatgggcccaacattctgggccgtcataggtaaggtcacctgtgacggccccgtaataagagcccgtcacaggtgagtttgcctacagtaattttattttattttatttcacttagttcttttattttccttaacatatttccacatacactacatatttttgttatacttaattattttatttcactaacggtagaaattgcacttcattattttactaattttattattttatttccaatggttatacttgcttaattattttatttcacttctagtgggtgcttcacttaattattttatttgactatttcataagcaatatactattgatcattccgaacatattagtcatacagataacagacatgtagacataaactacgtacataaattacaaaaataatccttcctcatggtcgacgcgtgcatattgaacgttatcttcttcttcctcctcttctagaggtatttcttgacctatgccgtggacgtgctggttgtaatcatcctcttcaatattgtccaatccaacaattccccttttcccttcacgaacaacatgtagtttcttgttacacgggtcaactatgtagaacacttgaacaacttgtttggcgagaacgaacggttcatccttgtacacgttgttagccaagttgacagtggtgaaaccttcattgtcaacttttacattacgaagatcgacccatgggctgcaggaa

SEQ ID NO: 73118 - DNA, 2851 bp, Oryza sativa
tgcaaaaacggattacccagttcctggtcctgcgctccatggtgtccaggattttcactggcttctccacatacgtcaaatcttcgcgaacttcgatttgctctgagtcggcctgctcggatggcactcgaagacatttcttgagttgcgacacatggaacacatcatgcacgttgcccaaggaggcgggcagctccagctggtaagcgacttctccgcgtcgagcagtgatacgaaagggacccacataccgaggtgcgagcttcccttttgtctgaaacctgtgcacacctcgcaatggcgtgacccgaaggtacacaaaatcatccactgcgaattccagatcacggcgacggttatctgcataacttttctgccgagactgtgccacctttagattatcccgaatgattctgactttagcttcagcttctctcaggatatcagtcccgaacacttggctttccccaacttggtcccacaatagtggtgtccggcatttgcggccatacaacgcttcgtacggtgccatctgtatgctggcttgatagctgttattgtaggagaactcggcgtaggggagactcttatcccatgtcttcccaaaatctaggacacaagcgcgaagcatatcttctaggatctgatttagacgcccggtctgtccatctgtctgcgggtgatacgcggtgctgaaatttaagcgggtacccaactcttcttggagcttcttccagaaatgataggtgaactggcttcccctatcagatacaattttcttaggaacgccatggagactcacgatcctagcgaagtagagttcagctagtttgttccctccataggtggtcttcacaggaataaaccgagctaccttggtttgtcggtccacaactacccatatagaatcataaccgccctgggtttttggaagtccggtgatgaaatccatcccaatttcatcccatttccattctggtacttggagaggttggagaagtccggccggtcgttggtgctctgccttgacacgttagcacacatcacaaagggccacgaactctgcaatttcccgcttcatactaacccaccagtatttccctttcaagtctaagtacatcttcgtactgccaggatggatggaataaggactttcgtgagcttcctgaagtatcagctgtttaagttccttgtcgtccggaacgcatacacgatttccattccatagggttccatgttcatcttctgtgaaaccagcggctttaccttgtttcatattcttgaggatcccatgcatatctggatcattcttctgagcctcgtggatttgatcgagcaaggtaggcttggcttccagcgtagccaagaatccacgatcaactatgcttaggttcagggcttccatctgttgatgaagttctggtggaatgccacggacgccaagagtgttgcaacggcttttccgactcagcgcgtctgcgaccacgttggccttaccagggtgatagtggattcccacatcataatccttgatgagctctaaccatcttctctgccgaagattcagatccgactgggtgaagatgtatttcaaactcttatgatcggtatatatttcgcagcgattcccaatgagataatgccgccagatttttagagcatgaaccacagcggccaactccaaatcatgggtagggtagttgccttcatgaggccgtagctggcgtgaggcataggctaccacatgaccttcctgcatgagcacgcaccccaatccttggcgcgaagcgtcacaatacaccatgaagtccttgcgagtatccggtaagattaaaactggcgaggaaaccagcttttccttgagagtttggaacgccttctcgcattgcgggctccacacaaatttttcttctttcttcaacaactgtgtcatgggtcgagcgattttggagaagttctcgatgaacctccggtagtatcttgccaaacccaaaaagctgcgaacctgagtaactgtcttgggttgcttccaatcagtgacggcggtcactgtttcggggtccacagcaactcctttagcagatatcacatgccctaagaatttgactttggacaaccagaactcacacttgctaagcttggcatacaattgatgttcccgcaactttcccaacaccagacagagatgttggcggcacaacgagacgaggagccggcgaggaggagcggccgacccaagggacgtctgcgatgaccaggatggagaggaggcgatgccgaagacgacgtcgctggctcgccgctgcgatgccggaggtggtggtggcacggccgacggcgcacggggatggcagaaggggctgccgaaagcgacgtcgacgaggaggaaagagaggccggcgcggcggcggcgggctccggacgaagacgggcagcggtcggggtggagggtgaccccgtggagccggggaaggagatgacgacgacggctgccgcaccgatgaggaacagtagccggccggaggcaggaaggtactggacaccgacaaggagaccgctctggcgagcttcgggcgaggaggaggtgaggccggagaagagggcggcgtcacagagccgagggaagcgacggcacggccgaccgacgctcacgcgcggccgcacaggcggttggaggcggccggcgcgggggaaagagaagggcgacggcggggaggggtgatacgaccatggggaggctcgggatgaggctaaaactatagaacggaggatggggattccattttataggcgcggggagggagccggccaggggaggagcggggaacggcggtggagtatgtggccggcg

SEQ ID NO: 73119 - DNA, 9541 bp, Oryza sativa
ttgaattatgtttcttaaaagaaccaacttatcccactcgacatgctttgacgtcttcccaaatgtctttactggtggacttgtatttttctgattattgacctgccaaatctgaaacttctttggtggatgtgattttaatcttgactctgtagattatctttgaacatatcacttggttcataactgggaatagctctcacgaacaagcaactcggattcactttttttacatttggttcacttcccactattctcttcatgttgtcctcagttagcattcaacgtattcctttacacctttaaccttgatgtgttctttcccgatttctcttatcaatcacgtttcgacctacttctttgcccggtaataaacatctttttcgatatcttctatcaatcatcttttgacctttgtcaactaagtactcttcactccgagagttgtggatgcttctggtgacgatgtggtacttgagcctgctgcctttcagagaaaccttcaagtggttcatcaaaagctagactggcggttgttgcctttgatccaaagaagacacatctgaaactcttagtccaaacaaaagtctctttggctttttaatctaacacagatcgcttcattttcttttctatcaacaactaggttacttgatttatcatagattatgagcttacggatatgagaccctaggtctcctttgtcagtaaacaattacgcacataatcacatatccgcatcttccaaaagaatccacatagatcttgtctgtattatacatttctcccttattacatgaatactaagcactgcctaaaaaaaaggaaaggtgcttagcatcggtacattgtttctgctatgggttatgattagcacgaggcctcacaggtatggcgtttgctccagtgaccacaaggcgagtgacttgtcttcttcttgcataatggccggagtgatgacgcaggttacgcttcggttgtggacaatctgtggagaaatgacctggttctttgcaattgtaacaaatcaatgtcttctttactgagctgttcgtctgggaacgatcattctgacttggagttggaattggtggttggaaatccttgctaacattggcatcagtggtaccatagttgctatcaccattggagtctttctcagagtcaaaattgctagggttgtcattctgggtgccttcattgatactatcgtcgatatcttggtgaatgctattgacatcgcacgcttgatccgagtggtccctaatggggcaagaaccatggttgttggtggtatcatcagcattagtattgctaatgttgttgtctgcattgtgtccatcttcttggggtaggaactcttgatgcgcaacagaggatccggtgatctgaagtggctcaatgcgctatctttggttaccacgtggaaatactgggatgttgacaatccttctcttgcagttcttcatccgattatgatcactttcgagttgtatggcttgtgtccacaagtttctcaaaatcttcataatcctctaggagtagttgcactgcaacctcatcttttaacccctggagaaacttctcttgtttgtcttcatccgtttccacatcttctggtgcatagtgagccaaacgatagaactcgtgcaggtactctgtgacggtcaaatcttcttgcttcaggtagcgaaactctcgttttcttagtgtgatcattcctgcgggaacatgtgatctcttgaatacagatgaaaactcatcccaagtgatggtatgtccttctggccgtgatgcttcgtagctattccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctaataacttgcactgttgctagactgtaggtacttgaacgttggttgcccctgctgggttgttccaattttgtaatagttgaaatgctgttgccaacatgttggtttggttaaccacaatttggattagctctggtgaggtttcgttgatgcttttctcattcccattgactgtcggatccatcattcccatagcctttgttaccagtgttatccatctgtcacaatgtagaggttgagagaggaagcatacaaggaaagaatagaccagaactagggacaagaccttaaaggaactaactctttttgttgatgtgttgtttgttttgcttattctacaagttgattaagcaaacaacctagcatggttacatcacaacccaccgatgcaaaccacgcgctacacacacaagcaaaggaacacacgactaaccacactaccctagagggcggcttaggttctgtgactggttcccaagatcttcactgcttcttccactttgctagcggatcctgcactcttctggagcttcagcagacaattgatgacatcttcttcttcgcaaaactaaccatctagtactagttgaaaatccgaaggaggaagaagagaataaacattttgcaaatagcattagggaaaggaggaacaaggaactttcgcaaatagtttcatttataaaatatgtccttaggttttatccacttggcttatcctacagtcgagatggctctgatactagcttgtcgcgaccgagaaaattgccttttcccgaacgctagtgtattaatccccgtcccaggaaaagccggggtacaccaaacaaacatgatacaaaaggcacatctttattatatcgataatatttacattattacaaaggcacttcaggcctgacaatcaaaaataaacagcagcggactagcaggcctacggctccatcttcacaggcgctcaactggggtataagccaggactccacctaagacttcttctccaaagcttctcttactgaaggggggaaagatagagcaagaatgagtacaaccaccgttttttttaataaactttgataattgtttttgttgcttaataaatatttccggtgctctgaaaattcaagtaaaatttgagggctcattttagaccaaggagaatttaacaaaaattctccgggccacattcgaatttttcttgtacatattttagtgttaaccaatttcttttcgaattttaattaattctattattccttttagagaatgatttttatttcgggatgaatttatcaggacgtgacatgggcccttccggcctggccttcggcccatctcctctcctggttcttctctatccatttctcggagttttgtgttgattctatggtattttgatgaagttcaaaaaccatccttgtatggatacatattttctctcactttagtatgattttcctcccaactttagagtttatcacttgcatacaaatatacaccaacacttgtgaaatatgtgagatttaacacctatcactctatgttggatgttttattgtctggactttatgcagatgttggcggtatagaattggcattgaataactgccaacaaaaccccctacacttagctctttactcgtcccggagtaaaagttagtgtagaataaatttctccaagatataattcgagtatataaattattcagacccatacctacaccgtgaactttaacagtggttacttgccatctggggtaattaataaatggaatgatctcgactccagtctttcttgcttctccggtcagactcatgggatttttatgaattttcacaaactaactcttttcctcatattgaccttatcccttgtcactcaagtaaataattttttttcttgtggatcctcaccaaggcaaaaatgtgccaaacttacccctattctaaggctgatatatggagcttggtaggggtaaaagtgtgacatacatgcatcatatatattgcaaagccaaatatatggactcaagaagattatcagtcatactcctagatcaagggtctttatatgtggtggaaaaaggaaaagtgaaatattttgtggaatgatggaataaagaaatgtgtctccttttttttcctatacctcctccatttttttttcttgcatgaatgtggaagtggcatggctatatgcatatttttttttcatcatgctcaatgttttgagagcaagctttatttctctctcttttttatagccatgcctttccctccttttctcattttctttcctttttccaaggattttctaggagaagaaaacatagtttaaaataggtgtatattttaatggaatttttgtgggaagccaacttccagtgtagaagcttagcttaattatatatatggaaatgaccccttgatcatgagagtataaaagatatctaacatgagtcacatagatttgacaaagctcaatataatgtcaagcagtcatatgcataataaagtttatcattgatatacttgcatatggccttggtaggtataaaataaagtcaattggaggaatgagctctttaaaacaaaattttattttgaaaaacaaattcccataagtaatgacaacagttgaagaacttccttcatctttaaccatctcacatataacaattactttgatgcataacgttccctaaacatggatgttcgttcacaagtacaagttcagctaagaataataaatatacaagattaatcataggaagaatttcattagttggaaattttatctttttaattatgcttgaactaattaatttctgaattcacagctctagtactataccatggtggagatatacagataatagacgtgctcacctgcttacctaggaaaattgagagggattgggactagcactggttgggttcagcccaaccaccttggtacccaattcctctgcaattccctgcagagttcagtgtacctcaggtgtttagatattcagcaaatttcagagtatgtgcacgtcagaagctaggatatctcccccacacttattcaaaacctgatctttattaaacaaaacaaaaacaaatcttggcaaacattggggttaacaccaatgagtcacattatttatagcaagtgcttacatgattggaaaataaatgaccaagcaccaattacatttattcatgagaaaggagacatttaattagcatcatacttattctccttccccatctctacgaatgcacgcttgatctagcgcatgaaccgcgactaagagtatcaaaattattcctaagctcagcaagctctacccctagttctgcgttacggtccctaagctcaatgttctccttgcggagcttcttcacttgtgccgctagcttatggaccgagggttccggcgacttcacttcttcctcttgaaattggccaagcgcccttacaattggagggggcgtcaaatgacgcttcaccgtcataggtggagggcaacgggattccgctgcccctccttctccgatgccgtcaacggccggagcaagcctttaccatacctaccgccgggagttcgcactctccgaatgcaaaaccaatcctccttgggggtggatggagtggcggtgggtgtgatgtagttgtggagctcctcatcccctgccttggtgtagagggtgcccacataccgctcagcaggaggcggagtggccttgtcatcgtcttggaaaagacgtctcgctttaataggctgagttcacccgtcgttgttcgtcgtgcaggctaatacccccggattttggtcttggtgacatgacgaggggagagggatcgtgctgccgaacggggagccgaacggggccgagacgggttcgaccgaacccctggtttggccgaaccagtgagtttgccggccggctccatatttgctggggagctgggcaccgtagcaaggggtgaatgcccccttccattgtgtagttttccactgggatgacttgattcgccggtgtttctccttcaaggttgtaggtggagtttgaggaggagccaatgtatggcatcagggatttgccagccattggtgagttgagggtgtaaatcaaggaattgagctaggatggagagaagagttgcaaagatggaggagaggaggaagaagggtcttatggtgctgatccaaaagttctacctccgaatgcgcatctaaacaaactcaaacgagcgcggagaggaagctattcaaacttggggccgattgggtgctaccctggtgggagcaggagaatggaatatggactttgaaggagaatggaaccaggggttcggccgaaccctagtgggctcagctggctaccaaaattttcacacgctcaagcaaacttattctaagctcagaaatgacaattttacaggaaattaagcatgctttagatgagatcattatggttcataatcgattaattcaataatatccacttcttcatctaaagattcattaggctcatgaaaaatttttaaacggtaactgcttaccttaaatatgttatttgagtcgtcgcaaagtgtgattgccccgtgccaagaggtgtcgataacgtcgaacggtccttcccatttactgcgcaattttccgtggccgaaaagcttaaccctcgagttgaacatcagcagtttgtctcattgcttgaatttcttgatttttatcctcttatcatgccagcgcttcatcctctctttggatatctaagtgttgtgatatgccttctctctccattcttcaagttcagcaatttgcatcatcctccattctcctactccttcaaagtccatattccagttcctgatggcctaatatgctctgtcctcaagttctacagggagttggcatgacttcccgtagacaatctgatagggagaaattccaatgggtgtcttgtatgctgtccggtatgcccacaatgagtctggcaatttctccttttatcctgttcccattttgttgaccgtcttttgcacaatattcgtgatttgtttatttgacgtttctgcttgactgctggtctgtggatggtaaggtgtggccacgttgtgcttcactcccatgtctcgtaggaggtctcaaaaggttttgtcaatgaagtgcgaacctccgtcacttatgaccatccttggggtaccaaaccttgggaagatgatctctatcaacatcttcttggtatgcttcgcatccgcagcgctgcacaacatagcctcaacccacttggagacatagtcgactgccaccagaataaacttgcaactcgcagttacatgacttagaaaaaggtcaataccccaaacatcgaatatctcgacttgcaggttgtatgtgaggggcattgcatcacgagcagtgattcctccttgcctctgacaacttggacatcttctgacgaattcttttgaatcttcatacatcgttggccagaagaaaccgcattgccaaatcttggcttgggtgcggaatgcgccataatggccaccataaggtgaggcatggcatcgttctataatcttaagtccctgttcagtcggcacacatcttcttagtaaaccaacggagcagaccctatataggtatggctcatcccatatgttacggcggctatcgtatttcaacttcctttgattttctcccggtggtatgtattttgataccatgtagttcactatgtttccatccacgggttggagtcacgtaccgtcatcagcatgtcgtctctcaagaaatcatttatcagttattcctgcatgtcagtgatttgcagcctagaaaaatgatctgctacagaattttctactccctttttatccttaatttctaagtcaaattcttggagcagcaaaatccatcttaagaggcgtggtttagcatccttcttagtgagcaagtattttagagcagcatgatcagtgtaaattatcacttacgtcccatcaagtaagatctaaacttatcgatagcaaaaacaatcgcgagcagctctttctcggtagttgcataattcaactgagctctggttaaagttttgctagcatagcagattgcatgatgttttttgtctttggtttggcccaagaccgcgccaacagtgaaatcgcttgtatcacacataatctcgaagggcagagtccaatcaggaggttgaatgattggagcagagatgagtgcctttttgagaatttcaaagtattttaggcacgcgtcatcgaactcaatgggaccatctttggctaacaggttggtcagaggtcgagcgtttgcagacaatgaccgaaggtccttccatagatagagaagtcatccatgaagacttccataatgtcctcgatcatattcgagaaaatagacatcatgcacgtttgaaaagatgcaagagcgttgcacagtccgaaagacatcctacgataagcatatgtgtcgtacggacatatgaacgtagtcttactttggtcctccgtatggatgggaatttgatgatacctgcaatacccatcaaggaaacagaaaaaggaatgatttgccagccgttccaacatttcatcaaagaagggtagcggaaaatgatcctttttcgtagccttgttctatgcacatcctccatccagttatggttcgttgcagaataagttcattttgagcatttgcaacgaccatcattcctcccttctttggcacaacctggactgggctaacccactcactgtatggtatggggtaaataatcccggcatgcaggagtttcaggacctctttctttacaacctctcgtatcgcattattgagtcgttgttgaggttccctggagggagtactctcaaggtcaatagggatacgatgagtgcaaagtgcaggattaatccctctgaggtcttgaagggaatagccaagaacaacacgatgcttttctaacatagacagaagacgttgagtctcgtcttcagaaagcttgtcactgattatgataggggcttctctgtcattgtgcaagaaagcatagcgtaggccttcaggtagaggtttaagctcaaacggaggtcgaggtggcagttccatgattggaagttcgagagtctcactaggttccgcttcttccttgatgaagtcagggacttcattttccagaagggcctcgggagactcgtgagggggaactgctctaacctcctccgcagactcaatctctaggagagagccggtcaaggcgaaccatgcccgcgagaatgcaactgagaattcgtttcctcccaaagttatcttgaggctatctaatcagggcatgtttattaggagtttctcaaatgggaagcccgattagaatgtcaaaatcttagatttcaaagtgaaagtatcaattaggcatagaggcgggtgaataggctaattcaaaaattcaattaaaagcggaagcagtaattttcggagtcagcccaaactcaaagtaaatcctagatctagttgcctataacaagaatatgctagcacaaacagcaactagacctatag

SEQ ID NO: 73120 - DNA, 21697 bp, Oryza sativa
  unsure (1)..(21697): unsure at all n locations
ttggctggatgacgtggccaacttggtcatgacggcacggcagcgcctaggtgctggtgggcggtcctccgccaccaagacctctggcgctgctaccaccggctccgtatcgtcaaggcggagggtgcggcgagcggcgctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcttcctcatccggagcgccacatcggtccgggcacggggatcagccccccgtgtccccggttggcggtgccggctgtcgagcctttgtggcgagccttcggaacgcccgttggcccccaaggttccggcccaccatcaccgaaaaatacgacagaagcgtcaaccccgccgagtttctccagatctacacgaccgggatcgaggccgccgggggtgacgacagggtcatggcgaatttctttcccatggccctgaagggtcaggcgcgggttggctaatgaacttgccacccgcgtcggtccactcttgggaggatttgtgccagcagttcaccacgaacttccaaggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcaggggggacgtgcggcacaaccgcatgctcgagaagatcgcctctaaggagccccagaccaccgcgcagctttttgagctcgcggaccgtgtggctcgcaaggaggaggcctggacctggaactcctccggctctggtgtggcagctccggccgcccccgggtccgccgctcggtcagggcggcgagacaggaggaggaagaaggggtcggcccgttccgacgacgagggtcatgtcctcgccgtcgagggcgcttcgtgggccccccgaaaggggaggcctgcgagcgacaaaaagaaggaggccggcactcccagcagggagcgcccgaccggcaagtggtgtaccgtgcacaacacctccctccacgacctcgcggactgccgcgcggtcaaaagtttggctgagcgcacgaggaagtgggaggaggagaagaggcaggagcgccgtgagggcaagtccccggcggctcccgccggcaaccggcgaagtgaggccaagcagaaggccaccgccgagggcatcgacgatggcgacgatgacctggggttccaggagcccgaggccaccgtcgccaccgtcgatgggggagcgtgcgctcacgcttctcgccggagcctcaaggccatgaagcgcgagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggtgcagccctcaacatcctttcccccgctgcctttgacgccatcaaggccccggggatggtgctccggccgtcccagccgatcatcggtgtgacgccggggcacacctagccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgcatggagcagcgcgcggaccacctcgccgcggcgtccaagcccgcgggtggcgacgagaggcccagcacctccgtcccggccgccccaaggcggcggatggtcacgtgcgacgaggtcccggtcaaggaggttgccctgggcgacggcccgtccaagaccacacgaatcggtggtcttctggacgacaaataggaagacgcgctcgtctccttcctgcaggcaaacgccgccgtcttcgcctggagaccggcggacatgcccggggtccccagggaggtgattgagcaccgtctcgccgtgcggccgggcgcaaggccggtccggcagaaagtgcggcggcaggccccggaacatcaagccttcatccgcgagggggtggcgcgacttctggaggccggattcatccgtgaggtcatccatccggagtggctggcgaacccaatcgtcgtccccaaggcgaacggcaagtttcggatgtgcatcgactacaccgaccttaacaaggcatgtcctaaggacccttaccccctgccacgcatagatcagattgtcgactccaccgcggggtgcgaccttttgtgttttctagatgcatattctggttatcatcagattcgcatggctagggaggatgaggaaaaaactgcgttcattacccccataggaacttattgctatacgacaatgcctttcgggttaaagaatgcaggttctacttttcaacgtactactcgaatttctttgggtagtcagataggatgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggtcaaccccgagaagatacgagctatagagcggatgcgccccccagcaagcttagggatgtgcagtgcgtcaccggcttcatggccgccctaagtcggttcatatcgaggctgggagagaaggcactacccctatttaagctcctcaaacgctccgggccgtttacctggacggaagaggctgagcgggccctcactcagttgaaggcgtacctcagttctcccccagtcctggtcgccccggagccagatgagccgttgctactctacctagcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcctgcttgtccgatggtgccaggcgcccccgacccccaggatggccccgaggccactacgggaaggccgcgcctgtcgccctctgaccccaagggcgtcggcacagaagccgagtgcgccccacgtggcctctcggacgaagagcgccctggagttgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattacttccaggcgcatcggatcacggtggttacatcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccacctcgggcccctcgcagctgcctcacaccgcctactgggtgatgcagttcgacggctccctgtctctttagggcgccggtgcgggggtcacgttgaccttgccgagcggagacgtcctcagatatctggtccgcctagacttccgggcgaccaacaatatggcggagtacgagggactccttgcgggactcagagtgacagctggactggggatccgccgcctcctggtattaggcgactcccagttggtcgttaaccaggtctgtaaggagtaccggtgctctgacccgcagatggacgcttacgtgcgccaggtgcggcgtatggagcgccatttcgacgggatagagtttcggcacgtatttcgacgggatagagcttcggcacgtgccccgacgaactctcaaggctcgcttcctcgcgagcccagaccccaccgggcgcctttgaagaaaggcttgcccagccgtcggcgcgacccgacccccaaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatatccatgaaggcaagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcacttaaattcatcaggggcatcactgctcggtttgggttgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcagaaatcctcaagggcctcaaaaccaagaccttcaacatcctcaagaagcacggcacctcgtggatcgaggagctgccgacggtgctctgggcgaaccgaaccacgccaagccgagcaaccggggaaacgcctttcttccttgtctacggcgcggaggcggtcctcccatctgagctcaccctgaggtcccctcgggtcaccatgtattgcgaggctgatcaagatcagcttcgccgagacgacctcgaccatttggaggagcgaaggcggcgcgcggccctccgaaccgcgcgctaccagcagagcctgcggcgctaccatcagcgccacgtccgggcccgatcactctgcgtcgacaacctcgtcctacgccgcgtacaaacgcgtgctggactgagcaagctcgcaccaatgtgggagggtccgtatcgagtgatcggggtcccccggccgggcttggttcggctggccaccggcgacggcatagagctacctaacccgtggaacatcgaacaccttggtcggttctacccctagggggggtcgggtgtcatgtttagggctcgggccaaccccgcacccccccgggcgtacagggttggccgggggctaccacatgcatatacttaccttttttctcttccgtatttcaataaaagcattttcgatttcctgaggactgtgtctgtgccatcgtttccttttgaagaatcttggcttgaattagtacgctcgtgcccgaccctaccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagctccgacccgcgccgtttgaggctgggacctaggcacgagcccttgttcaagccaagacacagaaggaccgcggcacagaccatcctcgtctcatacacacaacaaacagaactgacgcagaaatttcctctttacttgattacagattaaatcagtctatacaagaagggggcccgaaggcctcggaaaaagaagaaaaagttattaagattggcgggggcctgggggctcactccgacgcgcccgggtcgccgtcctcgtcgtcgttattgtccgcaccgtcgtcaccgccctcctcgtcagagtcgagggcgaacgcgagccgaggggccgtaccctcgaagctgtggacgatgtggtcggcggcatcccggacctgcgtgcgcgcgccgtcctcggttccgggagggaactcttccagcgctgcccacggggagaagtcagggtccctggcctggtagcttgccagtacgagctccaccgccccccgggcgaggtctctcgaggatgacttgatcgtctcctcgagctcctcggggagccgccggagggccccagccatctctgagaggcgctgggcgagacccccctggttggcggcgtacttcgcgcactgcccgccctagaggcccgcctgccgcccggcgcggtctagacgggagacggcgtcccgaagcatgccgggccctacctcgcccgccaagcggagggcctcgacctccccggcggacgagttcagcgcgccctgcagctcggcgatggtgtgttcggcggctgcgaggcgggcggctaggtcgccgtcgcccgcggccgccctgccgctgcgcgctctcgcgtccagctccttcgcccgcgcctcgagctcagcggcccgctgatccagtgcggccctctcggtgcgggcgccttccagattacggcgcgcctgctcctcccgccgctgcgccgcggcctcggcctcctcgagagctcgctcccgctcggtgagtgcgtcctcgcggaggcggagtgcggactcctcttcggcgcaggcggcctcgtgcgccgccaatgttgcctcccgggtggcgacggcggcctcgcggtccgccagctctctctccttcgcgtccagggcgcgggcgcgctcctccagcgccgtggcacgagcctcaagggcctcttcgcgctgccgggatgccgcctcgttctccgccgcccgccgttcccgggcagcggcggcgtcaaggactcctcgggcagcgtcgagcttcttctctagctccgccgcccggctcccgtattgaagatggaggtcgtcccgcgcctcgtcgagcacggcggtggcgatgagggcagtctcccgctcctcctccacctccctggcgatctccgccaggtccctacgacgggcctcgagctctgaggcgtgccggcggtgtgccttacggcccgcctccaccaaggcctccaccgagcgccgcccctcctcgacgcgcgcccacgccgcgtcgagctccgcccactccgcctgcaggacctccatctgggcacttaacccgtccagcaccgtgctgttcgcggcggccaaggcctgcaggaggggctctgcgctcagtggggcagcggaaggcagaggggagagacgcctcggtgtgggtgccgcgcggctcagccaccgatcgacgtgccggactcgggggcgtcccccgaagctggctcgtcccgagcgtcgcccgaggggtcgggcccgagcggcgcgcccgcagcctcgtcgtgggtggcttcggaagtcgtcgtcgcctcgggcggaatcgggtcgggggcttggcaggacgcctggcgtgcgcgcgccgcctctgcatcccggacggactccccggcccggcggagtctggcctcctcccgagcggcctcctcagcctggcgaacccggacggcctcctgggcagcctcctcggcttcctggaggcggtccgcggcttctcgccggtcagcttcccgccaccgggcctgcgcggtcaccgtctcttcggcctcagaccggccggacttggaatggcgggggggggggggggggggcgacgggatctcgctgaggcagaagaaaaaccagaagacaaaaagaaacgggtgagtgaaaactcgccttgggagatgggagaatgaatacggccgcggtgggcgcggagacgaacctgcggggaggtcggttaaatgaccacctcgggggcgagatgaggttcccccggcatggctcggtcccccccatcttgcggagccgtttcttctttcgctcctcctcgggctgcggcgtcggcacggcaccctccgggcgcctgctgctggcacgcaccgccccgccccctcggggaggagatgggggaggggtaccctcctgcttcctcttcccccgggcgtcggcagggcggctgccccccgggcccccgtcgcggggccctgaagcgcgaccccctcccggggtagattgttcccccctgcggctcccgcccgcgccatcgtggcctcggggggcccgctcccccgacgccccgaccgcctgcatgatggtcaggatgttggcgcggtctggatcgcagcagagggggaggaccccttgggggatgagggatgcctctacggagctgagattcagcacccgttggaccaccatcttgaagtcttcagggacccagtcccatttgcacccctggtgggtcctcatgtagtcctcggacccggtgtactcccaggcgccccgggcgcgccgctggagcggcgcgatccggcgacgaaggtagtcgccgaagaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccagtcgctcttccagtcgtcccactttttgcggaggacgcagggaatgtagcggttcagcaccggcccccgcggctggaagtagcaaccaccgactaccgtcggcggcgacaccggctgtacagtgaagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaagtagagaatggcgggaccagccccgccattgcgaaagagaggaagaagacggaccgccctgggtagtgtggcgccgggcgtccttcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcgagggtagggcacaggagacgaagagttggagcgccccgaccccctgaggttttggcgccacgtgtgtgggttaggtgagcacagcggggctcacctaaccgcatttatagcgggttggacgagcgcgccacgccgcatttaatgcggcgcagcgcatgcttatccggtccgtgaccggtcgcggcgtgtgaccggtcacagaccggtcagatcgcgggattaggtggcaacaggcggcctgtcacacgcctcgccccgtcccgtcggaatgatgagagtttcctggctctcgtccctagtcggagccggcgtgctcactcctgtagttggtatgtcagtcccggtcagattcattccagacttcaacgcaggcatggcaaggaagtcgctggccattaaatgaaggttgaaatgggcgtccaccggaaaagcgggcgagcagggcaggaagcgtgtgctctgcttgtcagaagtcatttccggctgtagactagccctcattgtaaaaagcatgtttcctttcttaggcagctagaggcccatgtggtgacccctgatcagataaaaaggaggcccaggcctaaaagaaagaggagggaaaaaagaggaggaggaaggagtgctagagcctgaacggtctccctcgctctccggctctcggtaattcttacacacacagatccaccagaacacaggagtagggtgttacgcttctcagcggcccgaacctgtctacgtcgcccatgtcttgtgcatttcctctctcgctgaagttcctccagatcgagggcgaagaacctcacttagcgcccccggccgaaccggcaaaggggggcctgcgcggtctcccggtgaggagccccacgctccgtcagccgccctcgcctctgtgatctcgcggctaatgctgcgagcaccagcctcgaggaggcgccccatctcgacctggagctcctcccaggtgaggacggcagccggcggaccacgaccagccacgagatcgctggctaggccgctaggtgtcgcctcgtggctcctgggcacgaccacgacatccgtcgaggccacagcaggagacgcgctggaggtccccctagacccgtcttgcaccgccttcgcccgcgccgccctgcgaaaggctgcaattgagacagactacaagagtttgacgaagtcacgaaacctcaaattcattcacttacttctcgccgagcgtcacaagccgctgccgtcgcggaggcgggggagacgcatccgaggcctggagtataacgtatatgaggtgaggtggaagtttcccgactatgcgatgaaagaccaggagagcttaccgagggggtgggcgtcttccgacgatgtctgatcacagaggagaatttcctcccctttttcggaacattgccatcactcgttgtggcagcagcggcagcagcgtcagacgcctccttggcgactttctccttcagcgacgtcgccacctaatggtccacgagcggcccgatgatatcagttagagggagagcctacacttcatgaagtcatgatgtgatcccgaaagaaaaatgcaaaaggaccgctgagtgcacttacatagttggcagcttcgcgctcggctgcccctttctcgcaaagggggacggggacgttgctcgccgttgttgggccactgatcatcagttggctgacgcggcactccacggttgcgctgtccaagcctgtagatcgagaccagaattcgataagtcgggaagaacacgcacataagggagtcaatttaactaaaaaaaataccccgaggagaaacccgggtcgcgtcctccggcccagaataatcaaaggctgggtgggcccgagcctggagcggctggatccgcctatcaatgaagtcggcagcgacttcataccccgacaatccccgtactcggaggtcatcaatgatatcgatgaaagattggagggatggggtcaaggtggatttggcggtccaagatgaaatcttgtctggttgctcctcaggaacaataaagaccggatccgaatcttctatctgaagatagaaccacctcccccgccatttgctgtgagatgaggggcactagaaggggggtgtatcgcgacttcaggccatcccgaagtcggaaaccgacacatccaaacacctttttaggtttcatccagcgcaactcatagtaaaagcggaagaggtcaagaaacggctctaccccaatgtaggcctcacaaagatgcgaaaagatactcaggaaggcgacggaattgggtttcaaatggagcaaggaaaggccgtagaaattcaagaccaagagaagaaattcagaaggcggaggaagaaaaccacagagaataaagtcctcgatcgcaaccatgcgacccaggacaggctggggttcagtacctcctgcttctctctccatggttccgcgactgggaagggcgccatcctcctgcagcttcttcagcgatgcgctggtagaggtagacttgtcgagatccattgctgccggggatcgccggagaaaggaccgagatgagctagctagggtttttgtgggagcggagaagacgagggacacttggaggctggagagttttttcacaacaggcggacttcaaattggatccccaaaactcccttaaatagacgcacttccgacggtgtgaattctaaggaaaggagagagatggccgccggaaatttctgggtctgttacgcgcggcagtttttcggacttcaatttaattcactcatgaccgttgagcttcacctggcgttgtcgatcactccttgtctctcggtcctcacaccgagaacgatgacaacctcgacatcagaagtcgcgatcggtttcgcgagttcatttaagtagaagtcgggggctactgtcagggttacgggtaaggtataccctctacccttcgatatacgtcacatatcgatatggtatacttacgcgtatatggacgttttcggcatacgttaaggaaattcattatggagtttacagatggaaggagtcctactcggatataaatgggtcgtcattgtatcgtaccgggtccgatgtctccgagttctacttggagaccagttgacatgcggtataaaagggaccccccgggaggacctaaagcatcgaatcttaccgccaacacatccaccacagcctacgaagccggagcctacaggagccaagtcgccgggtgatctagtcgaatcaactcgactacgatctcattggtatcgtcgagttccactatttcctttgtaatatgtggtttccatcatataatcccatatcaactggattagggctattacctatcaaggggcctgaaccagtataatctttgttttctgcctactcgatgtcgtattacgtagatccttgtaccagcgtactccaataccctctatatccggtttacggatatcccccgtcgacaccctccgtcccacattatatgggattaggggttaaaagcgtgtctcataatataagggatcgggtaggcagagtactaatccaaaccgacatataagaattgtttttttaaaaaaatatatttcaacatcgtattgcaataccttcgaaagaattgctcaggatatattgagattgacgaagtcaccatagacatcttgctatcgacgggtgcattgccttatcactaaaaaaaataattagccgtaaattcgagcacccgtgttaaatctagaatttaaacctggagggccagttcgaccacaagaaacctaaagttgagttacgctcacttcgcaatccacagtaatacataccaagcttgctctgtgtaagcacagttttttgaacaccctacacgatggtctttaaaaaaacgctaccttcatcaaaattttgacatcaattaaatgatcatgtattaccaaaattttgacaatgcctaatttttgaccgaattttaagttaacaacatttcgctaaattcacataggaaaaaatacaagttacaaaagtccaaaaggagaccgtggatgacgactacctggcacgacattgggccaccaccgccaaccctcccaaccactgccagatgggacgccaatacacagctcagcacccacccccaaaagtccaaaaaaacccagccaattcgctcatttccattggacgcagccaactccgcgtccgcaaagaaactagtctacgccgccgcctcgccaacctccccacgccggccaccgccgcacgggctccggcgacgaacgagggcgctgctctcgagcgcgatggggggccggaagcgcgcgctgctggtgggcatcaactacccgggcaccaaggcggagctcaaggggtgccacaacgacgtggcccgcatgcgccgcgccctcgtcgaccgcttcggcttcgacgaggccgacatccgcgtcctcgccgacgccgaccggtcggcgccgcagcccacgggggccaacatccgccgggagctcgcgcgcctcgtcggcgacgcccgccccggggacttcctcttcttccactacagcggccacgggacgcggctgccggcggagaccggccaggacgacgacaccggctacgacgagtgcatcgtgccctccgacatgaacctcatcacaggtgattgctccgcgcgctgctgtctacattttttttgtcgtcctgcttcggaattggggatcgaataggcgagatttgagagggacgttgtccgattgttacgtgacatgacttatgttcgaatcgtgctcagtgtgctatatgaaaaaaagttgaatttgatgggttatgaggcgacttaagttttgggatctaatgggccaaccactagtaattttgctactgaaatggacaaaaagctgaattcaacaacaccaaagattccgtatgatagtatttggtttcttttctgaaaatgttgattatgtttcttttaaatgtggaaaatgttaatatttcgagtgcatagaacctccatgctgtctataaaccaaagttagtgtacatcacacatttctgatacaataattatatctatacctgctatcccaactcccaagttggttgtaggtgagtggagggaaaagcctgaagccgaactaacacttgatcagaaggctctgattcagatcaattgaaccaaaatgcccttttagccacaaacaattagccaggccagattagaatttgccacttggtgtcctgcctggtaaatttaggtaacttagaataggatatgctcttcctgtgattccttcttaccgttaagttatgatttgattgttctacctctggtttcaaaattttaggtagcaagaaaaaaattatcaatcttattcactgagatagaatagtggcttacctatcttttttgaacggaagtagcttacctatctgattctgttgtcaagagcatacatcaatctttggtagagtagtagctcatctatctgattatgtagttaagagcattcatcaatcttgttcactgattcactgaagtagattagtagcttacatgtcttattctgttgtcaagagcgtcctgattttcttctgtaccctgcagaccaagatttcacagaactcgttcaaaaggtcccagatgactgcttattcaccatagtatctgactcctgccacagcggtggtctacttgacaagaccaaggagcagattgggcacagcaccaagcagaaccaggcccagcagatcaagcgagaagaacgttctgactctggcaccggcggtttccgatccttcctcaaagaaaccctcaaagaaacagtccgggacgcgttcgagtctcgaggagttcacatccctcaccagagcagccgccgcaacgacgacgaggatgaggagccacacatgggctcatcctcccatggtggcgatcgcatcaagaaccggtcattgcccctctcgacgttgattgagatgctcaaggagaagaccggcaaggacgacattgacgttggctcgatccggatgacgctgttcagcctcttcggtgacgacgcgagccccaagatcaagaagttcatgaaggtcatgctgaccaagctccaggagggccagcacggcggcgtgatgggcttggtgggcgccctggcgcaggagttcatgaaggctaagctggagggcaaccaggaggcggacgccctcgagccggccatgaaacaggaggtgcacagcgtccacgaggcgtacgccggcacgacggcgagnnnnnnnnnnnnnnnnnnnnntagcgggtgccagaccgaccagacatcggcggacgccacgacgcccaagggcgtgtcctacggcgcgctcagcaacgccatccagaccatcctgtcggagaagagcggcagggtgacgaacaaggagctcgtgctgagagcgcgcgagttgttgtccaagcaagggtacacccagcagcctggcctttactgcagtgacaagcacaccagtgtggccttcatatgctgagagcctggaacatcagctgtgctgcgtggattgctacatatgcgagaatcttccctttcccctttgatgttttacattgttatggagtatggagtctatttgttttttaaatgaaagacaacatggagagtggtcgactgttaatatcaagagaagatgttacaaaatgacagtaaaataatcaccaaatcccagccaccgggaaatgcgatttgtttgtcatcacggccaccatttcactgtcagatccccggtggtctccatcagtccaccacaaaaaacatgttgctaaaaaggctgtagaatggcagcctccagccaacctggtcaggcactcaggcacaccagccgatctgccagtgtcgagtggcatcactagccaatacaagaaagcgcgcgccctggcagcgacgatcacctcgcgctaccgcactcatcactcatcagagctccaccaacccaccacaaaactgccactctgccagtgccaacctatcggaacggcagctcgccgccccaccaacccaaaccggtgtcccggcagagtgcacacacctcgccggctcgccggtgctcacagccgcggtggcgattgatcgatcacatcgccggcgacgaacacgacgatggggcggaagagagcggtgctggtgggcatcaactacgccggcacggagggggagctgaagggctgcctcaacgacgtggcccgcatgcggcgctgcctcgtcgaccgcttcggcttcgacgaggccgacatccgcgtcctcgccgacgccgacccgtccacgccgcagcccacgggtgccaacatccggctcgagctcgagcggctcgtcggcgacgcgcggcccggggacaccctcttcttccactacagtggccacggcttgcagctgccgatcgagaccggcggtgacgacgacgacaccggctacgacgagtgcatcgtgccctgcgacatgaacctgatcaaaggtgatatcggagacaaacacctgatctctcgctaacacccagtatatatggctatcactcatttgacacgagagctggatgatgcagaccaagatttcacggagctcgtgcagaaagtcccggatggctgcctgttcaccatggtctccgactcgtgccacagcggcgggctcatcgacaagaccaaggagcagatagggagcagcacgaagcagagcaagatccagcaacgggagagagagttgcgccggcagcaagctccctctcccggcacgtgctcgtgcgcctccctcctgcagatcgcgctgcgccatcttcctcgccgcggtggccaacggatcatcggtagccgcagccgcgatggcgtgggagaggatcaaccaccacgctcgcaggcagagctgctggccgccgacgcgacgcgcgccggcatcaagaaccggtcgctgccgctctcgacgttcgtggagatgctcacggagaggaccgggaaggacgacgtcggcgtgggctcgatccggacgacgctgttccaccacttcggcgacgacgcgagccccaagatcaggcggctcgtgaatgccatgctgggtcgcagacacggcagcgccacggcgagcgaggagcacccggataaagctaagccagagcgcgtcgacggcgagggcgaggcggcggcggcgaagcaaggggcgccggagacgaggccgttgccgcgcaacggcgtgctgatcagcgggtgccaaaccgacgagacctcggcggacgccaccacaccggagggcgtgtcgtacggcgcgctcagcgacgccatccagagcgtcctcgccgaggagcgccgcgggaaggtgaccaacatggagctcgtgcggagagcgcgggagctgctcgccaagcaagggtacactcagcagcctggactttactgccgcgacaagcacgccaacgtggctttcatatgctaaaaacttcatctcgtgtcatctttatgcgataaattttatttccccgtgttatttagtatctcttggtgcctttttttttatcatagcacacgcaaaaaaaaccaaaaaatagcataagaatttttcgctttcgatcagaagcacaggccaccgatttttcttcgccccatagcacttcagtcaggtttgtagttaacagcattacactgaagtatgaaaaaaaattgttggacccatttgcccttcgtcttcctcgccttaatctcccattctgtgtcatctcgttctctttattctttgtcttcaccaaaccctagctctcgctccccatccgattatacaccatgtggaagacagagtgttcaacgggagctctcgggtcggtgcccacaatgacggcgctggcgtcgttgccaaatggcaatgcgtgacgagggtgtcaaggtgggccttgtcgggggcggcgaacactatgaggaagacctccgtgcaggccacgagcacgcgcgccccgtggttgttctcggcgatgtccttggtgaggcgaagcgcgctgcagctggcggagcagccgtgcatgtagaggatggtgcgttggacggtggcacggaggccgaggagtgccgcgagccactcgtcggtcccaagggagtgggcgccggcgttagtggagacaacgaggtgggtgatgtccgcggtggggtggccccacttggtgattaccctcaccgcggtggccatggctagctttggcacgcgttcttggtgaagttgagccgagcgtcgagagatggaacggcgcggtcgaggaactctggatggccggcaatcatctcctccatgtggctcatatgaaccaaggcatgaaggcaatatggtctttctaactcttgactaacaactaaccagttcactggaacgatgaccacgacggaagtgttacggggtgaagaaaaaccggtggcatgtgcttctaatcgaaagcgaaaaattattgtgccattttttgtaccgctttctttcctatgttatggatcgaattttctattttttcccctccagtttaacatatacaacacaaaataatactcttgcttcctgcattctcagctaaaaagaaaggaagaaagttcaattgcacttttcttacacagccttgtaaaaaaaatggcatacaaaattaacagtcatgtgggtgtcaggttgatcaagcagtaaacaataatcatatactccgtagcatgttccacgagatgtgctatggtagtatgctgtgacaaagaatatgccaatgacaaattgataaatccctaccgctgaactggcctcgagaaaaaaaaagtgttttgtctaaaaaaagagaaaaaaattgtgttcaacgaatcacacgaaaatggacaagttttctccaaactccgatcgatcgattcgatcacacggatcacacaaaaaaacaacggcgatcacggaaggcagcaagccccacacgtcgccgtcgcggcgatcaccgccgcctcctcccccacacaaccaccggtatcatcgacccccacctcccatcccaattcccaagttcccaacctctcgccagcgataagcaaatctccccctcccccctctcgtccacaaaaccctctttctttaccaaccccccaacccctcgtccccctcccgcctcccaccttctcgcggttccagcctccgcgcgcgctccctcgtcctcccccaatggcgtccgcggccgcgccgaccacgtcctcgctctccctcgccgccaggcgcgccgcggcggtggggcccgccgccgcgtcgccgctacggcgcggggggctggcggccgggtgccagccggcgcggtcgctggcgttcgcggcggccgcggacccgcggctggcgacccacgtcgcgtcgcggtgccggcaggcggcgtcgtcgtcctcgcgcgggacgcgcgccgtcgccaccatggcgaagaagagcgtcggggacctcaccgccgccgacctcgaggggaagcgcgtgttcgtgcgcgccgacctcaacgtcccgctcgacgacaaccagaacatcaccgacgacacccgtgtccgcgccgccatccccaccatccagtaccttatcaagaacggtgccaaggtcatcctctccagccacctggtaaagcctccgtccctcatctttttcctcaatgtaacgctacttgtcacagatatacaatgcaggatctcagaacctgcgggatgccagtcgctgtgatctcatctgattccatgggatgattgttgtgcatagtgtcttattaggcacgaatttttcttgttgtgctgtttgaaaggctaaaattggttatcaaatgttgttgcaaataatctagcaaagtaatatgtgaccaatctttttactcgttgcatatgaatcaattgtgatcttattcgttttctcctataaatgtgcagggtcgcccaaagggtgttactcccaagtttagcttggctccccttgtaccgcgattgtctgaacttctcggcatacaggtttctgcgttactgttatttctaattgaatctttacgggctaatttgatcacactgattaaaccatatttgtattcgcaaacaggtgactaaggcagaagatgttattggaccagatgttgagaaattggtatctgaattgccaaatggtagtgttttgctccttgaaaatgttagattttacaaggaagaggagaagaatgacccagagtttgccaagaagcttgcctccttagcagatctctatgtcaatgatgcattcggaacagcccacagagcacatgcatcaactgagggagttaccaagtttttaaagccttctgtcgcaggattccttttgcagaaggttactaccgtttcaccttacattttcaagtctgatgcttgaaatttttgaaagctatacctagaccagaaattttagagtaccctttcttttctttcaaaaacaatataaagttctgagcctcaatgtttatcattaatttaaatcacaggagcttgactaccttgttggagctgtttcaagccctaaacgcccatttgctgccatcgtgggtggttcaaaggtgtcatccaagattggggttatcgaatcccttttggagaaatgtgatatccttcttctaggtggtggtatgatcttcacattttacaaggcacaaggactctctgttggttcttccttggttgaggaagacaaacttgagcttgcaacatctctccttgcaaaggcaaaagaaaaggtgtctcccttctgttgccatctgacgttatcattgctgataagtttgctcctgatgctaacagccaggtctgttatgttttattcttttgtaatcactgatgatgattatcatagatattgtctagtcgataacttgatatagagcagctcaaagtttggtgaagtgatatactggacctgaccttgactttgaattgttctacaggttgttccagcatctgctattcctgatggttggatgggtctggatattggtccagattcagtcgcgtcattcagctctaccctggaaacaacacagacagtcatttggaatggacctatgggtgtcttcgaatttgacaagtttgcagtaggaactgaggtgatggcctgtgccaatgctctcattcggtttgattacagatggaattgccaaaacaaacttaacggaattgcgaaaa

SEQ ID NO: 73121 - DNA, 756 bp, Oryza sativa
caaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctcggtccgccccagtcgaaaacagttgtttaattttatttctcctttcacaaatcatgtcatcaacatcatggcaatgtggcgctcatgtctccacgtgccgcatctcaattaccttcccaaaagtaattgcccaagcatatagcatttgataaatatgagtatgcatgattctagtatagcatttctaagcaattgtcataattgactagggactcatacgtaatcaggggtacaaggattttaagggtttttaagcaataaataaggcaccgtattatcacaagtaggacgttcatcatttgcatgcaattttatt

SEQ ID NO: 73122 - DNA, 1397 bp, Oryza sativa
atctggtctttcttttcttgccggcatcggctggttctctaataagcccttggagaagagctaaagtcttgggggcattatagccgatgacggggggagatggcccacctctgttggggatcagtcctggggcatactcgatatccctgccgctgttgctttggtgagggggagaggattctgttgtctgcaaatcaggaggaaagttagctaaggactaatcaaccaagtagttattcaaataaaatcaagtgagttaggatttacttgaggaagaatatctggaaagagatctgtcatatacatggaagccgattgatggaataagtgtagcttccattcagtccaccatctgtcaaatgctttgctcctaaaggttgccagctttgtggtgtcaatgctgcctagaggaggtccttggagattgagcagccgatccatcattaaagatgatgagatttctcctcggcattggatcttatcggcaaagaataagccgattaggaggttgcccattccaaattgtctggcagaactcattggatgataaaactcgtaggaaacttggatgtttctcccttgatgaatgccgactggaaggatgcatggggtgattgcagataagaagatttttctgggcttttgatatctgtcattgttgatgtcttcaaatctgaagtcccatggattttccagaagtgttgagtctccatagagaaaccaaactcgagcatccttttggaacccctcataaaagttgcaaaaccagtctttgagcagctcagccgatagttttgctcctgcatcagttggtgtagaggcgtactctccatatgatgtgcatctccgatgagtgagttcttctccgtcatcgttgacagtcggctctaatcttgggaattcagtttctgttatagatggccgattgacgaacctcatgactaccaagtttagccaggattgcagcagccaccatggtccacccgctccgactactgagctgacaattagcttagccgatgcattattcagcatttggtacaagtagctgaggagtattttgcctaaaggaaattgtccttttgtctccaaagcttcggctatgaactaccaattggttgtaggaccgcagctagacccacaaaagagaaacttttctaaccacattaacaggaaagccacatgttctcggggggtaactggaccctagcccatatatgctgctacatagcctaaccagctgcctatgctcttggtcttgaagtcatattggttctttgtattcaaactcatagggttggccgatgaggtgacatccagacccgtgatcatgctgatatctatgagagttggggtcatcagcccttgattaaacaaaaatgcattgatggtgtttg

SEQ ID NO: 73123 - DNA, 9636 bp, Oryza sativa
  unsure (1)..(9636): unsure at all n locations
atgcggcagcggcgcggggcgcgagtcgacaacgcgatggcgaacggggcgcggggcgcggggtgtgagccggcgcgcggggcgcaaggcgacggtacgggtcgacagcggcgacacgacagacgcgcggcgtggcgacgggacggtcgcgcggcgatggaatgggcgggcgacgcggcgcgggacggcgatgcgcggtgacggctatgcgtcggatggcgtggcaacgggacgggcgcgcggcggccggtgatggcgacgagcgggcggctcggcacggggctcggcgtggcgacgacggcgacgcgacgggcgagcggtgcggcagcgggatggcgatggggacggcttggcagcggcggcgcgcggctcggagcgacgatgggacgcgcgcggcgacgggacgggtggtgacggggcggcagcggtggtgcgcggcacgaggagggatgcgatggtgacggccgagcggcgcgcggcgcggcaggcgacagcggcacggcggcgggtggcgacggcgatggctcggggcgcgaggcgcgcatggcaggggaggggaaggggctagggaacacggtcgagcacgtggcggccgatgaacagtgccctttttccattaaaccgattttagagtatttcccatataaatttgatttcacaattcctaattttacatatatgcattttacttaatattcgtgttatcttaactaatgaattcaccctagattaatattactcatattttatttttatataatttatttgagctttaattagggttaattcttattccatcgcaatgaaatataattgatccaaatatggtcgcgataatattttatttattactatccacacctaatctttatttttaatttatatttattttaccaatttgtttttaaggtttatttctaattaactattctttactcacgattaataatcctcgagatcaactccagataaaatagacgaataagatcggcatgatgcaattagtttaaaaagtttttgaaaatccatatttttagagtttttgttttgtcggtcgaattttcagggtgttacaaacctaccccccttaaataaatctcgtcccgagatttcttaccagtcttcgaataggtgcgggtattccgtcctcaaaaattcttcactttcccaggtggcttcctcctcagtgtgattgctccattgtaccttgtacatacgccacactttgctcctagtcctctttgcggcttcatccaatatccggatcgggtgttctggatatgtgagatcattgctaatgtgaacctcttccagcggagcttgctcttccggcactcgtaaacatttctttagctgagacacatggaagactgggtgcacatccgcgatattctctggtaactgtaactgatatgcaacttctcctcgcctggcgatgatctggaatggtcccacatatcttggtgccagttttcctttgaccttaaacctttttgttcccctcatcggagaaacctttagataaatgtaatctccctccttaaattccaggtttcttcttcgggtgtcggcgtaactcttttgtcgtgattgtgctatttttagacggtcgcggatcaagcgaaccttttcttcggcctcttgaataatgtcaggtccaaataccgcccgttctcccgtctcggaccacattagcggggtacgacatcgtcgaccaaacaacgcctcgttgggtgacatctttaggcttgcttgaaagctgttgttgtaggagaattcggcgtagggcaaacatctctcccaatccttgctaaaatccagagcacaagccctcagcatgtcttccaggacctggttggttctctccgtctggccatctgtctgtggatgataagctgtgctaaatgcgagataacttcctagggcttcatggactttctcccagaaatgtgaggtaaattgtgtgccccgatcagatataattttctttggtacaccatgaagacatactatcctggtcatgtataactcggctagcttagcactgctataatttgtcttaacgggaatgaatctcgccgtcnnnnnnnnnnnnnnnnnnnnnnnnnaaatggaatcatatcctgttgcggttttgggcaatccaacaataaagtccatacctatctcatcccatttccattcgggaatcctgagaggttgcaacaaacctgccggcctctggtgttcagccttcaccttctggcatacgtcacagagtgctacgtattcggccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttcctcgttgtccttctgggcttcttctatttgggttctcaaaagaggttgaatgtccagggtgtttatctgtccacggggtactatatgtaggttcagctgagctatttcctccctaagctcagggaccatcccttccattctcagatgattgcaatggatcttacgactcagagcgtcggccacaacgtttgctttgcctgggtgataatgaacctctaaatcatagtccttgattaactctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcatgggtagggtagttttcctcatgtggtcgcaattgtcgcgacgcataggccaccacttttccgtcctgcatcagtactcctcctagtccttgcctcgacgcatcacaatatataacaaagtctttcctgatgtcgggaagaactaaaataggtgccgaggtcagcttttctttaagctgttcaaagctttcctgacattgttctgaccatacaaacttcttttccttcttgagtagttgtgtcatcggtcgggctatcttagagaacccttcaatgaaccttcggtagtatctagccaagcctagaaaactccgaatctcagtcacagatttgggtgctttccattccgtgacagcctccactttagcaggatccactgctactccaccggccgagattacgtggcctagaaaagcgacttcttttaaccagaactcgcacttgctgaattttgcatataacttatgcttccgaagtttctggagaaccaatcgtaagtgttccgcatgttcttcctcatctttggagtagatcagaatgtcatcaatgaataccaccacaaacttatccaagtattccatgaatactttgttcataagattcatgaagtatgctggggcattggttagaccaaacgacattactgtgaattcatacaacccatagcgtgttgaaaacgcggttttggggatatcctcggtcctaatcttcagttggtggtatcctgatcgaaggtctatctttgaaaacaccttagctcccttaagttggtcgaagaggttactcaatccgtggtagtggatacttatttttgatagttacttcgttcagtgatcggtagtctacacacattctcatgctaccgtctttctttttaacaaacaacacttgggctccccaaggtgacgaactggggcgtacaaatcccttctcttgcaactccctgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgcactattggcattccctttaggggtagcatggtaaatatacctccggcacgttcggttagcctaggatcttgatccatggttgctctcatatccgatccccagggtgtggtcagggtaacttctctacgtctacagtcaattactcctctatgctttgctaaccaatccatacccaaaatgacatcaagagtttggggtattagcaccataagattggagggaaataccacatccctaaggcggatgggtacgtcaatgcaagctgtatccactgctatctcacccccaggtgaatgtactaacattggttgtcttaatttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcagctcgaacatggttcacttgcccgcgtccaaatccggtagcggtcctgttagtctgcggagtcctgaatagacctcgtccagcagcaggggtagcagtaccgtgaatagccgttgcattagctccggtacgaatgggtgtcttgtttggatgaggacatttattagcgaaatgcccatactctccacagttgaagcagctccctggccttactgatccagtggcggcctgattcggtgtaggagcgcggttctgaatggtaaccggcctgtggaaattgctggaggcggcaggtcgactggttgtcaccactgttggtctccatgctgagggggttgtccctttagaacgctggggggcggtctgaggcgggcggttcatggcaagcctccttttacgattgtgctccactaccttccggtcgttctccagcctgacgaccttattgattaagctctggaaactatcgtggtcttgtccaatcatgggcccgcgtaactcgtcattcaagccttcaatgaatttgtcgatcttttcctcttcgtcggcaagatctctagttgcgtagcgcgccagctgagtgaaacggttcaggtactcttgtactgtggtattcccttgccgtagtttcctgaactcgttcttcttcatccgcatcaccgcggcaggcacaaagttgtcacggaaggctgtggtaaattcctcccagtttggttctccagcatcttcttctcgggcttctttgtacgtgtcccaccaatctccggctggtccttccaattggtttgccgcaaagatcaccttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggttgccttggttgctcgcgatagcttgcagaagttgagtttgggtggccataattccggccagagtgtttaagtcgggtgtctgagtttcgtcattgctggttgttgcccgacgtcggcttgccatctgtgtaggttgatggagtaagcatcctaattttctaactagctcctatggctttatcccattaagggagttgtgtcgatatgaactttgtttcgcaagcatggtggaataaactcatttacaacacaacaacaatagatatcataaataacatcacagagtttcacaaatggtacataaatcatgatgcaattgactgcatatatacgcagtccaaataaggttcatccaaacgatacatcaaaccaatcatcaaactactcgtcaatctaggtaagggaagggggtgtctcgcatactatccaaaaaccatctgatacgagatcgaagctgcaaggagtccgtcagtctagtcctccagccatccgcaggatcccggggcaggtagagggtggtcgctggctcgcgcaaaccggagtccccactgctcaggggtagtggcctctggatctggcttaggcctcttgcccgggggtcgtgtgctcttgcgagcagtgctgagggtgcgagggcctccgaggaagctgatgcggggaacaggggtctcatcctctgaaggatcagtgatgtctggctcgatctcaggctcggcgtcggtcccctctgtctcggagtctatctggatcggagtctccaaaccgaaacccagctgcggagaaggtgtagggatcagtggagtgtgcaccaactccggaacaggtggctgtgccgctgtagggtccactaggtagggcgctgactcggtagctagcatactagcctctcccagaagagcgtggaacgccggtgggtacggcggggtgaggaagaagtagcggtcacggcctactgctgtggaagtagaagcccctgtagtgctgatcttggctgcttgaagctgctcctccagctagctgacgtgctcctgactctctctcagctgctcctcaagagtatccatcatcccgcggcgatcgttgtactggtcggataactgctggaactgatcgccgtggacctggagctgtgcctttagtgagtctatctcactgccccaagcctggtgctcctcctccaactgaagctgctgtgctgtgaggtcggtcacctcagtctctaactcccccacacgtctctggtggtcgtcaatctccaacagagcctcctcgtagtagtcatctactgcctcagcccatcgtgacaaccgtgtcaccatcgggttgtagcagcagggcatgtcctgaactgtgcaaactgagttgccctcctcccggaacgggtgatgagcaaactcggtactcactaactcagctcggtggatagagctgagtcggaggaagaccttccgggcggcatcctgcatcgcggtctctggcaggtctcggtggtgacgtgtctggaagctgtagtccaactcgaaagggactcgggggtgaatctcgacccgagccctcccaaactgagccacactgtctcactcggtatgacgggaacccagggtatcgcagacgcctcaacatccgatgcagctcaatgacatacccctctgattgaggtaagctcaactcccaggtagcgggtgaatccgaatctgccatctaattttaagaaaaacccaaggtcagttgagagtaaaacttgttttgtaaagggaatagttaagagtaagatgaaaagtgtaccgagttttgtaaacatagagtttttatttttgaaattattgctaaatgggaatttctcccttggccaacttagaaaaggggtggggcgccttttggtcttttcctacagtcgtatggctctgataccagctctgtggacccccgtttttataacaggaatcaatcgtgtaaacagtaccatttccctggatcaagtagtttggtacacacgaattcatagctgaaatatcaagtgcacatacacgagtgtctgatacgaattattacatcacaggcccgcatgcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgataataggcatagggatcctccgaggcttcatctcccacttctgataaattttatattcgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggatgtccaccttcccgcctctcaggaagtggctccaacagcataaaattcatcatgcaataacccctcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaagtaattgcccaagcatatagcatttgataaatatgagtatgcatgattctagtatagcatttctaagcaattgtcataattgactagggactcatacgtaatcaggggtacaaggattttaagggtttctaagcaatcctcttttcttttcttttctttcttttcttttctttctctcctccctcccggcttctttctcccttcctctcctttctttttcctctttcttttcttttctttcttttcttttctttctctcctccctcccggcttctttctcccttcctctcctttcactccctcggtttctctctttctctctcggctctttgcctccccgggcggtgacggcgttgggcgcgaggtgaaagggggcggggaggacggctcaccggcggcggcggtggtggtgacgatggcgacggcggcgcaaggcggcgacgcacggcgcggcggctccggggcgacggcgcggcggcttctaaggtggcggcgcggcggcacgataacggcggcgcggcggcgtggaggcggcggctcagtggagaggggagaggggaggaagggtgaaatggggtgggggataatggagagagagggggggtatttgtagagaggggagaagcggcggggcttgggcggcgcgcggctcggtgtgacgcgatggcgacgcgatgatgacgcgatgcggcagcggcgcaggacgcgaggcggcgacgcgatggcgagcggggcgcggggcgcggggtgcgagacggcgcgcggggcgcaaggcgacgggacggggcgacagcggcgacacgacaggcgcgcggcgtggcgacgggacggtcgcgcggcgatggaataggcgggcgacgcggcgcgggacggcgatgcgcggtgacggctatg

SEQ ID NO: 73124 - DNA, 3984 bp, Oryza sativa
gtccttggagattgagcagccgatccatcattaaagatgatgagatttctcctcggcattggatcttatcggcaaagaataagccgattaggaggttgcccattccaaattgtctggcagaactcattggatgataaaactcgtaggaaacttggatgtttctcccttgatgaatgccgactggaaggatgcatggggtgattgcagataagaagatttttctgggcttttgatatctgtcattgttgatgtcttcaaatctgaagtcccatggattttccagaagtgttgagtctccatagagaaaccaaactcgagcatccttttggaacccctcataaaagttgcaaaaccagtctttgagcagctcagccgatagttttgctcctgcatcagttggtgtagaggcgtactctccatatgatgtgcatctccgatgagtgagttcttctccgtcatcgttgacagtcggctctaatcttgggaattcagtttctgttatagatggccgattgacgaacctcatgactaccaagtttagccaggattgcagcagccaccatggtccacccgctccgactactgagctgacaattagcttagccgatgcattattcagcatttggtacaagtagctgaggagtattttgcctaaaggaaattgtccttttgtctccaaagcttcggctatgaactaccaattggttgtaggaccgcagctagacccacaaaagagaaacttttctaaccacattaacaggaaagccacatgttctcggggggtaactggaccctagcccatatatgctgctacatagcctaaccagctgcctatgctcttggtcttgaagtcatattggttctttgtattcaaactcatagggttggccgatgaggtgacatccagacccgtgatcatgctgatatctatgagagttggggtcatcagcccttgattaaacaaaaatgcattgatggtgtttgaccagaagtaagaagcagctgccatcaagggttcatctttggccgagtttgctatagtgaggtcaagtgcttggccgattccaatttcatcccagtgaacccttttgcttgctgatacatgtttgaaccatgtggtccaacttttctcgggtggaactttctctagagacggccaagatttgaaggtattcttccagtgacctagatctggattggttaatctgaagggaatcctattggtttcaccaatgataaactcagtgggatcaggattgctaactgggccgagaaagtagtagttttcgtgtgataggcttggaatcgcaactaggttggagagatgctacaaatccaaaacaaccgagaaaaagagagcgatataagacaagaggaaatcgatctgctgctaagaaaggggatctagccaacgaggacttatctcagcgtactcggctgatggcgcatcagatgggttggtggaggacgacatcgctgcgggtggaaatctcgccgaagatgaagtcgcctggaaatcgctattgcgtcggagagatcgccggagagagagaggacaaagtatcgcttgagcggtgaaaacaaaagtcacggcgtgagatttcttgagggcaacggttagtatttaaagcgatagaataacggtcgaaaaacggcggaatgcgaaacttgctcggaatcggtacacggcaaatccggaacattatcaaatatcctggacttggggggcatgtgttagcgaccaaatttggtaatatcagcatcggaagtgaagatgagatcgaagcggaatctgagataaggaatgctgcgggaatagagtaagaatcagctggagtccaaatcggctatgaccagaatcggctgaatccgaatcatacattcgaatgcgagctttggacctgtactagagttaagcagatctcccaggcctcgtgttttctgtgaacaggcggcgaagggaggtccggttaaaaagatctccaaaaagaaaggactcgtcgatgtcgctcgtgttttcagcgacgacaagtcttctgacgggactcagacttcgcccgccgaccgtagcttgcacctttcgaccgctcccattcttccgctcgatgctggcggagaaggtggtagcactgccatcggggctttagcctccgccgatcggatcgtcacggctgcggcgagggttatcggtagccccctgcgtcagccggttgtttcgccgctggtctaggcgaaggggaaggaggctgccgtcgaaacatctacctcggagtactccctcgcggggccccacttcgcccctggcgatttcgagtcccgggcggagcttattcccttcgtcgagggagtaagcaatcttgtcttacctgctagcaccccgagtctattcaccgagttgaacgagttcgatgaagggtgttccgctatcaaaagcttggcggttcgggtacgcctcttcgctctcttttttatcttcctctccttttttacatgtcccataattaacattttcgctcttcttggatccagattctcgcggcccactgttcgacagagtgaattgtgcggggtcgtcttgacggatttaagaaccgtcttcgggccaaggatgagaaaataggccgcaagagtttggagatggaggcccttgccaataccctcatagaggcgaaggccgaaaacaagcgtctctagaccgaattggagaaaggaaaagaggctagggccgagatcgatcgcctcaaggccaaactggagaaggaaaaagcccattctgccgcgctgaccgattattacaaccttaccgagccgaagatggaagctcttcgtctggaggtcagcaaggccgaggcgagcgctgtggaggagtcacggtggttttcgcgggagatggcgaaagccaccgaatccgcaaggacggcgtgccaaacgctccgccttgcccttactgacatggcagcaagggtgcgaggagtccccgccgaagacgcctcagccttcaacttctccgagtagacccagcaggatgatggtgcggtttcggactatgccactgcgtacggcgattgctatgagcgcgtatcggcggccttcactatgggccttctgcagcagttcggctatgagcacgtcgccgagttccctaactacacgaagggggactgggagattagtgcacataacgtttcgcccgcgctccgttcgtggcgaaagcagttctggcagaaggacggccgatccaccgccaaggcgcgccttctagagcaactggcgaaggcagaggcagcagaccggtgcgaagaagaggacgcggcagccgaagggggtggaggcgatacctaggatcacccagaggtgtgaggccctccgccctttccttagattttcgtagttttccttcttctttttctatttgctgggaaagatgtaaattctttttgtagccgaaaaggccccttggatatttggaatgtatgactcaatcttagccacttcttatggtcgatgccttcggcgtatatgactacgtcactttcgcattatgtaatattcgctcttttttcgcccgttcttactatgcacttcgtcttttgccctttctgcattgtctaccagggtgttcgccaaaaattgtgcattcggcccccttctgggagttggcaaagaaaaaacgagaaatttgtggcgttgaagggtttgccgaaggtacgatgcccatttcagcctgtttatcgcgaaatggtaataaacggccatagctataaggtttctaaggttgccggctggctgcgagcgcaccccgggcgaaccttagaagactacgatcatgttcatacaagacgtttggaggatgtggttcgtttttggcgaaaccatcagaagactgatcggcaggaggcaatctcccagcgtcgttacagtctagtctgtgtttcgcccccttctcctcttagggtcgtgtatgatattagtagtgatgacgaa

SEQ ID NO: 73125 - DNA, 9721 bp, Oryza sativa
ctctttcaatcgggccaagaagtagaagcccagccaaaagtctagtttgcatccctgctacagtggcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaaaaatcggagctaatcgttgagtatcttgcccgaatcgaactcgttttcgagtttatctccaaaacggagtttttgatttcccggatcgatttcttgcgggaggagtccgatctcttcaatccaaggaccccctagtcctcctctttcgtttgccccctctcccgagctctctcgtcaaccgtagagccgccgccacgacgtcttagccgccgccgtcgccggccgacgaacagccgcctcgcgccgtcgttttggccgtcgccgccgcctcctctcgccgccgtcgggtgcgcgtggaagaggggaagctcggccgccccctccccaccgtcgccggtcaccggagagtcgccgccgccgacgaccgagtcgccgccgtcgcctcctctcgtcgccgaccgtcgtccgacgtcgttcgtcgcgttggtgagtatcgttgggttcgtctcgtcgtcctctgcgtgtaggtgtcctccaaatccgcagccggccgctctatctccggcgaggtcgccaccgtggttcggccgccatggatgatgtcagcatgacatcatcatcctttctttttcccttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagccttcccgttgaggaaggttccgaagcgtttgcggaagcccaaggcaagtcacacagatcccaaacaaccctttgagcatgttgaacccgtttaaagctattattttatttcaactatgcattatttttgaatgtcatcgggtggtgaacctttccccgttaattaatggccaaagatgatcttatttttcctatgggttataatttgattagcatgaaccttatatattggattggttcagctaaatgctatatgtaagtttgcttagccatgcttagaaacattagctaactaaaggggttaattataaactatattatattatatcattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgtagtgaaacatttaccgtgccaaccacaagccagcgtgggcaacggctttaccttttgtatagcatgattcattacggagtgccagactgagaagcggcgagaagtccgcgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgattagagtttaatctattcgaatagccgtacccgcggttatgggtgagttgagcaatgtttttcgtgattagtctcacacctttcacaataattatggatgttataactggtaataatttgcttagctcctggtttggagttagatctgtacagccgggtatggttgttcaggatggttgggcctgtgcagcatgggtgtgctgttcagtgttgattaaaattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcacctgaagataaaggatccagaaggagaagacgtttggcttatacccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgtacaaattagttcggaaattactagtgaatttccgagcgtgacaatattgaatcccagtttataaaattattttgatttaaattattgcattatcgcttcatttaaattcccgcgttatcactgttttatttagccatgcctacttacctttgttatgaccttattattattgttattgttattattaccttgttcaccttagaataaacaataccccaactagtgggtactctatttatggttccactagtatgaatttaggtagatgtttcgctgattaattaggcaacattaggtggttttataactttagactttgggaattctcatatcatttggacagtatggaatggttggcttatgttggaattggacacacacctccccctcttttcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagttggacgaagtcgggggtcgatggacatctctaggacaaatgaaggctacacaagctgcggcccggtagtcgagatgtcatggcacagggctggtgtcctaatgctaggggctcaatcctgcctgcctgtcccggaggttccggccgtaggtggggttgggtcggtactcttgtttatggctaggatgggttgggaactatgtcacgtctttcgtccgtatgccgtggtggtatgtggcacgtgattacacgtgaggaagacgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatggttggtgtcgcgaccgagaaaattgccttatcctgaacgctagtgtattaatccccgtcccaggaaaagccggggtacaccaaacaaacatgatacaaagggaacatctttaatacatcgataatatttacattattacaaaggcacttcaggcctgacaatcaaaaataaatagcagcggactagcaggcctacggctccatcttcacaggcgctcaactggggtataagccaggactccacctaagacttcttctccaaagcttttcttactgaagggggggaaagatagagcaagaatgagtacaaccacagtactcagcaagccacaccgggagatgcatgattaatgcaagggggtacaaggggtaataataagggttaagttttgcagaaaacggcatttaaaagacacttagttactcaaagctattttgtaaacacgatcctagagctacacaatattattaatcaaggccgtggacccacacgaacctgccttaacccaaggcctacgatgattcagaccgaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaatagatgtactctgatcagaggtgtacatctttacccacaagacacatccttactccgcattccatggccttggaacccgtcgtaaacatgtgacataacccttcacctatcctagccgtgaacaaaagtaccgacccaaccctgcctacggccggtatcccgggataggcaggccaggattgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgttcaggactagactgagcaccgagttaagccttatccattagacatgtggttagtacggtagtgctttgcaacagaggcccgagcttaatccttatattggccggggtgctacttcccacatctggcatgcacccaaaccccaccggaaaacaggttttaggggttttgaaagaggaagaggggtatgtccaattccaccataagccaaccattccacagtgtccaaatgatatgagaattcccaaagtctaaagttataaaaccacctaatgttgcctaattagtcggcgaagcatctacctaaattcatactagtggaaccgttaatagagtacccactagttggggttttgtttatcctagggtgaacaaggtaataataaacaatagcaatgataaggacataacagggattaataggaagtgctaaataaaacagtgataacgcgggaatttaaataaagcggtaatgcaataatttaaaccaaaataattttataaactaggattcaatatgctcaagggtgatgtgacttgccttgctcagagagaacggccttccgaaccttcggcgacgaccgcgaaccacgcttcgagaaccttcggaacgacagaagctacgcgaagcacacaagcaaagctacaagcctataaagaagcaataacaatacataaaaagaaagcacacggttctttatgttataacaaacattaagagacttgaacgggtcgattcggagcccgtatgaccaagacatggtcatccgaagtttaatgctgttatatatggagatttgcggattattataattaggttttgcaactataaaacatgtgtaagcgctagcctggaaaagacaggaaggctgcgccgttgacatgcggaccccacatgtcaacctaaaggatcgcggtagaccgagaacacagagacggtccacgggtcgacggaagcgaaccccgtgtgtcaaccgaggcgagtggccgacaaacggactccactagacaccacacggcctgcacacgtggaaaccacgcggctaccgagcgggcacactgacacggtcaccacacgcacaagcgaacgactaccgcacaacgggcatgggcgacaccgaaaggacgaggacggggcagcgagaggacggacccttagcaccctgcgacgaggcgagggaacgacaacgacgaacgggcgcggcggagacggctcggggacgacggaggcgaacgacgagggaacgacttcggcggcgatccttgaacgaaggcgagacacggccggcatgaggcttgacgacgcggaggcgaggacgaagatgacgacggggctgcagcggctcgcttgacgaaccacgggcgacgaacgcgatcggcttgacggagggacgaacgccacgacgaccgggaacgacgggaggacgacgaggacagccggtagcggttgcacggagacgaggatggcgtggaacacgccgctgcgatgccgacgacggaggcggcgccgcgagacgacgagccggcgaggatgaacggtgaagacgatgacagacaccggcggtgttcggccgaaggggaagcgatgccgaggacgacgtcgcggctgtgatgccgaaggtggagacggcgacgtcggccggcgcacgggcacggcggaagaggctgccgaaggcgacgttgtcgaggaggaaggagaggccggcgcggcggcagcggtgttccggcgaaaccgaggagcagccggaggagaggacgacgctgcgacgtcgacggaggagacggcgacgtcggtcggcgtaccggcgacgaacagcagccggccagagacgatgtagtggcggcgacgccactggacgctggcgggggcgcgtctccggcaatttcccaacgaatcggaggcagcgccggcgaagaggaggcggctgcgacgccggggaaggcgacggcacagccggacggcgcttgggcgaggagggagaggcggctggaggcggccggcgcgggggaaagagaagggcaatagcggggaggggtggtgagtccacgggagaacgcggaaggggactaaacggcggatggggattccattttataggagaggggagggagccgggcatgggagaggacggaacggcgacgggaaacacggccggcggcaatggttggtggccgggaaaggcgcggccgttcccgacgattgggggcgccattcaagggggaaaacgggggaaatcaaagaggatggaaaggggattaaaagcccccacttaatttgaaaataagggaattgattcgtgcggatttgagggaggaagaaactagggttcacgggagagagagagaagctgggcgggaggaagacgacgacctggcgcgtggggcccacgcgggcgcgcggtcaacgcgtggcaacggcgtgctcgcgcacgtgcacggcacgggaaggaggcgcggttcggcctagaggggggggcgcggcttgggccgggcggccggcccaggaggagaggagggagaggcagcccgggagggagagggaggaggagggagtgggccggtagggggaggggaagaggtgggccgggaggaggaggagaggcccgggagaagagggaaagagagggagagggagactttgggctgggcttggcccaaaggaggaaggaggattatttttaagttttctttttaataaactttgatcatagttgttgttgcttaataaatatttccggtgctctgaaaattcaagtaaaatttgagggctcattttagaccaaggagaatttaacgaaaattctctgggctacattcgaaattttcttgtatgtattttagtgtttgccaatttctttttgaattttaattaattctattattccttttagaaaatgatttttatttcgggatgaatttatcaggacgtgacagttggcctgggttggcttgggacgagctaggactcagggtcgggttgccagttcggtctgaatcatcgtaggccttgggttaaggcaggttcgtgagggttcacggccttgattaataacactgtgtagctctaggattgtctttataaaatggctttgggcaactaagtgacttttaaaagttgtttactacaaaacttaacccctatattattaccccttgtacccccttgcattaatcatgcatctgccagagtggcttgctgagtactgtggttgtactcattcttgctcaatcttcccccccttcagtaagagaagctttggagaagaagtcttaggtggagtcctggcttataccccagttgagcgcctgttaagatggagccgtaggcccgctagtccactgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaatgcaaattttctcggtcgcgacaggttcaatcacgattgcgagcccttgcaaaggttaccaaggataaggaacgtgttgctcggcattacaagaagaaagtggtacccaaagatttttcggaaggtgaacttgtatggaaattgattttgccgattgggactcgtgatagtaaattcggcaagtggtcgccgaattgggaaggaccgttccaaatttataaggttgtgtctgagggagcatatatgttgcaagggcttgatggtgaagtctatggacgagcgctcaatggcaagtacttgaagaaatattacccaagtttttgggttaatgcatgatcggctagtattgccgatgcaagacagccgatgtgtttacatcgccttgagatggccgttatggttatatcacccttagttgttcttttcatggtataatcggttgtggtttgccgatgtataatgctcgatattgttatatcgcccttagttgtttttataattttatcaatgcttttgacattgtaaaattaggtgggcacatatgtatcaaaatgcaaaatttttataatgtgagcgaatttcaaagtcatcggcacaaaggattgtcaagatagtaaagtactagagcatcttagccgattacaaagatttctaagtcctattacacaaaagatattgagacaagtaccactggatagccaaaatagccctttgcctaatttgttctacttcttcaatagcttgggcatcttgagcatcagttctagaaatgaccttcagggacttggttaggtcagcaacattcttgatagccgatttgagccttgctttttgctgttctacagattttgggagatcggctagctttttgtgctccatatctagttcagcattgcattcttcaagttgtgccaagagattgatcttgcgggcttcaagccgatcaatattggatttgatcggaccttcggatagctgatcgagtttgactttttcttcatgcacaagctgccgattgacctggattgcggcttcaatctccttgtgctcacggcattcggataatcttagcttggctttctccagtttaaattgatgctgctcaagataagcagctggagttaggacatcggccagttcttcgggaattagagcttgaacttcgtgcaattgtgccctaatcgatccacagtccaccactaagctatctagagaagaggcctctagccgacgcgagatgtcttaaagtgttttctttgcattatcagataagggagctagagctttgcttgaagtatctttttctgcctcatcaagataatctctgatatcaaaatagaagagatcggctagaacctataggtataagttcagaaagtttgagagctaagccaatatagccgatctaaattcttgcatcaaaggaaaacttactgggatagcaggagcagctggttgttcttcttccacaatatgatgactccctacagccgatggagttcggtcactcaatgattgttgtacaggggaagaaggaggaggaggaagctgtaaaaagacaagtgttagacaaaatcggctagaattgactagtaaaattgagagtgtcttactagtggagctggtttgagaattggtgctgccgatgttttctttatagcagttttcttcttctataatcacaaagcctatgagtagtcggctgaaaaataataattataaaaagggtttgcaaggaaagatgttttactctgaagaagtgagtgggggcagaaggagttggagg

SEQ ID NO: 73126 - DNA, 7446 bp, Oryza sativa
  unsure (1)..(7446): unsure at all n locations
cgccgttaatgatgacagtcgntcgnacagnagcncattaaactatacaagattaaaatctccaagactggtaaaatacaattttattattttttagggcatatttggaatgttaccgtacaaatattttgtaaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggaacgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcttgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtcgcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggtcttagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtaaaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattacgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgaacttgtgtgccttgagcaacaactctatgtctccgtgcctttttgattttatcttccatgtactttgtcactacgttgccaaacactatgttgttatcggccatggatggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtgcaaaatcgccctagcggagggcggcaagggggcctccctgcataattccatgccccccacttccgcccatttgcaattggccccctttgctgcataccgcttgacattctttttaccgattgggggcctctatcgaattcagcggtgatggttatctagcgtattatcctctaataatttgtgcctactataaagtgtcttactggtctgtacagagcctacgcgcgcatatatctctatacttcggttacattaccgctcatctcgtctttagtcgctttaagattcataaccaccgttcaattgctccttaaatcgctttttaaactcttttatggggacggataaagtggcctaacacgctcactataactccctactaaatcttgattataaaactcg

SEQ ID NO: 73127 - DNA, 1513 bp, Oryza sativa
aggccttcttacaacacattcttgcttgtaatggttagaataagcctggcatatatcgaccggggctaatggtcaatctatggaatgtagcacgataactccagctggtgagaggtgccaaggagctcttgtcttgacggaatgggcaaggtgtgagtcagaccgcctgtcgccactaaaccgcgatctgaccggtctgtgactggtcccagaccggataatcgagtgcattgcactgtatttcgtgcggcgtgacacgtttagccgaaccgcaataaatgcggttaggtgagccatgctgtgctcacctaacccatacacgcggagtagaacccgcgaggggtcggggcgcctcggccctcgggggcgaggcaggagtggtccgacccccccccctcggggagaccaagaggtgggcgcacacatcaccctcgggcccgacgtcccccgagggtgccaggccacgtgggcgattgtgtctgcctcaagcctctaatcatgatactcccggtcccatgtcaccgacagacaggattggctacatgcaggtcgtagaatgccacaaaaggtgctagtaagccacaagggaggtttgctttatatggatgttaaattgttgaatatttaattaaaagccggtatgatgaagagtagttgttttcttaagtataaaatcatgacagtacatagtttgaatatgttctaattgacttctggatttgattctttatctcacgatatgaagatagtaatagtatgaactcgatgcttttgattccaagaggatatatagtatccgaatttcaaatcaactctgaaaatgggggacccctctctgtcggtgacccctctgcaagcgaaaataggcgactccttcattcctctttagccgaccactttgctccatcaattctagtaactcatgctgccggcgacgggggagaggggggggtctaggttgttaggcttttctgtaatagggttttttcctttatatttttgttttcttttagtgcttttgtgtagtgcgagagttcaccggcatcgcatttctcttgtccctgtagctttctatttattcctgccaaaagtccatccatggatggtatttgggtttgccatggacacccccaacgaattttttttatttataattttttttattaaaagttttacaaaaataattttccattttgaaaattaacggaaatagtcgcctaccgccctctgggagggcgatatccatcgtttcattctgatatgtggtcacataattaaaaagtgcgttttctttttttccccgagcaacagggtaaaccgccatcctagcaatatttctctttgtcgccatcaatacagccattcacaggataaggcccctttaatggtgatatctcaattaaaccctgcccagttttattccttatgatatctgcccacgcacaaatgggtggtaaccaccacgcgggaatctaatttttctcccccggtgtcccccagaggaattctctcg

SEQ ID NO: 73128 - DNA, 2136 bp, Oryza sativa
tctactctctgttgaggagctcactaagagttgggtcttagctaaccctttcctcaagaggttgcactaagcactcctccttccactaagggtatctcttccctttcggaggtgagatctgaccatcacaaacttctcccggccaatcacaagtagatcgggggctcgggagcgacacctagccgcctaggagtcctcagcctccaagagtaacaaatgaagcaatgaactcctggagatgatgcaagtgctcacaaatcttcacgaagtcaacaacaagcactcacacaaactcgaatccacaactctcacacacaccaaatccgaatcgaacacgggtgagaggggaaacaagaaagcaaggctcaaaagtgaatctcaacaagagcaagccaagagcacaagaatctccaatgtgaccagcagccctcacaagtgaggggagggggctatttatagccacagcctaaattatgcccgttatgcacaataattgtgattttcagatattccgaaagatttttggacatgtccgaaaattctctttcagacatgtccgaaaattccagctcggcaccgacagtaaagttaactgaagatatttcggacattccgaaaacttttcggacaagtccgaatatttccagaaccaaaaacacccttctggacattttcgaaaagtccgaaaattcctttcggaaaactccgacaatttacagaagcgaaaagactctattgatgtttttcaaaaaatccgaaaatcagttttggacaagtctgaaaatatgcagaaccatatttgccttctcagtcattttcggaaagtccgaaaatgccttttggacatatccgaaaatttccagaagcgaaaaactggctctgtgtattttcggaaagtccgaaaatgaatttcggaaaactccaaaaaaattccagaacacaccaaactaaggagaaacacttttaaaaattgattttgagcactttgatcactcctcgtatgtcaatgcatcatccctcttaatagtgcggctttcctattaactcaaggaaaagaaaaggtacaatatagcatttgctcatttgccgcatcacatcatgtcaatgcattgggtgggaaatgcattactttaactcattgaggacataacaaccttcacatttacgtgaataaaaattttaatcctctctaatcgcattgtaattaatcaccaaaatcactaggggcctagtcgcactttcacaaagacgtggaaatccaagactgcctccttgtcttcaaagcagacaggtacatcttgtacaatcccaaatccttcaataatatttccgttcgggtgtttgaagaatttatttgtcggggttactgccttaacaaggcgcaagtgaagctgggaatgagtcacatcatgatgaaactgaagctgagtgacagtctcgatcatccgcataatgtgaggagcatagaccaaccccttcttgtactgaatggaggccatgcggatctcctcccacacaaagtgcaaaacatgaaagcgatgaggaggggattgaacctgagaagtacggtcctggagaggtggttaatgctgctggcatcaccatccttaggcacaaaggaccggcaaaacatccggttcaagcaggcaaagtacggtttgagaccgtcgactttacccaacaccacattaggatcatttggagtgtaaagagggaggagattagtgttggcaggaatgggaagatcatgcatatcaggaaggtttagcaaggaacagacgtcaaaaccccaaatctcaacaaatcgcggacaggagacataatagtaagagccttgggtcatccaatgcatggcacaataaggatcaaagaaaacggtggcatataattgagcgatgacttcgctgcaccaattctgctgcaaagtcacgaaagagcgaattcccatgagctcacaatttgcaatcacaaagtttagcaccggatcatcatgcgcctgcagctcctcctagttgatccattgcatgggaacggtgggatgagctttggacttgatcacagactcatcaaagtcttgttgaaagagagtccaaaaccgcgaatccgtggcggtgcggcgaagggggcgcggatcct

SEQ ID NO: 73129 - DNA, 30021 bp, Oryza sativa
agccacacgcgcaacctgaggaaccgcatcctctctcccggaccaatcactgtccaaatcatcatgagaggatggggtgggagagcggtccctttggtgcttggacttgtgggaggtttgcttgcgtggaggcatccttcaaacaagatatagacaatgaatcagtgaatggaagccaaagaagcaaggaccaagtaagtgaaggcaagaatcgtgcaaaaccgaggtgataggggtcggccaggaattttcggatatatccggaaacaattttcggattttccggaaaaatccggccgaaccttatcatccggatgcagcacaaatccgccaacaaaaacttgggaaaatgaatctgcaggtcctagggcactaggggaacatctccaccaaagggaatcacaagataaaacttgaggaatcaaaggatttgattttagggcggatacctcaagaacacgaagaacacttgaagaacgcggtgatgatcgacaacgcaagtcccaataagtgccccaaacgcgctcccacaatgttggagaggaggggagccgcgggaggtcgccggagaatggggtcgccggtgcggagtggaggagggagtcaaacccgttgggaaaaagtgaggaagagagagagagagaggagtccacgggtcaaaatatatgagccccgaaattttcggacatttccgaaaattttcggataagtccgaacggatctagaggggaagcacacggttttgatgattttcggatatatccgaaaatttttcggaaagtccgaaaaatcctggaatagcatgaatagaagagcgacaggatgggaaattttcggaaggtccgaaaatttttcggaaagtccgaaaattcctggaaaacacagttttgcaaggggatttcgccgggaattttgatgaaactattttgcaaacatttgaaaggaattttgtaggggacaagcaccgggaaatttttttcaaaaacacatttcacaaagatttttgataggattaggaaaggagggatggtcgagctctagagggtccacttgaacttgtgactagcacccaatcaatcacacaaaccaatagccccaagtcaaatggacaatccgagggatcaaaagagagggaattaccatgagacaagataattcaccctcgagagagggaatgtgtgaatctatttcaagttgtgctacgaccaaaatttgttgaaaaatgagatcccaatacacatagattcaagttctccacaaaagtgactagtgtccatccatgagttgaatgaccattttgtcacaaagtagtatgcaaacctattctaccaagcaaacatgcatgcaatagatcaagccacattccgagaatccaagatatttagttcacttctcaactcacaaaacctaacttcatctagaggcttggtgaagatatccgccaattgtttatcggttctcacatgttggatatctatgtcgcctcttgtggaatgatctctcaagaaatggtggcgaatatcgatatgtttggttcgggagtgttggacggggttgttggctatcttaatggcgctctcattgtcacataggagtgggattttggatacattgaggccatagtctctcaaggtttgcttcacccaaagaagttgagcacaacaactcccccgccgaaacatattccgcttccgtggtggatagggcgacagagttttgcttcttggaagaccaagaaacaacagacctacccaagaattggcaagtacccgatatgcttttactatccactttgcacccggcataatccgcatcggtatagccaatgagatcaagcctcgctcccttaggataccaaagaccatggttaggtgtgtgcactaaatatctaagaattctcttcacggccacaaggtgacactccttcggagcggcttgaaatcttgcacacatgcacacactaagcataatatcgggcctagatgcacaaaggtaaagaagtgagccaatgatggaacggtataccttttggtcgacgtctttaccttgctcgttgaggtcgaggtggccatttgatggcatgggagtgtggattggcttggcattttccatcccaaacttcttgagcatgtccttcaaatactttgtttggcaaatgaaggttccttccttgagttgcttgatttgaaggtcgaggaagaacttcaattcacccatcatggacatctcaaatcgtatggtcatcatcctactaaactcttcactaaaagacttgttagtagaaccaaatataatgttatcgacatatgtttggtagacaaaagtatcattatcatgtctcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatagttcggatcctcgaagcccggtggttgctccacgtataccaactcgttgataggcccgttgaggaaggcgcttttgacatccatttgatatagcttaaaattgaggttactagcaaaagcaagcaatatgcgaatcaactcaagtctagctaccggtgcaaaagtttcaccgaaatctaatccttcgatttgggtgaacccttgcgccactaaccttgccttgttccttattacgaccccggcctcgtcttgcttgttgcggaagatccacttcatgccaatcacgttttgccgaggtcgctccaccaaagtccacacttcattccgggtgaaattgttcagctcctcttgcatcgccatcacccaatccggatcattaaaagattcttccacccttaaaggttaagagaagacacaaacgagtaatgctcacaaaaatttgcaatacgagaatgagtggatactcccttgttgatgtctcctaaaatgttgccggtgggatgatctcgttgaatactttggtggattcttgggcgagctagattgatcagtgagggtggcacttgctcgccttttgttaacaaccaaatttggtaatatcagcattggaaaagaagattagatcgaaacggaatctaagacgaggattgtcgcggaaacagagcaagaatcggcgggagtccggatcggatacgattgagatcagctaagtccgagtcagactgggttaggtgatacagccgattccgacaatacgacttggtgtacgacatcatgtcgagttgatttgtcttccccgccaaaaccttcgccactttccccaccctcagctacaatgcaaaaccacaccagcgaaagctagggctcacaaatccactccaatccatctctctagaacttcacagcttccacaaaatcttccgtgcaaccaccgcatcaacctcccatccattcctcgccacttccaaatcaaatcgcatcatcccacttgcatccatggcagaggagagagagagcttcgaaagtcagtgggcgccctccgatgttacggaggaagatttgaaggagatggtggcgcatggtgttcttccggcgaaggagatcatcgggtggcgtccggcatgcggcgaagcatttccgacccctgacacacatgaggtcgtggtgttctctcatttcttctatgggggcttttctcttccaacctcaagattcttccgggggattctggagttttacgggattagtttgcatcacctaaaccccaattccatagtccatattgccaatttcatccatgcttgcgaggctttcctaggtattagaccgcattttgccctattccgccacatcttcttcctcaagccccagccaaacaagagcaagccatgcattgttgggggagccggttttcaactaaggggaaccttgagccagaaatatttctccatgccctctaaaacctcgaacaagggttggcatgcaaattggttttatgtgcagaatcctgaaccagcgcttcctgagtacacctgtcttcctccagtatatcaagacacctggaacttgcttccaattggagatgaggctgcccaagcactcctccaccggtttgtatctaacatctcggcctctctgaaaaacatccttttgtcttctgcaaggttgattgaaaacttggaatatcatgcataggaattttccttgatgaagtctgatcctccgatcgctcaacaccgctcaccctgtcggcaggctggtcaggctagtggaaggccaaaaatccggtccgatgctcaaccaaacacctcgaagccgactaaccagtcagactctcgtaagaggaaattagttctgagtgacgatgagggtgacgatgttgaaaaggctggcagcaaaggggtgactggaaaacagccaagacaagctaacccgaagaagaaaacatccagtcgtcccataccgaaaatcaggaagtcatccaggtacatgtcacttagcattttctcttgtatcgctaatcattcactattgaagtattgttaatagcatatctcaaatttgcaggaagccttatgacatcgatccttctggaaaagactctgaaccaactggcgcggagactagtcctacgacagaaaccgggccgactgccaaagatcgcctgagtagtaatcaaccagcaaccgacaatgtacaggccagcaatgaacctcgactggaaaccagtcggccgaagctgaagtcagtactgatcaggagcccccgactagaaatcagtcgggtacagaacgaaatgaagacatcccggaagcagaggctcaagcaagcagccctccctaaaaaggtaccaacgccaaccttcagtcctgcctatcttactcaaagccgctatccatatgtaattgatcaatggaaaataatacagtgcaagctaccaagatatccgagctagaaaagcgaatcaaagctctagaaaaagacaagggcgaattgaccaaacaaagggactcggctctgaaagatgtcgaatgtacttgttgctgaaacttcaaaccattcttgtcttcttgcatagtcgttgatgtgaaccatttgcgcagatcgcaaatcaaatctcaagctcaattcgacgtcttggtcaacaaaattaagaagcttgaaggagccggagatgaagttgccaacgccgccacaccactcatccaagccatgtttttcaataataatggtccgagttcttttgatgctgttgaaatcttcgacaagctaagagctgctccagatacatattttaagaacatcaaggaagcgggatgcatgggggctagcctggcattggcaatgaccaagtccttgtacccgaagatcgatattgatgctgtcgacgactttgcagatgggacaagtgaagaacatgcccttgatctcatcaatgatgcacaaaaggctgcagacaagattactgctgatgtagttgagaggtttcaggacaacaatctcgggccgactgggtctggtaattctgatgatgaaaaaactgagtctgatttacattgtatagtattaacttatgatgatggaggcacaatttgtacaatactgatgaatttatgctgtgcttgataatttaaactcagctcctgatttcttaaaagttttcgtcaaaccttattgagcctagaactcgcaaaagttgttaaaaactttcagtcctcattgactaagccaaaagatcaaacaaggcaatgataaatcaagtaagaaaattgaattgataataatcacactccattattattatagtagcccccgactggtaactcaaggaacaacttgatgttagcagtcaaagaggaagatacaaaagtaatgcctaagcataaaaacgacgaagatactcaatattccaagagttgtcaacatgagtatcgtcttcacgcttgagtctgtaagaacctggccgagtaacttcaaaaattatgaacggtccttcccataagggagataacttgtgccgatctcgtgtagtttgaattttccttaaaaccaggtcttcaactgagaaagcccgcgatcgaacattgcggttgtgataacatcgcatcccttgtaaataccgagccgactgaattaaggctgcttcacgggcttcctccagtcggttgagatcatccactcggtcttctccctagcgctcctctttgaagttacgaaatcgtaaagattcgaattctacctcacttggcaacattgcttccgtaccatagactagaaagaacggtgactggcccgtagcccgactgggtgtagtgcacagagaccaaagtacagacggcagctgatctacccatttgccagcgtacggatgcagttggtcgaaaactcgtgctttaattccttgaagtaccataccattggcacgttcgacttgtccattgctcatgggatgcgctacggaggcataacaaattttgatgccgaagtcttcacagaaatctttaaatactccgccagtgaactgagtgccattatcagtgatgatccgattaggtactccaaaccgatgcacgatgttgatgaaaaaatctctagacttgtctgttgtaattgtgatgactggtttggcttcaatccacttggagaatttgtcaaaagctacaaagagatgactgtaaccaccggtagcctttttgaatgggccaacaatgtcgagcccccaaaccgcgaacggccaagataacgggatggtttgcaactcctgagctggtaaatgagtctgtcgggcaaaaaactaacaaccctcacacgttcgaacaattttgtcagcatcggatacagcggtaggccagaaaaaccctgtcgttaggccttaccaacaatagtccgtgcggcagcatgattgccgcagatgcctgaatgtatatctcttaacaattgccttccttcctccaaagacacacagcgttgcaaaatccctgatggacttttcttgtacagctcgatctcatgtatgacgtaaagtttgctgcacctggagatccgctcggctttgtctttatcttgagggagctcttgcttggtcaaaaatttgatgaggggctctctccagtcggattcgatcatgattacttcttgagtgtccgtagcctcggttgtttctttgcttggtacggttggttcataaagatgttcaacaaacacatcggaaggaggtgcttctcgttttgaactgaaattggccaatctgtcagctgccttattgttatgtcgaaaaacatgggttagctcaaggccatcgaacttatcttctaacttgcgtacctcctgccgataagcagtcaaggcaggaccactctttcatgacttgattaacaaccaactaagaatctccacgaactattagatgctgaattcccaaagatatcgcgatccttaatccgtgatgaagcacctcatattccgccatgttatgggacgcagaaaaatatatccacaatacgtaactcagcctttctccagtcggggaaatcaggacaacacctgctccggtgcctaaaagcctctttgactcgtcaaaatgcatggtccaatactccatcttttctatcggcatgtcttcttggaactcggtccactcggcgacgaagtctgctaaggtttggaacttgatcaaagttcgtggtttgaaagatagatccaaagacatcaactctaaggcccactttgcaatccgtccatttgcctctcgattatgaagtatgtccccgagtggaaaacgacgtgaccaccgtgaccgagtgaccttgaaaatagtgagataatttcctaacggtaattaaaacaccacataacaatttttgcacctgaggatatcttgtcttggagtcgaccaaaacctcgctgacgaagtaaattggttgttggactttttaaacatggccatcatcttcacgctcgacaaccaggaccatgctcacaacctgagatgttgtcgacacatataacaacagcggctcttgtggatgcggtgaagataagaccggtggagtagtgagaagtttcttgaagtcttcaaaggctttttgtgattcgggtccccactggaaattgtcagctttctttggcaacttgaaaaagagcatcccccactctccgagtcgtgaaacgaaccagctgagtgccaccatgcatccagttaacttttgaacgtcattctgggaactcggcggtttcatgttgaggatggcgttgattttctccgagttggcctgtatgcccctatgggacgccataaagccaagcaacttccctgacgttactccgaagatgcactttttagggtttaatttcatcttgaagaagcagatgctcgcaaaggtttcttctagatccgcgatcaaatcatccctctgcttggtcttgacgactacatcatcaacataagcttcaacgttacgaccaatctgagttgaaaagcatctctggatcatgcgttgataagttgctcctgcgttctttaatccaaaaggcatggtgatgtagcagtaggccccgaagggcgtgatgaatgaagtcttcaagtagttggactcctttaaatggatctgatgatatcctgagtagcaatccaaaaagctgagtagctcgcagccggccgttgagtcaactacctggtcaatgcgaggtaacccgaagggatctttgggacaagatttgttgaggtcggtgtaatcaacacacatacgccattgtcccgtcttcttcagaaccaggaccagattggccagccagtcgggatgtaggacttctttgatgaagcctgttgctaacagcttggtcagttcctccttgatcgcatccttcctatcctgtgcgaagcagcggagtcgttgctttatgggtttagcgtcttccttaacatgtaaagagtgctcaatcacctctctaggaataccaggcatatcagatggtttccacggaaagatatctttattattttgaagaaaggtgatgagcgcgctttcctatttacaatctaactcggcgcctattacaacagttttagtgggatcagagggatctagaggaattttcttagtcttggcatcgccctctccgttctttggcatcttggttgcaggcacttctccttcggttgctgtggatgcagccagtcggatttcctctcgagcgagcgtaatctcgcgggtctgggccatctcgcagctttccttgtggcaagtcctggcatcttcatcatcatgtaggtatagtgcgggacggccaagaacttggctaacaccgggcgttcgagtatagcatggtacgctgtctcaaaatcaacaacttcgaagcaaatgttctttgtgcgaaagttctcccaagtgccgaaagtaaccggcaaagtgatctggtcaagtggagtagaagatagcccggggatgactccgtgaaagggcgcattactcggcttcagttctgtgcgagggatctgcatgtcgtccagagtcttggcaaaaaggatattgagtgcgctgccaccatcgatgagggatcgtcggagcttgacgttacgaaccactaggtctagtaccatggggtaccgccccgggtggaccactcagtcaggatgatctaagcggtcaaacttgatagctgtctctgaccaccgaagatattgtggcgtatcgggctgaacggcgttgatctcccgctcggttagcttttgctttcgcttacattcataagccaggggtccgccaaagatatggttgagttccttgcgtgagtcttggaaaccagtaggggcatcatcttcatcatccttcttcttcgacgtgctttgaactccgtcagtcggtttgcttgagttcttggcgtattgctctgcgaactatttgtagacgaagcaatccttggccgcgtgatttgaattcggatgatgtgggcattgggagtgcatgatcttgtcgaaagtgttgacgcgcgaacgctgtcgggaggatggtgtagtagttgccacaagttcttcgggcttacgcttgcgatctttgtaattggtacttccactcccccttgtcgtcggcgtatctttctttggcttccaggtggtgcctgactgcttggatgcggtgacgacgtcttcagcttttgcgtactcattggccttttcaaacatctgcttgacagtcctgggaggcttgccgactaagagttcatgacgaatgcccttggtgaaggcggcaatgatgacgtcgtcggtgatatcagagatcttgttatgttgctcggaaaaacgtcggatgtaatctcagagggattctccagacttctggacaacgttgtaaagatttaactgagtaccagggcgttcaaaagtgccctggaagttggcgatgaagtggtcgcgaagctccgcccaagatccgattgtgccacgggatagcccatgaagccaggaccgagcagagtctgctagggccacaggcagataatttgccatggctttgctgtctcctcctgttgtgcggatcgcgagcctatagacagtgagctaagactcaggatttgtcgtgccatcatacttctcgattccagtcggtttgaagccggtcggccaatccactcgacgcaggtcacttgtgaaggcagcatctccatccacatcgtcatcgtaatgatccagtgaatggtgggggatgtagcctcttgccgtgcggcgctggttgatagtttcgcaaagatcgacgggacgactgcgacgtggggagcgaggctgttcggctcgacgctccctgtgtcggtcaggaggcgagtggacatatcgttcgccatgatccctactcctgcggctagatccggcgccgacgacgctgaggcttggttggtgatagtcttgagatcgaagaggcggaactcggctgccagtcggcgtacggacacttgcagagttcaccgggactgaagcgacgatcatggtcttgatctgatttaagatgttgacgacgtgattggcctgattgagtgcatcttccttaaggagagtgtcgagaagggtgatcgctgcaaccgcgttctgctggggggtgcgaaaaaccgccgtcccttcgacgtcttgttgcccaataagttctcgtgctcgtcgcccggcctccaaggcgcgctgtcgccggtcctcagcctccttcgtagcccgttcgtgctcttgttgctcacgctgtagccgttctcgctcttgtgcttgacgctcctcctccagtcggcgacgttcggcttcttgtcgcacatgctgttcttctgcttctcgggcttgacgctgttcttccgtgtcattgtcggccatgaaaacgccgaagaagagaggcgcgtagttatcttcgtggccttcgtcgaagttgtcgaggttgcggtagtcgtagtggtagtcgaagtagtcgtactctacaatctccgttggtcgagaatcgacaccgggggagctgaggaagccatacaattcttccgtcgaaaccgtcccgagacgttggagtatgacgccgacttccctggagctaggctggatcgaagccgaggctggatctggcctaggcctacgggaagaagacgcccttgtggtgaagactgtggccaagtcgtcggggagactcatcaggattgagggataggccccattgtcttgatcaggtcgtgttgaagtagattggatctcgtccgactggtttgaagccgactcggttgagatgatcttggagtagatctcggccgagttcgggataccgaacggggcggagacctggcctccccccgactggttcggatccgagtcgaggagagaaatcttgccgaagtcgttggtgatgaagtcgaggctgccaaaccggaacgcctgcccgggagggaagacgaagtcgtcgatgccggagacgaaacccatcgcactagtcggcgaagaacttgacactaccctacctggcgcgccaactgtcgaaacaagatttcggcaatactaaaagggggtggctatcaagctggaaaagtggatgggtttaaagacaaaaaattttatacaggttcaggccttcttaataagaagtaataccctactcctgtccagggattgatccgtcgagtgatctaggagaaaaatcgtgccccaagagacacccggacccctccttatataggagaaggggtccgtattacaaagtacagcccatactcctaacggaataggtagttacagataagatacaatcgtaaccgactaggatcccgggtatttccttgacataaaagtttggaatttaacccgagtccctttaaagatattctatctatacatggcaccccatacccagtcggatatacatgccgtgtaggtatggggtatccataatctccacagatagagtcctgagaaggcaattgtatctatcaattaggatattttatgtaatttccttagagatatatttgggcaaaagtctgccgcaaagacttatggtatcttagagtttgttagagataagagtcgtatccgataaggacatagtttgtaattctcgggtataaatagaccctgaaccccatgtaatcaatgaacacacatgttcaatacaatctcggcgcatcgccaccctttttactttcgttttgtttcgacgagttcttgctttcgggttgagctgtatcggtttcgatctttaacaagaggtaaaacttgttatgacggcttgcgttctcgggattagtgcttccatctttacgacactctaatcttgtttatgtaattcatcgagttatcatatatcctgcataatctctggcaatatcgttatctggcctacaatcggctaacatctatcggtagaaggcagccgattaggttaaatagtgacgttggcttggattatataggatatctaccactctatgaaacttctaatggcttgattgtctagatatttgtcacgcccggaaattcactagtaatttcaaacttatttgtgcataaaatcctcgtctaggaatcagccgaggtacacaaactgataatttaatatacaaatccatcataataataacgttacatacatacaaaagaaaagaaaacagcagcggaataacggtctagcgatggcttcagctccactcccacaagcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagtaaagatttaagagtagtgaaacagtagagtaattaatcagaaattttaatcaacactgaacagcacacccatgctgctcaggcccaaccaaacctgaacaaccaaccccggtcgtacagatcaaacctccaaaccaggaatttaccattccaaaccaggagtcaaatttattatcacattattatcattaatgagtagtgtgggactaatcacgaaaaacattgctcaacccgcccatgaccgcgggcacggctattcgaatagttttactctggccagaggtataccactatacccacaagacacgattccacacatgttgccatgcctcgaagtaccaccacggcactgcaaagggggaaatcatgacaatacccttcgcacaacacaactcaccacagtgcaccattcctgaatcataatcaacccctctataaatataaccagaggcatggactccctagcgatccccacggacttctcaccgcttctcagtctggtgccccgtaatgaatcatgctatacaaaaggtaaagccgttgcccacgctggcttgtggttggcacggttaatgtctcacaacagtagctcgcgaaccggtccttaattgccataagcacgaccttcaaaaccatgtgctgacaacccaccattaattatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgtacagttgaaataaatagagaatttaaatataggatcaacatgctcaaaggattgtgtttaggatctgtgtgacttgccttgcaataatcgatcttcaattaatcttcttgaacacttccgacgcactcacgaaccttcgcaacgacggaaacgacaaagctagcacgcaaaacgaagaaaaagactaataaaaaccaaataaacagtacaaaaacaagcataaacagtatatgtggatatttttaacatgtagatcttgattttagaaaaatttagcaactagaaccagtcgaatccgagttacgacgatttagttatgaagttccgaagtttaatcgattttcatctaataaagaaaacctagaaaaagggatttatgacgtcatcgctgacatcatcatcgccggccatggcacggttgacacgaccaccggcaaaagagggctcggttgggctatccgaggacacctacgcgtagaggacgacgacgcgaactcaccggtgcaaagaacaacgaaggacgacgacgaacgacggccggcgacgaggttcaacggcggctcgactcgggtccccgacggcgacgctccggcggtcttcggcggctgcgaaggggcggacgggattcctctcctcctcacgaacccgactgtgacgacggacggcagcggcgacgatactagcggcagcgcgacgcgaccggaggatcgccggcgacggcggcggctaaaacaacgcggcggcaactctacgggcgacggctcggttgggacttggggtaaacggaagaggacgactaggggatgctttatatcggcatgggtggaggagatcggctcaggaacggatggatttggtgaaagaagagtcgggcttatcccgagttcacccgaataaaaacggccaaaattcgtgagatagataacgaatttgatgggggtttcttcgggattaggtggaggagatagagaggaatccgtttttgcaatcaattttggaagggaagcaacggatgcaccggatttgatggaggaggaggcgactgcacaggttggctcggctctgtctggagctggaagacgacactgtagcagtagggaggccaactagactttttgggctgggccggaagggagcaacaaaggacttccaatttaataaattaatcaatgagatgagctttgaattgttaaaaatacttccaatgctcaaataatttcaagaaaaatcctgaaaatacttggacactcaaagtatttaacaaaattaaaatcagatcattaaatgattaatttaatatttaaataattgctgaactgctctttgtatgattaaaattaatagttgagctccgaaaaatccgagaaaattccagagagtataattaaccatggagaatttaataaaaattaaatccaaccatgccttatattgaggaaattttatttcccacatttaacttcacttgtaaattaatgaacatttaatataaattctaataattatttattaaataatttataaatcctgaaacgaaaatcaagatgtgacaacacgtttccgtgcgtcgacatgccaccatgacataacaaaaagagtccgtgacaggacccttcacataaccccctctaactaattggaccacacctcaggtttcgccccgtccccagcaggcaacgggtagccccctcccccctcgtgccacggtgaattcggcagccgatcaaccgaaaaccccgaccgacccaactccatcacacccaccctagcctgggtacgtcggctagaggaaagctatactacaagcctagccgttgcccacgctggcttgtggtaagtacgataagttcttccagggtttcccgcgaaccggtctttaattgccatggcacgactagcaaaagtatgcacccacagcccaccatttagtgtattttaattaactagcaccattgcggtggcaccaatccaaagctatgctaataaccaatgtctaggctttaatgtgttttccccttttgtgtactagttgaactaagcagggctcagcaattctaatccaacatctaggcatgttacatcccaagttaacaaagcaaaatggcatacaaataataaggctgagaacagtaggtaaaaagcccataccgtgacattgtaaaacaatgcagtatttagagcaaagtagagcatttgcaatatgggagcaatatggtcaattaacaagaatgacttgccctactctcgcactgatgagatctctgcaacgacttcgacgcaccacagagtgacgaaacaaccgaaaactacgcgacaaacaaacacccaagcaaaacatgctataagtctactgaaacatgaagcaaaaccattttcaatggattctagggatttttataaatttactgagacttgaattgacttaaacggagctcggatgaattagttatgatttttagaagattatctctgtttttactataaaaaagaaaaagccttaattatttattgcgcaatatatcccaggtgatgacgtcatcaaggggggactggcatgcgggccccacatgtcagcggctcaagggacagtcggtccaccgtggaccaggaccatgtgggtggtccaccaccggtccacgggaccaacagcccggatcggccccaaggcctatcggacgactcggtttcaagacggccggccggctatggcgtgggcggcggcgcgcgcggcctccgatggcggcgaccagcagcggcagacggcgcataggacggcggcgtcggccgagggtgatggcaagcgtgcggaaagcggtggcgcatacgggagagagggaaggaggaaggagagggagttctcaccgtggggctggccggcgcgggaaggtgcgacggcgaatgacggtggcaagcggcggacggcgagacgagcaggtggacgacgtccgaagtgacctagggaagcaaatgagaggatttagagggagagaggaggtccacggtgagcggcaatgccagccaaagggggggaaatggaggggctcaccggcgtgcgaggaaggatgatttccgatgggatttcgacgatgggaggcggcggccgaggtagctctcacgacagcgatgtaggatcgtaaagggcctttcccacccccaaaagctagccattgaggtgaggggctccaccacttatatcttaggtcctttgcccttccacaaccaatgtgggactattcaacaatctcccacttcacatattggtgtccctcagcccttcaccgccccttcaccatttcaccatggtccctcaggtatatgggccccgcaagcacccacggtccatcaagccttcacgcactgtccatcgggccagagatgttaaactagccaggctctgataccaattttaggatcgtaaagggcctttcccaccccaaaagctagccattgaggtgaggggctcccccacttatatgttaggtcctttgcccttccacaaccaatggggactattcaacaggcgaagctaacggcggcggcggccctagcggcggctggagttgggcggtaggcggcggcgctaggggagatcggcgtgggagcggtgggggcacaggagagggcggtgaaaaaaaggaaaacagtggaggagagtacgggggagctttataggtgcttgggagagacggacgtggccggtgggcggccaattgcaccggtgacgtggggagggggagagagggggattcaaatcgaaactcgcccttgcgggcgcgggtgtatgggcggaaaccgggggcgtgggtggtgacatgggcacagagtgggcgcggccggcacgcgccggcgattgggatggcggttcccgctggttggaggaaggggaaggggctgcaggcgggccccatccgtcagcgcccgagagagaaagggggaggtagggttgacttcgggagggtgcaggaaagatgggccggcgacccatgaggtagggagagggagaaaaagaaagaaaaagaagggaaaaagaaaaaaaggggggattttccagggacttatattgcatataattgattttaattggttaaaaattatttaaaaggctctgaaaattccactaaaaatcatgttagcatattagagcatggctaaacttcagggcgtgacacttacttatactaaataattaaataacataacaaagtatcccgaatgctaacttaatagaagaagtttctccgaacccggagcagagtgtaccggcagctctagtactcctcccaaattcctcctagaaagctacactcgccgaggaagaagtcagagagagtgccaaacttccgggcactcctccagagcttctcctcactctctacctattttctaatgtacaaaagatacaatagagcctcttataattcagctcaaagttgtgtgtttcgaagtgtgatggagtcctccttttatagctaccatatgacggttatggccatggtaaatgtcctaactacccttcaaccgtcatcaggaagtaatcaggagagtacacgtggagccctccgagaacgtgcaaacccttcgtggaggaactcgaggtgcagctgtgggcggtgatctcggatacaggccagcacatgccctccgacatatcggctcgaccgacgacactcctgtttcaaggcctcgtcgatacgcttcccgatgccttcaagcagagtgcaggccccgttcaaccacgagatatacccagccgctgactcctcgagattcccgcggggtacttggagctctctacagactccagccatcgctgtataacaactcctgaggtacgagttgaaccacacctcgcgacctcggagtgcttccacggcttggtccttcttcacttccaccatagtcctctcgagttcggccacctcgaacttcgtcctccaatattggattcgacgatctcggtcggccaacgtactctcgaggtctgctcaatacggaaatgactaagtcaggtcgttctcctctttcgagaacacagcaaattaagtcgatccgaacaaaagaataaaggagatgaaaaccaaagtaccaacctaaggaagtcgtcgccacgtccgccttcacagacaggctttgatcgacatcgtcccgcggcacgtacggctcaagcgcaagtgccggaacgactaccggcgactcaggctgcccacgctgctggacatcctcgatatcaacatctctacaatgacagcaaagtactcggaatcaacatgctaaagaaaacgaaggaaacaactgcatacacaaaggcagtttgaaccgacgaaagttttacaagcataattgattaaggagtacaagggaaatacaaccctactcttcaaaaagggggagaatggactcccccaagtcaccgacttctttcatcacgcccttgcgcgcgtcattggcggccccctgatccagaatcctctagaggtcgagttcagggtatgccagcttcacgcaagcgaggacgtggcacgccccggtgtaaatcctatttgacgtctccttgccgatcctggccgcatgcttggaggggatctcctccatcgccgcagcgagctccgcgagcgaggacgtcagcgagaactcgttgggggttgccgggatggtggtcgtgacgccgcactccccggcgagttggtgtaggccggtgtaagacacccgcagcaagccacggatctctgacaggttgttctcgagctccgacatccggtgttcgagcccctgccgctgcctttcgttgccggccaccaactccctcatcttgaggaggtcctcgcgggtctccgacagatcgcgcgccagttgctggcgcgttgggttgccgacaacgtcaccgccctggctttctcgatctcgtagcccacgccgcgagcaccagcctagaggatgcgctccatctcagcttggagctccccctaggtgagggcatcaatgggcgggccccgagcgggcacaagaccgccagcgggtccactcggcgtcgcctcccggtccctagttgtgaccacgacatccgtcgaggccgccacaggagacacgctggaggtcgcaccggacccgtcttgcgccgccttcacccacgccgccctgcgaaggatttctgcaatttcatgaagacaggcaagcaagagtttgcgaataggatgacttctaaaacgtctacctacttctcgccaagcgtcaccagcctttgccttcgcagaggcgggggagacgcatccgaggcctgaacaagatagcacgatatgaggtcaaagtattctgactacatgattaagaaacaagagaggcttaccgacggagtaggcactttccaacagtttccaagtacagaggagaacttcctccctttcttcggaacgttgttgccattcatcgtggcagcagcaacagcaatatcggacgcctccttggcaacgccctcctttaacgacgcctccgccttgtgatccgcgagcggcccgatgacgtctatcaaagggagagcttgcgtacatgaaggcacaatgcgatccaaggaaagaagaagtaaaggagccatcgagtacactcatgttgattgcagcttcgcactcggtcgtccccttcttgcaaaggggaacggggacgttgctcaccgtcgtagggccgctgactgacgcggcgctccacggttttgctgttcaaacctgtaggatcgagaaccagaactcgataagtcagcaggaacatgcacataaaaaatgaaatctgaaatacaagaaaaataccccgagaagaaacccgggtcgcgtcctccggcccagaatagtcaaaggctgggtgggctcgagcctggagcggctggatctgcctaccgatgaagttgacagcaacttcataccccgacaactctcgtactcggaggtcatcgatgatatcgatgaaagacttaagggagggagttagggcgggtttggcggtccattccggaatcttgtctggttgttcctcatggacaacaaagactggatccgaattttctatctgaagatagaaccacatcgctcgccattttctacgagaagaagggcactggaaggggatgtatcacgacttcaggccatcctgaagttagaaaccgacacatccagatacctttttaggttccatccagcgcaactcatagtagaagtaaaagagatcaagaaatggctctaccccaatgtagggcccacaaagataggaaaaaatgctaagaaatgcgatagaattggggttcagatgaagcaaggaaaggccgtagaaattcaagacaagaagaagaaactcagaaggcggaggaagaaaaccgcaaagaatgtaatcctcaaccgcaaccatgtggcctaggacaggtttggggtcagtacctcctgtttccctctgcatggtcccacgaccagggagggcaccgtcgtcctgcagcttcttcagggacgcattggtggatgtggatttgtcgaggtccatcactgccggaagatcgccggagaacaggacaagatgggaaagctagggcttttctacggaagcggagaagacgaggggcgtttgaaggccggaaagttttgcagcaaacggacttcaaaatggatccccaaaactcccgtaaataagcgcactaccgatggtgcgaattccaaggaaaggagagagatggccgccagaagtttctgggtccgttacccgcagcagtttttggacttcaatttaaattcactcatgaccgttgaacttcatgcaatgttatcgataactctacgtctctacggttctcataccaagatcgaccagttgagagcgataatgattccgagatcagaagtcgcgatcggtcacatgagttcatttaagcagaagtcgggggctactttcagggttacagaggtataccctctacccttggatgtatgttgtatattgatacggtatacctgcgcgtatacggatgttgcgtacacgttaaggaaatccatcacgtaacagaaacagagtccacggatggaaggagtcctactcggacagaactgggtcgttactgtatcgcgtggggtccgatatctccaagttctacttggagatcaactgacccgcggtataaaagggaccccccgggagggcctaaggcatcgaatctcaccgccaatacaaccaccacagcctacgaaatcgaagccaacaggagccaagttgccgggtgatctagtcgaaccaactcgactacggtctcgtcggtatcatcgagttctgctattccctttgtaatctgtggtttctaccatataatcccataccaactggattagggctattacctatcaaggggcctgaaccagtataatccttatcttctatttgcttgatgtcgtattacgtagatcctcataccagcgtaccccaataccctctatatccggtctatgggtatcccccgtcgacagcagcgacggaagattgcctcgggttgacagcgacacgtagccctagtgatttgcagtggcggcgaaggggtgaacgggcttcggcttggtgctgcgatgccggcagagactgcagcgaggtccggcgaccacggggtcgacaaggaggtgcggctggagatggtggcggctgtggagagagagggggagctcgcggggaggcggctagggttagggaaaacttcgggaaaaaggggaaaacggaagaggatgccgaggggctgctatttatagctggaagagggagagatcggctcggaaacggatggaatcggcgacggattagtttgggttcgacgaaaaaacggagctcgaaagcgcgtcgaatccacgcaatttacaacgggattcaagggggtttcttgtgataagatagaggagatcgaggggaatatgttcccgcaactaattttggaacgggagcaatgcagcggcggattcggtgcgggagcggcgctgcacacgcacggctcgggatggaggcggccggaggaagatggcggcactgtagccgagtgggccccatgcgtcagtgagaaagaaagaggagggagctaaagtagacttcggtcgagaggggagagaaaggagtgggtcggattcagcccaagacaagagagggaatttaattaactttttaatttaaataattactgaaatgatgtttcatttattaaaaatacttccattgctcaaataaatccaagaaaaatcctgaaaatacttgggcacacaaagtatttaataaaattttatctagctcaagtttatgttcaaatttttcatagattttattcacacacttactttaatcattaaataatttctaaaaattcctttttcacaacgatttataatttagcgattttcagggtgtgacaccctcccccgccccaccccctccctcccggaactttttttcttgcgtaacaggcgtagtaaaagttttactcattgagaaatcatcttcaaatatatctgtggagccaattgcacacctccaggcctccaccaccataaccaaccacccaccccctattttcaccgatttttttggatccgagggaagcagcttgagtagataatatcttgtgtgcattattcacacaacatcttaactcgtgcgcgttgttttaaatcatttgttgaaagttttctatttttcgagtcgaaagtattttagatttggacttgacaattttaaaatctatgccggaagtttcaaaaaaaatcttgattcaaaagtttttaatttgtttacatttgaaagttttcaaaactgagttcaaattcttgaaaaaaaaaatcttgagttgcaagtttcacatatagactttgatagttttcaaatccaacttgaaagtttttacattcgagttgaaagttttaaaatatcaattgaaattttcaaaaaatctttcaatgaaagttttcaaatttgagttcatagtttcaaatcattagtttaaagttttctattttccaagttgaaagtatttagatttggacttgacaatattaaaatctcagtcaaagtttcaaaaaatcttgagttgaaagtttcaaacattcactttgaaagatttcaaacccatgtagaaaaattttaaattttgactttcgaaagttttcaaatctcatttcaaatttttcaaaaaaaaatcttaagtttcaagtttcacatattaactttgaaagtattcaaatatcagttgaaattttcaaaaaaatcttcagatgaaagatttttgagttcatagtttcaaatcattagttgaaagttttatattttccgagttgaaagtattttagatttgggcttgacaattttcacatatatgttgaaacttcaaaaaatcttgagttgaaagtttcaaacattaaatttgaaagatttcaatcccaagttgaaagttttcaaatctaagttcaaatttttgaaataaataatcttgagttgcaaatttcacatattgacttttgaaagttttcaaatccgagatgaaagttttctaatttgagttaacagtttttaaatatcagttgaaattttcaaaaaatgttccgatgaaaagttttcacattttagtttattgtttcaaatcattagttgaaagttttctattcacaagttgaaagtgttttagaattggacttgacaattttcaaatctcagttgaaagtttcaaaaaatcttcagttgaaagtttcaaatattcactttgaaagttttcaaacccgagttgaaagttttcaaattttgacttttgaaacttttcaaatttaacttcaaacttttcaaaaaaagaatcttgagtttcaagtttcacatattaactttaaaagttttcaaatacgagttgaaagttttcaaaatcaatttgtatgttttgaaattttcaaaaaaatatttctatgaaagttttcaaattggaattcatagtttcaaatcgttagttgaaagttttatattttacaagttgaaagtatttagatttggacttgacaatattaaaatctcagtcgaaagttccaaaaaatcttgagttgaaagtttctaacattcactttgaaagatttcaaacacgagttgaaagtttttaaattttgacttttgaaagatttcaaatatcaggtgaaattttcataaaatcttcagatgaaacttttcaaatttgagttctattgatgcgaaaaacacactagcctggaagatctgcttaacttcagtgcgggtccaaaatcttacttttaggttcgtgagcctgccagttgatttgatcctgcaatcaacaagaaacaaagatgagaaaaaccgcagttaaatccataaacgatagccgatcggccagtcgttgatgacatatcatttattttcgagccgatgtcatatgtgaatcgatcggcagttataaataagcaagataagactaaatctactcgatcagctatagatattaacgatatataatctttctgtcgatatatatttaaatcaagtgattgggatagatcggtcgccatgccgagacaatataaatcacttagatcaaagtatatattaacatgaagattataaacgcatatagcatagccgatcaaatagatctagcatgtatcggctaatactccgataccactctatattaagatattaaaacagatagaatatatcaaacagaagcctaatatactttattgcgataagatcttaatataaagggcagatctagcatatcaattaagcatataagatataaagctaaatcaggtaagatcggctgaaaccccgatactatctctctcgatgatcataaaacaagccagatatcataattatagatattacttaatagatcgaactcaaccgatgcagcattaagcataaagacaagtataagatctaggcaagatgatgaaaacctataagagatggtagatacacgatacaatctaaattaataacaaaacataactctatcggtcacttcctaacaataagaatcagccgataacaagttatatagcgcaactaacagagattgcaacatgcatatgataactcgacgaattacataaacagtattaaagtgtcataaagatggaagcattaatcccgagaacgcaagccgccataacaagttttacctctagttgaagatcgaatcgatgcagctcaacccgaaagcaagaactcgtcgaaacaaaatgaaagtaaaagggtggcgatgcgccgagattgtattaaactgttgttaattgattacatgggttcgggctctatttatacccgagatacaagatacgtccttgccggacacgacacttatctctaacaaactctacgataccataagtcttcgtggcagacttttgcccaaacatatctctaaggaatttacatgaaatatcctaattaataaatacaattgcctatctgagagctttatctccatcgtggcaatccccgtgaagcactttgatcaatccctgaaacagccctgaaaccatcttcatcgcaatcggctgcaccacctctatcagctgtgtcagctgtcctctgtccgatccttctcagcctatgcagactccagccgatgccttcgcagccgatgcatactctgttcttgtaacatcctgaaaattcctgacaataaaaatcactaaaatttcgaacttttaaaaacttttgcatcatgctggtgttattcgtttctctgttgcaaaatgtattgtttaaattaaataatgtgagaagacaaatatattggtatgacaagacaaatactaaaaccttaaatatggggaaaatagaaacatatgttggaattagaaaaaataattattaatatatggtgcaataaatcacaagattggaagtgttgaaatataggtaagtatctaaaagaaataaggagattaaaacatctaaaacttattcacacaaaaagtctaggaaaagccctaattgtgatttttcccgggttgctactgttcattacgcgctaggtgttcgatctgtgcctaacccgaccgaacacccgacgccgccctctccaatcactgccgtgccgcgcggctgcctttccgactcgtgcgccgcactggtcgtgcccgtgcgccgcaccgcgtcacgccacgccgcgtgggcccgccgccgaccgaggcgccgaagacccgcgccaaagctgcgccgccacgagagcccgcgtcatcccgtcccctcgcgcgtcgccttcgggattgagggataacggtcgccacgacgaccgcgcgtcaccctagggcatagccctgcgcctcccctatcaaggccgctaccactgcacatcaccgccaatcgagtcaccatcgtgtcgccatgccgtcgcacataaccgagaccgctggatattagggtgttccctccccagctaatgaaccctctcctggaaccctatcatctaggcaatcatgccgcgccagtgcatggaaccaaacctgggagcgatcgaaacaatgccgtgtcatcggttattcttatccattaaggaatccctctccctctcgcttttataagcttatgtctggctcgttctcatccaaacccaacctcccatttgctcttcctctccctaaaatttttgctccaccgaagaggaacaagatcgcgccgcccgccgggtgtcgaacacctggtgagcgagggctgcgccgccgccacagggcttctcagccggtgtgggtggcggggtgtggagaggagttgctcgcgttgctgtagctgctgttggagggagccgggagccgctgaacgagggagaccaggcgtcgaacacctgcgactgtcgtcgacagctagccgcccctgtttcgtccgcaccgcgccgcgcccgccgaaatccgccgtctcgccttcccgtggtaagccctcgcgcctagagcaactcccagaaacttagtaacttgcggccccgtcgatttggggtgcgcgccgccgtagccatgcctaccccggccaccacggcgccatggttgagctcgccgtggcgggacctcgttccaatgtagaatcggctagatttttgcttttctatactccatgtgaaccctagatggttaaatcgaagtcttctgtgcttgaatcgacacccattgcgctgccgccgttctcgcgatctcggtgccgccacgcgccgtcgcgccgcgcgtcgggtggccgccgtgcctcgccgccgccgccgatgggtttccagtgatgcgccgctacctttctccaccgcgcgccgagccgtcccggctcgagccgtcggaccgctgcgtgccattcctctgttcggccgcagcgagaggtagaagacgacgggaaaaagaaaggaaggagagagagagagaaaccgtgcgggacccacatgtaattagcgcacagtaatcctccacctaatgatgattagcccactcaatggcatgtggggtccctgttattaaaatctaagagaacttaattatagactttgtgtccatgacaagcgggacccactggttattaaacaagccagtttgaccctagtcaaccagggctggtcccacatgtcagtcacggtggttatggataatgttggattaaaaataaacagtatgcgcacagtaactttttacaatttctcggattaattcaaatttgaatctttaaactacataacttattcattttagctccgatttgagtgaaacttgaatctaaattcataatctttccaatggtatataactcactaattaataaaatatatttataattattagataattaatatcatatgattaggttatggtcaacttaaaaatgtgttaataaatacaattgatattttacagtagagtagatgtcaaataattatatttaacatgttttgtcactgtaacaaccacataaattaattataaatattgtttcaaattaattgaagcatagaaagtaccattgctatttattaatcactgaccatatatgtagatgaatccatgatttataaattatttacataaagtttagcctcatattttgtaactaaaatatgaatactcatagatgaatctttaacttgtttatgagaaataataacagagctagttgtagttggaccgtgacttaggattatttattgtaaaattatgcattgagataaactttaactataatattatggaccacactaatcaaacctacagagtatggtaattcattggaacccttatatagtaatatttgtagagccatgcctaggcaatccattccgttagaactactgctatgattaaattatccactgagccttggtaaacctcctacagggtgtcaccatttaatctacgatcaaagctagtttagccatgaactccccatagccatagttgatagatatttgagccgtagacccgtagtcctgagtattgagttctgtatgtgggcagcccttagtttagacttcgtagcaccttacaatccattagcaaacatgagtggtatgaatagccctaggtatatccccaacaattatattttgcttgtgcatatttgcttgttgttgaatattggtttcctcgcgtattatagaaattgtatatcggttagtcgcgaggcaacgtatgcagcttccaggaggtgaaggttgatcaagattatatcaagaataagaactatcctgagcaggcaagtcatcaccccatcccttg

SEQ ID NO: 73130 - DNA, 13905 bp, Oryza sativa
tttactgctgtcatttccttcctacgaaattcctcatcaaacaattgccaccaaaattcaatctggcaatcttttctttcaggccatgtgctgtgcatagaactggaaatgtataaaattttcaattatcaaagaagaaacctatgttcactactactactacagagcacctaatcgaggacggcatcatacgttttgttttatctattccaaccgaggcattttctcttcgaatataaaagagtacagaactcgttttatggtaaagcgttaaaggtacaacatttaattagcattgcctcttgttgacaattatatatgaggtgatacgtggtcacacgaataacaagcagtgaagcgtgcacaaatatgtaaacttaccctttttctttcccaaaatcatttttgtacaacgtactaaatttttcgaccaattagatctgacaagcactaaaccgcgtgtaaatataaagaactaaagtcccccaagaaacaaattaaaaaaatactaaaactacttgcgaatgtatatgtatatatatatatactccatccatactcgtaaagaaaatcgtttatgacaatatttaagtcaaatcttaggaatataaatcatgaatagctctcaagtttgtcgagtttgaaaatgtaaaaatttatatgaatagatttgtcttgaaaaatactatcataaaagtatacatatattatttttcaataaatatctttatagaaacaagaagtcaaattgtattttgaagaccgtgtcgctatccaaaacgacttcctttccaatccgagtacggagggagtaattcagtacttattcccctaaaattcagtaattactaaacattcctacgagcagtttcatccaaagtacttagcatcttcacaccaaaagtcctgttggtaataaatattcaacacggctataactttcgttcttcgttaaataaacccataatttcaccaccaaacacatccatgtgcattggaaacttcatggctaaaggcgtgaagcatcttcggaatcttcaccaaacgagaacgaaactctcttggattgccataacacgaccgcgaaagaccaaaatcattttagtcattgcccaatgaaaaacatcaacttgaccaagcgctcacttatcattgacgtacagcatctatgtcagtcaccagcgacctcattaccagaagtcccccagcacgcattgcacaagttaattaatgtgtggaccagtaagtaaaccactaggcactagctccaaaaaaaaaaaaagctttagaaaacgacctgatctcacaccaaacgcatgtcaatccgtctatataagtagccgttgctagaagctgccatgtatatagtcctaaccaacagtcaggaacagcaacaaaagtaagccaagaatctctctgcctcccaccaacaaccacacacactcacagctttggtcatggaggtcacccccaaccacacgcagaccgtctccggctgggccgccatggacgagtccggcaagatcgtgcccttcgtcttcaagagaaggtataaagaaatgagcaagaagtgattgatatttggatagatttagatgtagcttgttgttgagaatgagatttattgcatgggtggttgcagggagaacggggtggacgacgtgacgatcaaggtgaagtactgcgggatgtgccacacggacctgcacttcatccacaacgactgggggatcaccatgtacccggtggtgccggggcacgagatcaccggcgtggtgaccaaggtgggcaccaacgtggccgggttcaaggtgggcgaccgcgtgggcgtggggtgcatcgcggcgtcgtgcctcgactgcgagcactgccggcggtcggaggagaactactgcgacaaggtggcgctcacctacaacggcatcttctgggacggcagcatcacctacggcggctactccggcatgctggtggcgcacaagcggttcgtcgtgcggatcccggacaccctcccgctggacgccgcggcgccgctgctgtgcgcgggcatcacggtgtacagccccatgaagcagcacggcatgctgcaggccgacgcggccggccggcggctcggcgtggtcggcctcggcggcctcggccacgtcgccgtcaagttcggcaaggcgttcggcctccacgtcaccgtcatcagcacgtctccggccaaggagcgcgaggccagggagaacctcaaggccgacaacttcgtcgtcagcaccgaccagaagcagatgcaggtaattacatacgaatatacgattgaactccaaggcaacctcatcatgtgcacgcataagattaattagttttttttaaaaaaaaacgaaccgatcgcaaacgtgtcaatttcattggaaataataggagtaaaagttatcaatacaagtatgaaaaaaacctactatatgagaagtaagaacactacgacagcataataagcgagatgtgctttgcccctgctatcgctcaagttctgccttccttaatctctgctcctaacgatgtgaaaaaaagaaaaaggctctttgcgctgaaaactccccggggttatccgctctccttccaaacctctcacgcgaggattagtgtgtggaattcttttttcggaagttctttagccgtcattcaagattagtggagtactaatttaattaagcactgaactagttaattacttaatttactgcaataaattaggctatgacgaggagccttgactacatcattgacacggtcgcggcgacgcactctctgggtccgatcctggagctgctcaaggtcaacggcaagctggtgctcgtgggcgcgccggagaagcccgtcgagctcccttccttccctctcatcttcggtgagcatttgagcaatcacccatcaagttaatttaattactactacgctacttagtagtatctgccaactaatcaatcaattaattcgtgggttgcgtgcaggtaagaggacggtgagtgggagcatgacgggtgggatgaaggagacgcaggagatgatggacatttgcggggagcacaacatcacctgcgacatcgagatcgtgtccacggacaggatcaacgatgcgctcgccaggttggcgcgcaacgacgtccgctaccgcttcgtcatcaacgttgggggcgactccaagctctagactcatgctactatcatattgctacctagtaccaacctccatgcctttcttaatttaatttattggaggctctgcacgcagaatgggacagttcgagctgtcgttttctcgttggccacgtgaagtaactgtacgcactttgtacttattcgagaaatgatcagtgataaatcatcaatggccttattttattcttaattagagcaagtttaataatatagccaactactaatttcaaatcatctagagtcaatgtaatagctaattcatacaatagttacttactatactattaatacctggtccaacctatcatacacacgttacgtcttgaagtccatgctgcagctggctacatatttttagtccgttgctcttcttttttttcctttatctttttaaaatatatttataaatggcttagagccttgctattgtacctgctcttaataagctatgttttgatctctgaaacgagccatgaactgaacatatgttggtcctatgttacgatccaacacctgccatagtaatgcgtgtgcacggcggtaatgatgagaaatcgagctgagctattgagtaaggggattggccgattgggtgtagctagctagccgtctagaggaattacaggtagaagagagaagggaaaagtacaaattaccctatgaactatcacggtcggccaaatttcccacatgaactcgaaaaccggacattactcaccctaaactttcaataccgaacgaattacctccctcgacccaatccagagcagttttgtcctacgtgacgtacgcgtggcaacctagtcagcattttctttttttaaatatggtggggcccacctgtcattctctcctatcttctccttttcctcttcccctcttcccccctctctctctctcgcgacgtcaggcgtggtcggcacgcgagggccgcgatgggcggcagcgggttgtcaagcgtggacgcgcgcgggcggtcggcacgcgagggcagcggtgggcagcagcgcgtcgtcaagcgtggccgcgcaggcgatcggtgcgcacggcgccgctcgagggcaggtggtgggccgagaagatcgatccggatcctctccagcggccccgtctttttcgttcttggtcatcaggagagatcgatctccttggttttgtcattgtcaagcagcagcaacggcacctcgctagctaggtcaggggcgaagcccaatagaggcccgtgggtgcagatgaacaccccttaaaaaaaaatttagttattacccccatatctctgccctaacaacagtccagttaacgttgtaaacccatgaggagagtcaaatccagatcaatcttttctcttctcgacttctcgtatgccgcgtcccgtcgctgctaatcttgacgactctgcctcgcgtctgtttggcttccacgccgctgctctgcaatcagccaatcccagtctcccagacagcacttgcccatctcggcaccacgacgcgctgccgtcggccatcgccctcggcagctcgccgtcgccgtagcccctgcttgcttagcgcctgcattgcttgctccagccgcaggagccgggaaggcaggaagccggtcgccaggcaaccagctaaccaggagcaagcgtcagaccacactttcacaagccatgaagccaacaacgacatcatccatctccatcaactgatcagcacacagccacattgtgcattagtagagacaaggtaagaaagcatgcttcatctatttcttttttaatcaatttgatttattagatacaaaggcctaaaatttttattggttgtttttttttacattgtagaattaggaggccagtagggttcaatttggaatccttcagaattggaataaaattgcagattgggggaaaatttgagaatttgagttgaaggtgctatttggatgtaagtcatatcaattttcaatctacttctgtacttgaacgaatgataaaatcagtatatatttacatcctcctgaatcatctaatgataggttaattgatggaatgattttacaaaaggaaagtgccaaagccgaatagtgctaacaatgcatgtaattcatgtttggatgatataaactgggaagatgagattaaatatgatccaagattaagaaaacaaattgatgagtaccatcataatctcagagagagggtgagaaggaaatacttagagaatggcccttgttaacctcgcacatttgcttttcctatgacaggttcaagaaggtttgtcccggaatggtttgatgagtttggaagttggcttgaatacagtgagtccaaaaatcgagcatatattgttttttctgtttcttgtttagagaaaagaaggatggtggatatgaagcatttgttaaaaatggttagaatggttttcatagaaaagaaaggttgaaattgcatgtaggtgatgtcggtggttcacactatcaagcaatgaagaagtgtgatgatttattacaaaaaagacagcacattgatgtagcttttcatagtgtgagagaaactggtaagagggactatcttactcgattgaatgggtccattgatgttgctaggatgctagtaaagctaggattgcctttccgaggtcacgatgagtcaaaggagtcctacaacagaggcaacttcagggaatttcgtgattacacagcggagcaaaatccatccttaagaaaggcaataggtacaaaaaaatcaaataacagtcttttggttgctcctgaaatacagagggatatcgtgaaatgttttgcaaaggaagtgctacatgctattctagaagaaattgggcatgatgttttttgcttgctagttgatgaatcaagagatgtttcttgcaaagaacaaatggtagtggtcttgagatatgttgataaatagggaattgtgagagagagatttattggtcttgtccatgtgactgaaacaacttctgcctatctcaagttttctattgatgctctatttgcagaactaaagctaagtctaaagcaagttagagggcaaggatatgacggtgctagcaatatgcgaggtgagttcaatggtttgcaatcattgatcatgagggaatatagttcagcttattatgttcactgttttgctcaccaactccaattggttcttgtggatattgtgagaaaacataaagacgttagtgatttttttactaagatttccatcttactgaatgtggtgggtggatcatctaagagaagggatttgattagagatattaatgttaaagaaatgagtaaggcattgggttctgggcaacttcaaactggaaccaggttgaatcaagagcaatgtcttcagagacctggggatactcgatggagttcccactataaaactctcaaaagtttggttggcatgtttgctacaatagtcaaagtgctagaaattgtggaaaaagacaaaaatgattggaaaattagagatcaaggatcgaatcttttggagtacttccaatcttttgattttgtcttctatttgcacctcatgttgactatattaacaatcacaaacagcttgtcactagcattgcaacggaaggatcaagacatagtgaatgctatgaaatgtgtaaagtcaactaggctcaatttggatgagcttagaagagaaaagtgggagaaagttctagatgaagtctctgacttttgtgacaactatgatattgtcaaattggaaatagaagatacatatattgatcccaagaagcgtaggcacaaatctggaattacaaacaagcattactatcaagtggattgttttaatgatgttattgattggatacttcaagagcttgacaatcgcttcagtgagacaagctctcaattgcttatttgctcatcggcttttagtccaagagactcatttcatgatttcaatctagagaatttgatgagtttagcaaaattgtatcctagtgattttaattctggaaatttgagggaccttagccaccaacttggtctctacatcgctgatgtgagggatgatggtagattctccaacatacaaactattgccgagctttctcaaataatggtggagacaagaaaacatctttgttatccattggtttatcaacttttaaaacttgtacttgtattgcccgtcgctactgccacagttgagaggtgcttttcagctatgaagaatgtaaaaacatatttgcgcaataaaattggtgatgagtacttaagtgatagccttatttgttatgtggagaaagaagaaatgaagaaagtcaccaatgaggccgttgttcgtcgcttcatgaaaatgtaaggatgcagatttgatgatgattgaaggtaatgattgtatctaagtgcgctggattctactttttatttgaaaaatgagaactgattttgatgttaacttgttttaggttatcaaatcatcgtcgaggatgttgagataatgaaatagaacggtgtttgcttatgtttgcatatgcagatcatcttttgctcatgggttagtaaccaattctcaattatcaatgttattagtggatttcttaattttgtaaaacaatgtttgtcactttttttattttattgatgcatgtgtgtctctacagttgatgtaaaaaaattattaatcaacggttctatcgaaaatgtagcttgaagttatatatattgatatacttgtggcaaaatctcgaacccccctccattttgctctagcttcgccaccgagctaggtcatcgtcgacggaatctgctccgccccctgcgcaccgaccgtcttcgccgcgaccgcggtcgaccttggggcctccagcccagacctcctccttctccggtcgtcgcgttctcctggaccacgccgtcggccggctctccctcgctggcgttcgttggtccgccaccgccgtcgaccggcccaagccacagtgtcctctgcgatgagccagcgctggcgactggctagggtgctcgttgctgccgtcaggacttggccgcttcctccatcggcaccgcctcctggattttgcggcgcaatcagagccgcctgccacgctcgcgtcgtgcacctagtcgcgctcgctgtctggagcccatcgccgcgcatgcctgttgattttgcaaattggccggggaagacaatgagaatccaaatgtctcgccatctcgatcacacccatgttacatccatcgatcgcatcgtcatatactacatcattaatgctaatcatctcttcaattctatcaatgtccgttgtcatcgtcgtcatcaattgtctattctgtaaccgtgtcctagctatagctaaagacaaaagacacaatcatcccctgacgacgcgctgccgcccatcgccgcccccgcaggtgctggggagcttccggccgacccccgcctcactgccatggccgccgccgtgcgcaaagctcgctcctctcgacctccccttccacctccatttcctccccttccccatccacctccgctcccccctcccccatcctctcaacctccccgcgcgccaccgggtgcaccgacggtcgggccgcccgcgtgcgccactgcacaccgcccgtccctcgccgatgccgtgcgcgtgacggccggcccgcccccgcgcaccgttggccaccggcgttgcccaccgcccctctccgcattgcgtcgtgcgtgccgtcgcccgttgaccatgtatgaacagaggaagagggggtatgacatatgggtcccaccattttttttagaaaaaaaagctgaccgggttgccacgtatacgccacgtagaacaaaactgctctgcattgggtcgaggggggtaattcgtctggtattgaatgttttgggtgagtaatgtctggtttttgggtcaggggggatttcagctgaccgcgatagttaggggggtaattcgtactttttccaagagagaaacagagtggtgggcgaagaggatttgacaaacaggaaatatgcatgacatttaacttttcgtaacttttaagatgtggcaattaattatttccaaatcatatagaattgttatatgaacataaatacatgcagaataatgagatattcaaatccatttaatctagtctaataacatgccaaatcatagaattgtggtatgaacgtaaatacatgatacggcatagatgcagcgatactttatgtaaaaatcaacaaaatgatatgataaataaatatttagaataagagtatttgcatctcactctcaagacatgtcacgcccggaatttctatccaaaattccaaacgcttacatgtgtgtgaaccctcgtccaggaatcagccgaggcacacaataacaaattgataaatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccactccacaggcagcttgaccagggctacacctaatcctccacaccatcagcttcactgtagaactcctcctctgatgaatgattgcaaggtgagtatatgacatactcagcaagccacgtagcaaatatacaagtgcacaaggataccaaaggatggcatagtagggtttcatttgcaaaagcagcatttagcaaacatttaagattttaataaaacagttaagtaataattaatcaatattaatccaacgctatacaacataccctgttgcataggcccaaccattctgaacaaccatcccggctgcacagttctatctccaaaccaggaatataccattccaaaccaggagctaaacaaattattaccagttaaagcatcttttattatgatgagaggtgtgagactaatcacgaaaaacattgttagacccgcccataaccgcgggcacggctattcgaatagttttactctgatcagaggtgtactactgcacccacaagacacagccccacatcatgtcaccatgtgccccaataccactacggtacctcggaaaggagctgtgacaatacccctcgcacaacacaatccactacagcgcacctttcctggatcataatcacccccttataaacaaggcatggactccccagcgacccccgtgggcttatctccgccacttctcagtctggtgccccgcaatgaaccatgctatacaaaaggtaaagccgttgcccacgctggtttgtggttggcacggttaatgtttcacaacagaagctcgcgaaccggtccttaattgccatgagcacgactctcaaaaccatgtgctcacaacccaccattatcaagttttagttggcacataaattaattaaccaatcacgattgaccatcgtgagctatcattaagccatcattaaataattaatagtaaatcataagttatcccaatagtgtgctaatgtttctaggcatggctaagcaatcacatctaatatctagtcgaaccaatatatatatagcccaactagtcaagttaaaataacccaaggtatcaaggaataaagtaatcaatgcaaacaggccataacaaaggaatagtttcacaccacccagtgacattcgaaaataaatccacagttgaattaaatagagaatttaaatataggatcaacatgctcaaaggattgtatttatgatctgtgtgacttgccttgctggccttggaactcttcaaattcttctcctgcgagaacggactctccggaaacgtcggaatctaaacagaaaagagcaaaaacaccaaaacagcacataaacaagcatggacagtatatgtagatatttttaacatgtagatctcaattttagaaaaaattagagacttgaaccaactaaaaccgagctaagatgaattagttatgaatttttaaagattaaatcgatttaaatcacttttatggattttaattgaattatgacgcaataatgaattatttttgaaaaggaaaaaagagatttattgcgtcagcggctagggtttgcggtggaccgggcgcacgacagcggttcacgggaacggacggccgagatcgatcctatccaaaacggacggccgagatcgatcggtccacgtccggctcacagcagacggccacgatgacgtcagtggtgacgtcatcgccggcggcggcagcggctcggcggcttggcggctcgggcgcgcaagcttgccggcgaacgacggtgcggcggcgcgaacggagagcacccacgggtagcggacggcgcggcgaactcaccggtgaccaaagaaacggcggaggagcagcggacggtgacggcgacgaggttgaagcggcggagaccttcggcttgacgacggcgacggtgctccggcggtcttcagtgacggcgaaggggcggacgaggacggcgacgcgacggcgaccacgaaggcgacctccgcgagcgacggcggcgcacggctggagcggcggcaacgacggcggcgcgaggtcccacggcgctagggctcttccgacggcgagagacgaaggcgagggtggcgacgggtagaggagacaccggggatccttttaaaggggctaggaggcggcggcgaaggcccacggcgacccgcggcgggatggaaagctcgggctcagagagagagagaccgatccgaatcgacctcgaatcaaaaggtagaggagatcccgaagattgtttcccctcaatcgatttcaccggatcgggaaaggagcggccggatttggaaggaaacggcggcggcgcggcactagggtttcgggcggcggcgacgcgaggaagacgacgggtccgacagatgggccccacctgtcagcgaccgggcacgcgcgcggctgcggactgggccgacttgggccgggggaagagagagagagggttttgggccgactttcggcccaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaaacctaccccccttaaacagaatctcgtcctcgagattcggaagaactggcgaacagatgcggatgagctgacttcaattcatcttctcgttcccaagttgattcttcttccgaatgattactccattggactttgcaaaaacggataactcgatttctggttcttctctcatctatttccaagatacggattggtctctcaacataggtcagatcctcttggacttctatttgttcaagattagcttcttcggtaggtacccttaaacactttttcaattgcgacatggaacacattatggactcctgccaaagattgaggtaactctaactgataagcaacctctcctcttctactaacaatcttataaggtcccacaaaacgcggtgccaactttcctttagtgtgaaaacgatgaactcctcgaagaggcgtgacacgaagatacacataatctccgtcgtcaaaactcaaatctctgcggcgattgtcggcataactcttatgacgagactgggccacacgcaatctttctcgaatgattttcaccttttcttctgcttccctcaggatatccgtcccgaaaacctgacgttctcccgtttgatcccacaaaagcggagtgcggcacttccgaccatacaatgcttcgtaaggagccatctgaagactagcttgataactgttgttgtacgaaaattctgcataaggtagattcttatcccaacttccaccgaaatctaaagcacaagctctcaacatgtcttccaaaatctggttcaccctttcggtttgtccgtctgtctacggatgataagcagtactaaagttcagcttagaacccatctcttcctgaagcttcttccaaaaatttgaagtaaactgactgcctcgatcagacactattttcttagggacgccatgcaaacacacaatccttgccatgtacaattccgccaaccgacttccagaataagttgtctttactgggatgaaatgagccactttggtaagtctgtcgactatcacccaaatagagtcatggcctgatgacgttctgggtagaccagtgatgaaatccataccgatttcctcccatttccattcaggaatcttcaaaggctgcaacaaaccggcgggtttctgatgttctgccttgactcgctgacaaacatcacatactgctacgtattctgcgatttcacgcttcatacttgcccaccaaaacctttccttgagatcctggtacattttggtactaccagggtgaatggagtataaagtatcatgagcttcttttagaattgcatcttttaaatctttgttgtcgggaacgcagattctctcgcccaaccatacagttccttgctcatcttccaagaaaccgatagcctttcctcttctcatattcttctgggctgcagg

SEQ ID NO: 73131 - DNA, 2324 bp, Oryza sativa
  unsure (1)..(2324): unsure at all n locations
ccgtcgttcgcgattgttgtgattgtggtggttgttgtggtcccggtcctcgtttgagcggtctcctcgatttccgttatcatggcgccatgaagagacatgacgccgagagcgattcacgttgtctcgtgtgcgtcgtgcttcccagcggccgttgatttgatctcgaagatcgccagtgccgcgaggagaaggggtagcttgttgaggtgattccctccgttccggatcttcaccattggcctcgctagttggtggctgctcctggtgtgctgcggtagcggcttcttcaaacgcgttgctgaggttagtcaccgattcccgtagtcgttctgtccaacgctcgaggtcaacgttcagaacaggatcgtaaggagtttccctcagtatcgcttgaacggccctgatgtgctgggctggagtagtcgattgattccccgcttctgtgttggcgtgcgctgacgtgccgatgtcatcgatagccaatacctcccgcggcgcactcgttgtcgatgacccatagtcctcgagaagatgtaagaccgatggttcgtaaggatcgatatcgattaccccaacgaatcgatctgaagttggagtcgctccttgttccttgccgtaatccatgatgggaacgtatgacttaggacactgagctttcatggcactgagaaagactttgcagctcgagaggtcgtgattctttgtcttgtgaataggacaatagacatcccgagttggagaagtacgctgaattccacgttctttgcaggcgcaaatttcagcacggacgttgaggaaaacccatcaatcttgcagagtgtgtttcttggttttgtggataggacaccaagaccttgtggcttcggaagtcatctttgttggctcatggttcatgtcggaaggacaaggtttggccatatcagaatccttcttgagcttggatgccatcgatattccgttctccgtctcgatgggaggatttttcgacatgaaatcgccttggtttgtagccactgcgttctcgtctccggtcattggaggaccggttgagatcggcgtcgtggtgtaaaccgggaagacgatttcgccgacttgagtccataccagcattgttgaagcagggagtacttggctgaggctggtgctaacgttgttgtcgacgaagctagatgacatagtagtagaaccttgagtaccaaagccccctacctggcgcgccactgtcgacggatgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaataagggaacttgtcggatccggcgagattgtagtcgagttgattcgactagctctcgatgacttggctcctcataagctccggcttcgtaggctgtggaggttgtgttggctctgagattcgatgtctaaaccccccggggggcccttttatatcgcagatgaggaggtctcctcatagaactcggaggtatcagaccttatacgatacgccaacgacccagttctgcccgagtaggattcttcccatctatagattccatgaaaggtttccttagaatatacatgaaatatccgcctgcgcgtgggtatgccatatcgatatgtaatgtatatcgaagggcaaatgatatgcctaagccgtaaccctgacagtaagtgacataacatggcttcaaatttcaagtctcggagtatttgacagctctgcttctaaattctgcagataaaaaaaccactctgtattgaagcatacaaccagtggtattattattaaaatttatataaaaaagtagaaatgttgactattattttagaaagaaaaataacacgctacatctttttgttgatttgagaagttcagttcgagaggtttttatatcccgataaatatccattaccttattcgctacgatttgtattcgctctgtttttatattctataatatttgattccgtttttatatccggggcttccgattcgattatgatttcgagaaaaatatggaaacgaaaacgatagtgttggtttccgtctgaaacgacagtgaatcaagaataaaaatatagggtgagctcatagtatatgtcaatagaacaaaaataaaatacatatcgttgtgcaagttaaatttagtgcatacatgatcaaataggaatgatgnctnctgtacgactagttatccattnggctcg

SEQ ID NO: 73132 - DNA, 698 bp, Oryza sativa
ttcctgcacccccgaatcgccatggcccagcccggcaagccttctggatggcttgcgggctaggaactcagcgccaaccattatggcgctgaactaagggacctcagcgccagcccacctggtgctgaggtgggacttggccgaatcggccatggcccagcccggcaagccttctggatggcttgcgggctaggaactcagcgccaaccataatggcgctggaccccttgcgggcttggaactcagcgccaggcataatggcgctggacctagggacctcagcgccagcccacccggcgctgaggtgggacttggccgaatcggccatggcccagcccggcaagccttctggatggcttgcgggctgggaactcaacgctagccataatggcgctggacctagggatgggacttggccgaatcggccatggcccggcccagcaagccttctggatggctgggctgggacctcagcgccagtgcacctggcactgagggtgaaaatctcagcgccattttccctggcgctgagtttgcagtcctgctaaaacttagcaagactgctctctgtccagtcagactttgcacacaacacacatcacaggcaataatatattcacaggcagtaatatatccagagaaccatacatccatccatcaattccaacatcattccatacatccatagaatccatcaa

SEQ ID NO: 73133 - DNA, 769 bp, Oryza sativa
cagacttcaacgcaggcatggcaaggaagtcactggccattaaatgaaggttgaaatgggcgtccaccggaaaagcgggcgagcggggcaggaggcgtgtgctctgcttgtcagaagtcatttccggctgtagactagccctcattgtaaaaagcatgtttcctttcttaggcagctagaggcccatgtggtgacccctgatcagataaaaaggaggcccaggcctaaaagaaagaggagggaaaaaagaggagaaggaggaaggagtgctagagcctgaacggtctccctcgctctccggctctcggtaattcttacacacacagatccaccagaacacaggagtagggtgttacgcttctcagcggcccgaacctgtctacgtcgcccgtgtcttttgcatttcctctctcgctgaagttcctccagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagccctatggccgaacgggcagtggcgcacaccctctctccgagcgctagcggtgacgacggggagcagaacccgcgccgtcgggctcgcaccccaccgtccccctctcgctgaaatcttgggcggggggaggcgctcgagggggtcgaaagatccgcgacttcaccgcc

SEQ ID NO: 73134 - DNA, 717 bp, Oryza sativa
tgcagcccgaactgactaaatgactgaagaccgaatatcgagaccgggatttggtctgaccgaatacccacccctacaccacagtctaagtagaagtactataaattttcataacagtagagaaaaaatgttatgttcccacacgatacttttttttattattttgttgtagggagaagccgagtactagtgttttattctccacttagtacccgaaacatgtaaataacattatatgtaacattttgatctaactaattaaacatactattacctcggccccagaacataagaagttttattgttggacacagtttgtcggtgacatgggaccgggagtatcatgactagaggcttgaggcagacacaatcgcccacgtggcctgtcaccctcggggggcgtcgggcccgagggtgatgtgttcgccctcctctttgtctccccgaggggtcggaccgctcccgcctcggccccgagggccgaggtgccccgaccccttgtgggttttgcgccgcgtatatgaggtaggtgagcatagcggggctcacctaaccacatttattgcggtttggacgagcgcgtcacgccgcatgtaacgcagtgcaccgcgctcgtttatccggtcagtgaccagtcacagaccgatcagatcgtgggttaggtggcgacaggcggtctgacgcacgcctcggcccatcccgtcaggatgagagcct

SEQ ID NO: 73135 - DNA, 2299 bp, Oryza sativa
tcacacaacacaatccaccacagcgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccgatccttaattgtcatgagcatggccatcaaaaccatgtgctcacaacccaccattatcaggttttagttggcaatttaattaattaaccaatcatgattaaccatcatgagttatcattaagccatcattaaataatagtgagtcataagttatcccaatagtgtgctaatgtttctaagcatggctaagtaatcatatttaatatctagctaaaccaatatataaagcccaactagtcaagttataataactcaacgtatcaaggaataaagtaatcaagaacaaaagggctttaacaaacaataggttaattccacccaatgacattcgaaaataaatgcaatagttgaatagaaacaatagctttaaacgggatcaacatgctcaaagggttatttgcgatctacgtgacttgccttgctggccttggaactcttcaaattcttctactgcgaaaacggactctctggaaatgtcggaatctaaacagaaaagggcaaaatcaccaaacaacacataaacaagcatgaacagtacatgtgaatatttttaacatgtagatctcaattttagaaaaatttagagacttgaaccaactaaatccgagcaaagatgaattagttatgaattttcaaagattaaatcggattaaatcatttatttagattttaattgaattatgacgcaataatgaattatttttgaaaaggaaaagggaattattgcgtcagcggctagggttcgcggtgaaccgggtgcacggcggcggctcacggaaacgaacggccgagatcgattcatccaaaacagacggccaagatccatcggtccatgaccgggccacggggaacgacgacgatgacgtcagcggtgatgtcaccaccggcggcggctcgggcgtgcatgctcgccggcgaacgacggcactacagcgcgaacggagggaaccaacacgtagagggcgacgcggcaaactcaccggtgaccaaaacaacggcggaagatcaacggacggcgacggcgtcgaggaagaagcggcggcgaccttcggcttgacaacggcgatggtgttccggcggtcgacagcgacggcggaggggcggacgaggtcggcgacggcttggcgatcacgatggtgacctccccgagcgacgacgacgaccggagtggcggcggcgcacggctggacgaacggcggcgacggcggcgctaggctacacggcgctagggctctaccggcgacgagaggctaaggcgagggtggcggcgggtagcggcgggcttgggggtcaatttataggggttaagaggcggcggcgaaggcccacagcgaccggcgacgcgaaggaaagtctagggttcggaggagagagatcgatccgaatcaaactcgaatccacggattttcaaacgattttagccgacgattccaaaagagaaaaggtagaggagatcccgaagatcatttcccctctattgatttcaccggaaaaggaaaggggcggccgaatttagaaggagacggcggcggcgcggcgctagggctcgggcggcgggcggccgaaggtagactacgacctgacaggcgggccccacctgtcagcgtccgagggcgcgcgcacgcggctgctgcgggcggactttgccggcttgggccggggagagagagagagaaggttttgggttgactttcggcccaaagccaaaagaggattttaaaaacctttttcaatttaaactattcattaaatgcaattccatttattaaaaatacttccttagctcaaataaatcccagaaaaatctaggaattatagaattaagcaaagtatttaatgaaattttatctggccctattttatattggaatttattaattaaaactagatcttctcttctaggcttttaaaataaattctaataattccaatttagacaacaatttatatatttgggatttttagggtgtgacaagaaggaggctctgtaccaacttgtcacgaccggaaataacccaacgggcgttccttacgtgcgtgtattattccttgtcccaggaggcaaggtacaccaaaagttgat

SEQ ID NO: 73136 - DNA, 12667 bp, Oryza sativa
cacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccagccctgtgccatgacatctcgactaccaggccgcagctcgtgtagccttcatttgccctagaaatgtccatcgacccccgacttcgtccatctccatccgtgtacttttgtttataaccagactgagccacaaactaagccttacccactagacatgtggtagtacggtagtgcttttcaacagaggcccgaagaccggtccttatgtggccgaggtgctactatcaaaaccatgcaccccgagcccagcctaaaaccattttgaggattttgaatagagggggaggtgtgaatccgattccacaataatccaaccattccatagtgtccaggtgacatgaatattcccaaagtctagagttcaatatgttcaaggatgatgtgacttgccttgctcgctttcccaaacgtcggcttcaacctccacgtagagcggatcttccgaagctgcagcgtctacacgaccaatgaaaaggaaaaaggcttttactctaataaactccatataacaagtaggaacaaagcacaaaaatgggttcttgacttcttaagaaaaaattagagacttgaacggtccaattccgagttcaaatgaccaacttagggccatttgaagtttatatgctctttaagtgaatatttgcgaatttcttcatttaaattttaatttagaaaggatttattgcgtcagccgaggggagagggcgcgcggaccggtccacgggagtggggcccacgcggcagcctcacggtccacggtggaccgggtgcacccgggctcagaccggccggcgccgtgggccccacgcatcagccacacccaagggcgcgggcggctgacggccgggccccacgcggcagccgctcggcgtgcccgaaggcggccacgtcggcgcgaccggtgggagggaaagggggacacgaggcggcggtccacggctcaccctaggtcgacggcgatgacgaaaaaggcggacggagcggaggaaggcggcggtacggctcgggtcgacggggagggcggcgctctggcggtcagcgagctcgacgagggggtgcacggggacggcgacggtgcggcgaagccggaggaggcgacgccggggtgggaaacggtcccggcgagcggagaaggccggccggaggtcgtcggcgacggaggagagagagggcgacggcgcgagctcgattccggcgaggagacggtgtggcaaggggcggaaacgggcgagggaggcgcggggagggtttaaatagggttggaagggggagagggcggccggggaaggaaggaaaccggctgggaggtccggccgccatcaatggcgccggcgagatttgcaggagcaaatccggccgtttgaatgcaagagagagagggaaaaatggggggaaagggagaggggatcacggggagtaattcccccctattgatttcacgcggggatgacgggaggcggtgggattcgcggcggcggcggcgctaggcgtgggcgaggcggcgggacgaaggagatgacgggtgggccccacccgtcagcgagggtggcgggcgggcccgcccgtcagcgacgcgcgcgcggggagaggccgagtgggctgcgggggaagaggagagagggggagggaagtgggccgagccggcccaagagagggagagagggtttttagggtttttctttttataaaaccttttcaactttgtttatttcttaataattattatttgtgctctgaaaattccactaaaatttatttacacattttaggcttttaggaaatatacaaaaatcctctaagccttatttgacttttacttcgcacattttaatttttggaggctttctcgaggattttaattattctaggcataatttaaaggatatattttagggtcgttttgggacgtgacacagccaatcgtccatcccatgatgaggacaggcggctatgtactcctgcagtcgttcctatgcttctggaatagattcgtcccttgtttgctggaaacttgaagtccttccacgaagggcattggtttttcccatcgggaagaatttcgagaggaatgtcgtagagcatttgtcccaggtattgacagcagcacggttggcacagaaatactgcttcgctctcccgaggaaggagaatggaaacagccgcagcctgacagcgtctggactgacgcccttgatggtgtacgtgctacagatctccaggaactgttgtagatgagcattgacatcctcattagtcttgccacagaatgggctagcctgtgccatcgtgatgaggctggacttcaagtcgaaatccacgtctcccatgttgatctgcggcccaatggccacattgtcagcagagggagcagcaaactcgcggagagacttgttagccatagtcttctgcggagcaacgactcacggcctgacgctccggaagaaagctttgtacgactggtttctttgtcggtagagttttctgcggagcaacgactcgcggcctgacgctccggaagaaagcttctggattttctttgaagttttccggcaagttgaaaccagtcatgatctaccctgatttcacaacaaaaagtgaaaacaaacaaggatagcctgcaaaggaaaatgattatatagaggtaaatataaagtattagttcaggaaatctatattatgaatcttccccggcaacggcgccagaaatgcttgttggtatttcttaacgacattactagaaatataatttccagcaatgacgcataaatacttctggtatattatggttacagagttcatccgcaagcgcacggatataccattgtagcatttcacccgagagtattccaagggtatcatattaattttatcccgtgggaagatcatgtagagagaacttgactaataatttatatattacttgtgataatcatattctaagcaggggttaagataatccaagggtagagtgacacacaagcattagctactcattcccataatatattatctgagctaagtggaaagaaaagaaaaagaaaatctattcctatacttgtaatatacacagtatacatacattttagttaaccgatatactagctaataccctctatctgataccctcctgctacttcgagaagccacccctgactaccgagttccttatgacagcccatcatgaccatacaaccggggttaaatacggaggaataccctccccagggaattaacttaggatgatataccggcgcggaggaatacacgtactgagctgtcaccatcaccagcccgcctgtcatccgcaatatataatctcaaataatgatatcccgtaatctagacaccacgcctaaactaccagatactactctaatatcatcgtcatgacatagagtaattgtatatgtaaacattatacccgcaccaaagcatctcccagataagctagccgtatattcagtataacatgaacataatgtaaagtaggcattcatatactcggaaagtattttaataccataaatgtatatagaagagtattctaataaaagtacaaagcttacaaaagagaagaggaaagctactagagccatacccgaactcttccgaaggcttccggactcctgatttctactctattcctattccaccagctagatactactaaactaaacttgagagaaatgagagagctattgcttgaggtgtgtgtgtgaagtgagaagagaagctccttttataggcaggtaatgatggttgtaacggttggaatggtcggtaataccctccaaccgttattggggatcaatcccagccgtccatccaaaccctgcatccatcggcgccatgggaggttcggccgaaccatgggctggcccaacctagcccatcttcggctggcggcctactttgttgtcctcctccatagacttgtgaattttggcccaatgtgtcatgttatttctgagttcttagcccattcatacataagtctggttctcgacaccgtccgattgatttatcgtctgagttgatgtcgattctcctccactttattgtcattctttgcaaaaggttagtatacctaatactagtggaatattattattctgaaatatatatgcattgcaagcatgactagttctcctttattttagtaatattgacggtcgaaactgatcgataacgaccgtcaacagatgcttaagaggtccgcctcaaaaaatagattttttttatggcagacctcttagcgtggccaccagcgaaaatcggttttcgctggcggtccatggccccccacccctcgatatgtttttgctgacggttttcgcgtgtggccgccagcgaaaataataggccaacgccatgaaaaatcgtttttctagtagtgagtgctactagtgttgttcgcgaatctggttcctttctcatttttctaagaacaagtgtatatatcacaataaccagttggtagaaccaaattcagagaagaacttgcattaatagctaggaacaattttacctaataattaagttcacaaactgtcaccgctaaaaatttactagtaatttccaaactaatttgtgcattaaatcgtcgtccaggaatcaattgaagtatacaaatatgcaatttgaatatacgaaatcaattgaagtatacaaatatgcaatttgaatatacaattccaacataactaaagcgataaatacttacaaaagaggctctttgtctgcaacatgaagaaaactgcaacggaaaagagaatcttgagaagcttcaactccactcccacaggtatctcgactgggatataaaccagatgtcttctcctttgaaatccttcttcaattgagattgatgattattgcaaggtgagaatatggaatacttagcaagccacatggcaagtatgcaagtgcacgggataacaaaaggtgacaataatagggcttatttgcaaagacagtatttagcaaattgttaaaattagtaaaacagtagagtacttaaatatcaatattaaacaactctgaataccatgccaatgcagcacaggcccaaaccattcatacaggttgtacaggtacaaccttcatacaggaactaaccattccataccaggagctaataaattataatcagttaccaatttaatatcattaatcaataagtttagactaatcatgaaaaacattattaggctcgcctataaccgcaggcataactattcaaatagttttactctagccagaaatgtaccaatgaccaatgtacccacaagacacatcctcataacatgttgtcatgccctcagtatcaccatggtatcttgaaaaggagttgcgacagtaccctctgcataacacaattcaatatagtgcaccgttcccggttcataatctcctcgtgaccccatgcactttatctccacttctcagtctgttgccccccaatgaaccatgccatacaaaaactatagccgtttcccacgctagcttgtggttagtcctcttagcgcttcacaacagtagctcacgaaaccagtcttttaattgtaatgagcatgaccatcaaaaccacgtgctcacaaccctccattaattaggtttagttgtcaaattaattaaccaatcacaattagccatcatgagctaccatcaaataaccatcattaagtaatagtgaagcattcgttatcccgaccatgtactaatgtttctaagcatggatacccatatataaagtacaaggtagtcaatttataacccaaagggtactcaatgcaaattggtcgtacaaaggagtaggttcacaccactcgatgacattcgaaaataagagcacaattgaaataatagagaatttaaatataggattaacacgctcaaagggtgttttaggatctatgtgacttgccttgtaaacaagtatcttcaattcatcttcgaaaacttctccaacgaacaagtgatcctctgaaacgacggaaactatactctaacacgcaaaataagaaaaaaaaacactaacagaaaccaaataaacagtacacgtaaagttcataaataggtagaacttgaatttggatgaattataagacttgaatgaccatattccgagttcgtatgaattaataaagttttaatcaattaaaagctataaacaaagcaaccaaatggcttatgacatcgtatttaattaatttaaaactgaaaaggataataacgatatcagcaatgagagaaaatggactgacgtcactaaaaagttggacccacgtgtaatagggagtattgcatgggtctaccatggacctagtccaaaaagatagcccacggtgtaccacagaaatcgacgtctaggattggttgacaaaagtttgacctagatcagactactctgatcaaacttgaactagggttaggacatcacaatgttggcaaaaaggtagcattaagcatttaatgctactaagttttgcacctttgccaatgaggagatgcaccataagcatcaccaaactaatagcctcatcttttcgcttatgtttatgcttataagccaaaatttgaatttttaaccgtaaatttggagttgattttgggggtttttcaatcgtaatttatttttcaacctttgcttttagatcattaagaacacgtatataaaaattttatttagaaattatttttcgtttgcaaatatatcgcaaacgatggactccttgttgacggtcaatattaccaaaatagaggcgaactagttatgcttacaatgcatatccttgttagaataataatattccactagtatttatttcaaaaaaaaatattctactagtatttggatcactaaccttttgcagagaataactataaagtggaggagaatcgacatcaaatcagacgatgtcgagaatcagacttatgcatgaatgggccaagaactcagaattgatatgatgaattgggccaaaattcacaagtttgcataaaggagcaatagaggaggccacctgccgagtttgggccaggtgggcccagcccatggttcggctgaacctcccgtggcgccgatggatgcaaggtttggatggacggctggtattgatccccaatgatggttggagggtattaccgaccattccaaccgtcacaaccgtcattacctacctataaaaggagctcctcttctcacttcactcacacacctcaagaaaagctctctcatattctctcaagttagtttagtgttatcaagctagtggaataggaatagagcagaaatcggagtccggaagccttcggaagagttcgggtatggctctagtatctcttctcttctcttttgtaagctttgtactttatttagaatactcttctttatacatttatggtattggaatactttccgagtatacgaatgccaactttacattatattcatgttatactgattatactgctagcttatctgggagatgctttggtacgtgtataatgttagcgtatgcaattactctatgtcatgacgatgatattagagtagtttcttgtcgcgtcccaaatcgactctaaaatacatcctcgaaattgtgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaatccctaaaagtccttttccccccttcctctcttgggccggctcggcccagctccctccctctctctctcctctcccccgcggcccatcggccttcccccgcgcgcgcgtcgctgacgggcgggcccgcccgccaccctcgctgacgggtggggcccacccgtcatcccctacctcgcgccgcgcccgccgcgtcgcccgtgcccaagcgctgccgccgccgcggattccgccgcatcccgccgcccccgcgcgcaataaagagggggaaatcactccccgtgattccctccctctttcctcccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccatcggaatcgagctcgcgccgtcgtcctctctctccaccgtcgccgccgagcttcggttcgccgccgtcgtcgccccggacctcctcccgcttcggcatcgcctccttcggcttcgccgcgtccccgtcgacctcgtccaccccttcgtttcgcccgccgaccgccggaacgccaccgtcctcgtcgacccgagccgcgccgccgcctctctccgcttcggtcgccgttcccgtcgtcgccgtcgacccggggtgagccgaggaccgccatttcgcttcccccttccctctcctctctcgggcgccgctccgtcgcgccggtggtcgccggcggcgaccatcggggcgcgggcgcgccgcctcccgtcggccgtgccggcgaggccgccttcgggcgcgccccgcggctgccatgtgggacccggccgttagccgccagcgtcctcgggtgcggctgacgcgtgggacccacggcgccggccggcgcaagccgcgtgcacccggtccaccgtggaccgtgaggctgccacgtgggccccactcccgtggacccggtccgcgcgcccctcccctcggctgatgcaataaatccgattttaaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaatatattgaatcccaatttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctatttaattaggtaacattaggcggttttacaactctagactttgggatattcatatcacctggacactctggaattgttggatcattgtggaattggattcacacctcccccctctattcaaaatccctaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcagcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacttgcttaacaactaaaatatggaatggttggcctgggttagcttaggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcatgcctgccgtcaagtgcctgtggtcgtcgccctagtcttccgctgtttctcgtttgtctttgtgtgtgctgggccttcgctgcccatgtaataaattaactatttacgcttccgcttgttatactctgaattgtatcaacttttggtgtaccttgcctcctgggacaagaattaatgcacgcacgtaaggaatgcccgctgggttatttccggtcgtgacatttctggtagtttaggcgtggtgtctagattacgggatatcattatttcgggttatatgctacggatgagaggtgggccgctgatggtgatggctcaatacgggcattcctccgtgcgtgtatatagtcttaagttaatttcctggggagggtactcctccgtatttagccccggttgtatggacaagacgggctatcctaaggaactcggcagtcagaggtggcttctcgaagtaccaggagagcatcggatagagggtattagctactatatcagataactaggatgtatgtatactatgtatattagtagtataagaatagattctctttctcttttctttccactgagcatagataattcatatgagaatgagtagctccttgcttgtgtgtcactctacccttggattacattaaccccagcttagactatgattattacaagtaatatataaattactagatcagattctctaccatgatcttcccacgggattaataaatatgatacccttggaatactctcgggtgaaatgctacaatggtatatccgtgcgcttgaggatgaactctgtaaccataatataccaggagtatttctgcgccgttgctgggaattatatttctagtaatatcgttaagaaataccaactttcctaaaatgcacctttagcttaaagtgtggccacaagacatcaaaatatgagacttaccattcatactaataaaatgcattcacattgaattgtttttatcgtcattccattaaattgtttatttgtagctatttgtttgccacgcagaaccttttatttatcgtcatcccaatgtgacccaccttattttcttaccggtcacaagcattgtacatatggctcttgtgactttttccagtgggttccacttctattgctcatggtgccacaagcattggccttgcccttaaggacattcacagtgcacacacgtggtatgtggcaatattaaacgcttctgtggacgcgaaaggggagtggggacagtaacttcactaggttcgcgcaaccaaagttggtaacgagagccctgcaacaatttcatcagaaaaaaggaatcaaattgcgcgtaacaagaaagcgagagagagagagagagagagatgaagaacggtgtctaatagattgcgccggagaatctcaccggagagggccgcggaggtggtgaagcggcagcaagcccgaccccgccgacggtgcccttgccagctcacgcctcctaatctgcgtcgaaagatctcaccgaagaagggagaggagtaggggtgtcggcactgcctgatttgcccatagctcatgtggtggtgaccggagcggaggaaggaggagcggtcgtcggttcgatatggttagcgcggccgcaccgctggggagctcgtcgcccacatcgccagagggtttttcgatcgccgcttggggggggggttccttgaccgtcggtgctgcatttattctgggtagccatgggaggagaggaatgggcggtgccacgatggtggccggagattgcaggaaggggacggtggtggtgggttgcggctcgatctgccccatgcaaccgcgccgccgagggaggaggccgtagggggataggaagcggcggtgccgcggtgatggccgtagcgggggagggagagggcatttgtcgtgggcggcgacactgtctgccccgcgcggctgcgctgctagggagctcctctatcaccgccgagggaggagaccggagatggagagggaggagcggtggtggctggacatggagtgggag

SEQ ID NO: 73137 - DNA, 680 bp, Oryza sativa
ttgtcttcattagagttcacatgaaaaagttataaattatttttaaatataaagtcttttagaccgtcctatttggtccagatgatatacaaatccaagtttagaaactggtgtgacacaactgaataagttggaggacctaaacgagtgatctgcaagtttagggattgggatgacacagtcgaacaagtttgagatctgaacggtcgatttgcgagtttagagactgggataacacaacggtaaaagtttagggaccggtgatggactttactctaagaagtttttctagaggtttattagtaaaatatttttctaaaaaaaataaaaatcctgatggatcgatctctcacctgacgatcaaccacacgtatcatatccccgccgattcaggaactgaacatgagaacttgggcgtccatgaccatgatgcatgtaatgatgtagtacatgcgacattggggaataacaaaactacaaatgggataacaagatatcccaaaacaaagggaagaacaaaatcctggcaccggaaactcaacgcccagcaagaaatccgggaatgatatcagggcatcaggcaggcaggcatcccgtcccgcgcatcccatgccgggcggtgcacctaatctcttcccgagacaaaggccacgggctcgaccaggcccgatccctttgtt

SEQ ID NO: 73138 - DNA, 1178 bp, Oryza sativa
tggtaagtatcatccgatatctcgtaagtatcacgcgatacatagcagaaatcgtctgatacctgacatgatacctcgcgagtatcacgcgatacgaggtagaaatcgtctgatacctgacaggtatcacatgaaacctcgcgagtatcacacgatacgtggtagaaatcgcatgattcctgataagtatcacatgatactttgcaagtatcacctgaaacgtgtgtagaatcgtctgatacctgataggtatcacacctgatacctactcgggatcatcccgttcgaaaacgggattccgtcgtatccccttttaaaaaagaactaaaataaaaatatttcccctggatccattctcccgtcagttcgtgatgattgtttcgccacactttaccacacagccagttccattgttccaatatagccattcgtctacagcttgcggttaattttgttgcagtgtaggagtctgacaagcaaccaccgcccgggtcggaggacggcgaatcgggaacccgtacatgttacctgaaagggacatcagaattcagtgcccgtgatgggctgctgctgatggacgcggaatgacaagcacgcatgacatcgaggacgaggtggatgccttgccttcccactcccacagtcccactccctcggccctcgctcgcgtcgttgccgcctgcgcgcgccaaccacccaccgccgatccacccgcatgcgtacgtgcaagcccgcgcgtcggggcccctccaactcgcgcgcccgtatcgtccgtgactccggcccccgaaccggccggtcctaaccttcgtacgccgttgccgctttgcccccgtccttctcttttcggcttcatgatttgtaccagtaaccagtgtaccacacacaccgcaagataaatgacacgagacaaaatgcgaggacgcgcgaaagcacagagacgcacgcacggtgtcaccggactaatctccaatttgatatcgagtagcagtacttgtgtattgccccggagtaacccacatcgcgggtgattacacagcgcgcgtgcgagcgttgcacgtacgcgttacgattacacgcgccatgcccgtggtgaagggtggcggtggcgcggaggcgtcctcggcgcgggcgaccttgccgccggagccaccggctcgcggcgtgaggaggggggc

SEQ ID NO: 73139 - DNA, 12172 bp, Oryza sativa
gccccccccccccccccccccgccattccaagtccggccggtctgaggccgaggagacggcgaccgcggaggcccggaggcgggaagctgaccggcgagaagccgcggaccgcctccgggaagccgaggaggctacccaggaggccgtccgggttcgccaggctgaggaggccgctcgggaggaggccagactccgctgggccggggagtccgtccgggaggcagaggcggcgcgcgcacgtcaggcggcctgccaaacccccgacccgactccgcccgaggcgacgacgacttccgaggccacccacgatgaggccgcgggcgcgccgctcgggcccgacccctcgggcgacgcttgggacgagccagcttcgggggacgcccccgagtccggcacgtcgatcggtgggccgagccgcgtggcacccacaccgaggcggctctcccctcggccttccgctgccccactgagcgtggagcccctcctgcaggccttggccgccgtgaacagcatggtgctggacgggttaagtgcccatatggaggccgtgcaggcggagagggcggagctcgacgcggagtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggctgcggagctagagcagaagctcgacgccgcccagggagtccttgacgccgccgctgcttgggaacggcgggcggcggagaacgaggcggcgtcccggcagcgcgaagaggcccttgaggctcgcgccacggcgccggatgagcgcgcccgcgccttggacgcgaaggagagagacctggcggaccgcgaggccgccgtcgccacccgggaggcaacactggcggcgcacgaggccgcctgcgccgaataggagtccgcactccgcctccgcgaggacgcgctcaccgagcgggggcgagctctcgaggaggccgagcccgcggcgcagcggctggcggacagcctgttcctccgcgaggcagcgcgggaggagcaggcgcgccgcaatctggaaggcgcccgcgccgagagggccgcactagatcagcgggccgctgagctcgaggcgcgggcgaaggagctggacgcgagagcgcacagcggcagggcggccgcgggccacggcgacctagccgcccgcctcgcagccaccgaacacaccatcgccgagctgcagggcgcgctggactcgtccgccggggaggtcgaggccctccgcttggcgagcgaggtagggtctggcatgcttcgggacgccgtctcccgtctagaccgcgccgggcggcaggcgggcctctgggcgggcggtacgcgaagtacgccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgtgcgcaggtccgggacgccgccgaccacatcgtccacagcttcgagggtacggcccctcggctcgcgttcgcgctcgactccgacgaggagggcggtgacgacggtgcggatgacagcgacgatgaggccggcaacccgggcgcgtcggagtgagcccccaggctcccgccaatcttaataacttttccttcttcttccgaggcctttcgggcccccttcttgtatagactgatttaatctgcaatcaagtaaagaggaaatttctacgtcagttctgtttgttgtgtgtatgagatgaggatggtctgtgccgcggtccttctgtgtcttggcttgaacaagggctcgtgcccaggtcccagcctcaaacggcgtgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcaagcacgagcgtgctaattcaagccaagattctacaaaaggaaacgatggtacagacacagtcctcaggaaatcgaaaatgcttttattgagatacggaagagaaaaaaggtaagtatatgcatatggtagcccccggccaaccctgcacgcccgggggggtgcggggttggcccgagcccgagacatgacactcgacccccactaggggtagaagcgacgaaggtgctcgatgttccacgggttaggcagctctgtgccgtcgcccgtgaccagccgaacggagcccggccgggggacgccgatcactcgatacggaccctcccacattggtgagagcttgctcagtccagcacgcatttggacgcggcgtaggacgaggtcgtcgacgcagagtgatcgggcccggacgtggcgctgatggtagcaccgcaggctctgctggtagcgcgcggctcggagggccgcgcgccgccttcgctcttccaaatagtcgaggtcgtctcggcgaagctgatcttgatcagcctcgcaatacatgctgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacaagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatattgagcccccagacagcaaacagccacgaaagaggtatggtctgcagggcctgggccagctgatgggtttgcctggcgtggaactggcacgccctgcaccgccggaccaggtcgaccgcattgttgacagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgtgccgatagagggtcccttccaccaacacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggccaggactccgacgggcctcgggggccgtccaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcactggtactccttacagacctggttagcgaccaactgggagtcgcctaacaccaggaggcggcggatccccagtccagctgccactctgagtcccgcaaggagtccctcgtactccgccatattattggtcgcccgaaagtcaaggcggaccaggtatctaaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacaggctcgggagctggggtccactccgccacaaagtcggcgagggcctggctcttgatcgcgtggcgtggttcaaagcgcaaatcgaattcagagagttcgattgcccatctcaccacccgtccagtaccctttcggttatgcaagatttggccgagggggtaagacgtaaccaccgtgacccgatgcgcctagaaataatggcgcaacttcctcgaagccatcagaatagcgtaaagcatcttctgggcctgaaggtatcgggtcttgacgtcccggagggcctcgctaacgaagtagacgggccgctgcacctttcggcggggccgatcctcttcgccaggggccgcatctccagggcgctcttcgtccgagaggccacgcggggcacactcggcttctgtgccgacgacctcggggtcagagggcgacaggcacagccttcccgcagtggccccggggccatcctgggggtcgggggcgcctggcaccgtcggacaagcaggcggagggccagctccggccgtcgggggcctcgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcctagcctcgatatgaaccgacttagggcggccatgcagccggtgacgcactgcacatccctaagcttgctaggggggcgcatccgctctatagctcgtatcttctcggggttggcctcgatgcctcgggcagagaccaagaacccgggaagcttgcccgcaggcacgccgaacacgcacttatcggggttcagctttatgcaggcggagcggagactttcgaaagtttccgctagatccgagagtaaggtctcttggttgcgcgtcttcacaaccaattcatcaacataggcctcaacattgcgtcctatctggctacccaaagaaattcgagtagtacgttgaaaagtaggacctgcattctttaacccgaaaggcattgtcgtataacaataaattcctatgggggtaatgaatgcagttttttcctcatcctccctagccatgcgaatctgatgataaccagagtatgcatctagaaaacacaaaaggtcgcaccccgcggtggagtcgacaatctgatctatacgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagttgcgccaccttctcgcggatgaaggcttgacgttccggggcctgccgccgcactttctgccggaccggccttgcgcccggccgcacggcgagacgatgctcaatcacctccctggggaccccgggcatgtccgccggtctccaagcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtgctgagcctctcgtcgccacccgtgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccactccatgcggaagttggcggaaccaccgaaggtgaccgggaggtcgatatgacccagcggccaggtgttccccggcgtcacaccgatgatcggctgggacggccggagcaccatccccggggccttgatggcgtcaaaggctagaggggaaaggatgttgagggctgcacccccgtctatgaggacacgacccaacttcacattgcaaacggtgggggaaaccaccatcgcgatctgtcctccccgggcaacgcacggcgggtggtcggtctggtcaaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacagcgctcctgcctcttctcctcctcccacttcctcgtccgctcagccaaacttttgaccgcgcggcagtcagcgaggtcgtggagagaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccaggggcggccggagctgccacaccagaaccggagaagttccaggtccaggcctcctccttgcgagccacacgttccgcgagctcaaaaagttgcgcggtggtctagggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcctcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcagcctcgatcccggtcgtgtagatctggagaaacttggcggggttgacgcttccgtcgtatttttcggtgatggtgggccggaaccttgggagccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgacgagcgtcgcaccggcgctcgatatcgaggcgggcatccgttcccccacgcacatcttcttgggtcggaggcgttgacgagggaatggcggacgaacggcgggtaacggccgccgctcgccgcgtcctccgcctcgacgacatggagccggcggcggcagcgccagaggcctcggtggcggaggaccgcccgccggcgcctaggcgctgctgtgccgtcatgaccaagtcggccacgtcatccagccaacgtcgggctggagtctctggatcggggacgacgggcgggtgacgcaggagcgcgcccgcagcctggagcgtgccctggggcgtgccgccatcgccgtaggcgaggcggcgacgcgccccgtctcgccgtcctcccccgtcgcccgcgggcggcgaagtcgcggatcgttcgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttaggaagacacgcgcgccccgtacctggcgcgccagatgacggagcgtggggctcctcaccgggagaccgcgcaggcccccctttgccggttcggccggaggcgctaagtgaggttcttcgccctcgatctgaggaacgtcagcgggagaggaagtgcacaagacacgggcgacatagacaggttcgggccgctgagaagcgtaacaccctactcctgtgttctggtggatctgtgcgtgaaggaatacagagacccggagagcgagagtgagttcaggctctagaaccccttccccagagtcccaaccccctttctcctaggcctgggcctcctttttatctggtcaggggtcaccacatgggcctctagctgcctaagaagggaaacatgctttttacaatgagggctagtctacagccggaagtgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacacgcgatctgaccggtctgtgaccggtcacacaccgcgaccggtcacggaccggataagcgtgcgctgcgccgcattaaatgcggcgtggcgcgctcgtccaacctgctataaatgcggttaggtgagccccgctgtgctcacctaacccacacacgtggcgccaaaaccacagggggtcggggcgccccagccctcggggccgaaacaggggcgccccagccctcggggccgaaacgggagtggcccgacccctcggggagacagagggaggggtggccacgtcaccctcgggaccgaccccccctacccccgagggggtcaggccacgtgggtgaccgcggctacccaagcctctagtcacgatacccccggccccatgtcaccgacagtagcccccggcgttacgccagggcgatcgccccctcgagggaagcgctcgggcgtgacgccactccttaggcccggtgacaggtggggccggtccctacaggcgggcagaaacccagcagtcacaaatcgcgcgcatcggcaagggaaaaacgaccgacgataatgagcggcctctttaagaccgctacattactcgagcagcgcgcgaatcgggacgagccggttcgtttcgcctggagacatgatgatggcgcttttcacggttagcgagcgtagttaatgcgcgcacgatctgccccatctcaaccgccatggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttctttcctctcgccactcttccccttgccttcgccacttgcgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctaccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctggtcgggtggtgcttcaccgtacagccggtgtcgccgccgacggtagtcggtggctgcaacttccagccgcgggggcaggtgctgaaccgctacattccctgcgtcctccgcaaaaagtgggacgactggaagagcgattggttctacacccccctcgccgacgaagcgcgcctccgacttctgagccagcccccggcgcaggcctccagctggcgggcggcggtagatctgggagacggctacaacgccgttcttgaccgcctggcgggtctgcgatcccaggggctcacggggtccatggtgttcggcgactaccttcgtcgccgaatcgcgccgctccagcggcgcgcccggggcgcctaggagtacaccgggcccgaggactacgtgaggacccaccaggggcgcaaatgggactgggaccctgaggacttcaggatggtggtccaacgggtgctgaatctcagctccgtggaggcatccctcatcccccaaggggtcctccccctctgctacgatccagagcgcgccaagatcctggccatcatgcaggtggtcggggcgtcgggggagcgggccccccgaggccacgatggcgtgggcgggagccgcaggggggaacaatctaccccgggagggggtcgtgcttctgggccccgcgacgggggcccggggggcagccgccctgccgacgcccgggggaagaggaagcaggagggtacccctctcccatctcctccccgagggggcggggcggtgcatgccagcagcaggcgcccggagggtgccgtgccgacgccgcagcccgagggggagcgaaagaagaaacggccccgcaagacggggtggatcgtgccatgccgggggaacctcatctcgcccccgaggtggtcgtttagccgacttccccgcaggttcgtccccgcgcccaccgcggccgtattcattctcccatctcccaaggcgagttttcactcacccgtttctttttgtcttctggtttttcttctgcctcagcgagatcccgtcgcgccccccccccccaaccccctggacattccaagtccggccggtctgaggccgaggagacggcgaccgcggaggcccggaggcgggaagctgaccggcgagaagccgcggaccgcctccgggaagccgaggaggctacccaggaggccgtccgggttcgccaggctgaggaggccgctcgggaggaggccagactccgctgggccggggagtccgtccgggaggcagaggcggcgcgcgcacgtcaggcggcctgccaaacccccgacccgactccgcccgaggcgacgacgacttccgaggccacccacgatgaggccgcgggcgcgccgctcgggcccgacccctcgggcgacgcttgggacgagccagcttcgggggacgcccccgagtccggcacgtcgatcggtgggccgagccgcgtggcacccacaccgaggcggctctcccctcggccttccgctgccccactgagcgtggagcccctcctgcaggccttggccgccgtgaacagcatggtgctggacgggttaagtgcccatatggaggccgtgcaggcggagagggcggagctcgacgcggagtgggcgcgcgtcgaggaggggcggcgctctgtggaggccatggtggaggcgggccg

SEQ ID NO: 73140 - DNA, 6803 bp, Oryza sativa
ccgatgatcaaagatgttaaggttgaagttgcagcaatgacagccgatgattggaggtatgatgtgcatcaatatttgtatagtccgtctcaatcggcttctaggaaattaagatacaaggcattaaagtatacattgttggatgatgagctttattatcggacgattgatagagtgttacttaagtgtttgagtgtcgatcaggctaaagttgcaatcggcgaagttcatgaaggaatttgtggcactcatcaatcggctcataagatgaagtggttacttcggcgtgcagggtatttttggccgacaatgctggaggattgtttcagatattataagggaggtcaagattgtcagaagtttggggcaattcagcgagcgccggcgtcggctatgaatcctattattaagccatggccattcagaggttggggaattgatatgatcggtatgataaacccaccatcaagtaaaggacataagtttatattggtggcaactgattatttcaccaagtgggtagaggcgattcctttgaagaaagttgattctggggatgcgattcaattcgttcaagaacatataatctaccgatttggtattcctcttacaactgatcagggtttaatgttcgtgtctgacgagtttgttcagtttgccgatagcatgggtatcaaattattgaattcttcaccttattatgcacaagctaatgggcaagccgaggcatctaataaaagtttgatcaaattgattaagcggaaaatttctgattacccttggcaatggcatactcggttggctgaagcgttgtggtcttataggatggcttgtcatggatcgatccaagtccctccttacaaacttgtttatgggcatgaggtgttttgccgtgggaagttagaatcggctctcaaagaatggaattacaaaatgatttaacagccgatgagtattacaaccttatggctgatgagagggaggatctggttctgtcacgtaatgataaattcatcccgaaataaaaatcattctctaaaaggaataatagaattaattaaaattcgaaaagaaattggcaaacactaaaatacgtacaagaaaaattcgaaagtggtccggagaatttttgttaaattctccttggtcaaaaaggagccctcaaattttacttgaattttcagagcaccgaaaatatttattaagcaacaacacaattatcaaagtttattaaaaagaaaaagctaaaaataatccccctccttcctttgggccaagcctccctctctctctcggcccgcggccaaagtccttccctcctccctctctttttccttccctctctctctcttgggccgccctccctccttcccctcggcccagctccctcctcctccctcttcctcccgggctgcctctccctcctcttctcctgggccgcctcggcttcgcccggcccaagccgagccgcgcctcccacccgtgccactcagtgcgcgcgcgcacgcgcccgttgccacgcgctgaccacgccccgcgtgggtcccacccccgggtcgtcgtcgtcctcccgcccggcctccttcctttctctctcccgtgcaaaccctagtgccaatcctccccaaaattgacgcgattcaaaacgggggtttccgaaattgattagggggttttaatccccattgattccttatcaattccccctaatttcccccttgattcgtgccctctaacgcccgaaacggccgcgccattcccggccgccttccatggccgccggccacaaactccaccgccgttccccgctcatcccgtggacggctccctctcctcccctataaaatgcaaccccccctccgtgcgttctctcgttttagcctcttcctgagctcccccgtggccgcaccacctctccccgcctcctccttctctttcctcggcgccggccaccctccagctgcctgtgccgcctcgcccgtgcggcggctgacatcgccaccaccttcctcggcctcgcaggtgtcccctctcgccggcctgcactccgtttcgcacggggaccatcggagacgcgtcctcgctggtgtagagtggcgttgccgccactgtaccacctccagccgcctgtgccgctttgccggagcgtcggctttcgtcgtcgctgcctctctcggcacagcagcgccatcctcttccccggccaagccacggtgtcgctcgaatttcgccggaacaccgccgccgccgcgccggcctctccttcctcctcatcgatgtctccttcggccgcccgttccaccccgcttgtgcaccggccaacgttaccaccacctccggcatcgcagcggcaaggtcgccctcggcctcgcctcccctccacccgaacaccgccggtgtccgtcgtcgtcttcattgttcctcctcgccggctcgtcgtctcgcggcgctgcctccatcgtcggcatcgcagcggcgtgttccacgccgtcctcgtctccgtgcagctgccgccggctgccctcgttgcctcctcgccggccccggtcgttgtcctcatcgtcgtggcgttcgtccctccgtcaagccgttcgcgttcgtcgtccgcatccgtcaagcgagccgctgcagccccgtcgtcgtcttcatcctcggctccgcatcatcaagcctcgtgccggccgtgtctcgccttcgttcaaggatcgccgccgaagtcgtttgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagttaagccttgacttgaactgcagcgggaacaccactccacaggcatcctcgacgaagcctactcctcagagaaaccaccatctgacatatactcgtactctggggttggggaaaatagagcaagactgagtactacccactgtactcagcaagtcataccggaataggggtatgatgcagggaattatcaaaggagagatagagtggttcatttgcataaagcgagcatttatatgcagaagttgaaagaattaaacagttgtaataattaatcaatattaatcatccgctgtccaacgctataccacgttgcaagaggcctaaccatccacctatactatccaatttcattacactaaattagggtgaaactaatcacggtgaatctggttgaccgctcataaccacgggcacggctattcgaatagttttactctgattagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtaaatcgagaagcgacagaggccgtcgcagggcccgccccgctccatcacgcccacccttgcctggatgcgtcagctagaggaaagctacactacaagcccagccgttgcccacgctggcttgtggtaagtacgataagttcttctagggtttcccgcgaaccggtccttcattgccatttgtgcgactagcaaaaccatgcacccacagcccaccatgtgattcatttcaattaaccaacaccaaagcggtggcactaatccaacactaccattagaaccaacagcctaaacattaataggattttccccattgtgtactagttgaactaagcatggctaagcaattcctagtccaaagtctattcatgttataacccaagctaacaaaggaacatggtacaacaatagcatggctatgaccataggtaaacatcccatagtaacattgtaaaacaatgcaatatttgacgaaaaacaatagagcatttgcaatataggatcaacatgttcaagtgacaagcatgacttgccttgctctgctgctggaggaacctcagcgactatttcgaaatacaccggagcgtcagaagaaccggaatctaagcgacatacaaagcaaacaatacaaacaggctataagactattgaaatagagaacaaaaccatttttaatggattctacaaatttttcttgatttactgagacttgaatgggcttaaacggagcacggatgaattagttatgaattttagaagattcactgcgtttattactataacaaaaatccttaaatcatttattgcgcaataaatcccagtgctgacgtcatcaaaaggggggtggcgccgacaggcggggcccgcatgtcagtggctcaaggggagataggggcgccggcaagtggggcccccgggtcagcggccgaaggctgccggtccaccgtggaccgggaccacgcgggtggtccaccgccggtccacggaaccgacggcccagatcgccccggggctgatcggacgggcggtggcgacccggctcagctcggctcaaggccggccgaccggccgcggcgatggcgacggcgcggtgcggcggcgagtctagcggcggctagcggctgccggagtagcgggagcggcggcggcgggtggttgcacggcgcgggagcgatggggagcacgagggagttcggtgaaatggggaaaaagagagagggggcgacggcggagcttaaataggggaggggaatcctggacgtggccggtgggggcgggattccgccggccaacgcggggagtgggggaggagagagaggcgggattcgaaaatcgaatcccggccatctcaggcgcgggcgcgggcgggagagaaggggagtgggcgctgtaggtgcggcgcatgcgcgggcgtggccgacgtggcccggaggaggcggatgcgtgggcgcggcggcggttgcagtctcagcgcgctgctcgaggtgggagacgggtccgataggtgggccccacctgtcggtgacccgggtgagaggatgcggtcagccggcccgccccggctaactgggccttggcgtttcggccggcccagcgggaggggaggaaggaaggaaaatggcccaacggccctttcaaaaaaaaaaaaaagggaaaaaaaaggaaaaaaaaaaaaatttttcctaaggattacatattgcttatgctcaattttaattggttaaaattatttaaagagctcttggaaattccactaaaaatcttgttagcgaatttcgacatgtagaactcaaaaaaaattcacatgccaattccgattattaatttgcattaatttattaaggtttacttttgctttacataggtattttcttgagaccatttataacttcaatttaggcttgggaaggaacttcggggtgtgacatcgttccctcgccgtttgcttccgtcgttcccaagccgtctccgttcccacgcctcgtcgcgtggtggtaaggatccctctccctcactgccccgtcctcgtcctttcggtgtcgcccgtgcctgttgtgcggttgtcgaccctggtacccatgtaccggtgtcggtagtcgttcgtgtgtgcgtgtggcgactgtgtttgtgtgcgcgctcggtagccgcgtggtttccacgtgtgcaggccgtgtggtgtctagtggagtccgtttattggccactcgcctcggttgacacacgggatccgcttccgtcgacccgtggaccatttctgtgtactcggtctactgtggtcccttaggttgacatgtggggtccacatgtcaacggcgcagccttcctgtcttttccaggctagcgcttatacatgttttataattgcaaaacctaatcacaataatccgtaaatctccatgtaacagcattaaacttcggatgatcatatcttggtcatacgaaccccgaatcgacccgttcaagtctcctaatgtttgttataacctaaagaaccatgtgctttctttttatgtattggtattgcttctttataggcttgtagctttgcttgtgtgcttcgcgtagcttctgtcgttccggaggttcccaaagcgtggttcgcggtcgtcgccgaaggttcggaaggctgttctctctgagcaagaaaagtcacataatccttgaacatatttgtcacatcctgatttttgtttcaggatttataaaattatttaataaattattatcagaatttatattaaatgttcattaatttacaagtgaagttaaatgtgggaaataaaattttctaaatataaagcatggatggatttaatttttattaaattctccatggttaattatactctctggaatattcttggatttttcggagctcaattcctaatttttaatcatacaaagagcagttcagcaattatttaaatattaaattaatcattaaatggtctgattataattttgttaagtattttgagtgtccaagtattttcaggatttttcttgaaattatttgagcattggaagtatttttaacaattcaaagatcatttcagtgattaatttaattgggaaagtaattaaaattcaccttttccttttcgggccgaattaggaaaagtcctctcattctcggcccagtctcctctcagcctgcagcccttttcctctctttcccgaagtctgctttgtgtccctctttcaatcgggccaagaagtagaagcccagccaaaagtctagtttgcatccctgctacagtggcatcttcaatctccagccgg

SEQ ID NO: 73141 - DNA, 10233 bp, Oryza sativa
  unsure (1)..(10233): unsure at all n locations
cgataatctccgcatatagatgtctaacatctatcctattttatcatgataaaaagtgagactctgctatggcaaacccatcacttatgatcacaatcgtaataggtgcaattattggaagagcataaattacacttaatttttgagggaatctatcctaccatgtcatatcctgaaaaggtcacggggtacacagatctcatctatgattcgccatatgaaaaccttaacggtgtaatcaaattgtgccgaaactgagtcaatctcattgtctcgtttttctcaatgcgtgcggttccagtggacatcggactatccgatgaacacaatcatgctcggccgtggtgagtaccagacattctagtgaagtcaccaacacatatactgattgatctcatcaacccatgtgcctatcggtccatcttatgttccgatcatctaagtactcatctactacaaaatagatctcatctactacgcccgcatatcaactatatgcaatgatctaaatcataaattatacaaggcggctctgataccactgttaggatacgcgaaggctacgatagcataaatcaaaattttctaccacgtaaactaggaaccatgcaagtattagatcatagatcattaccactcgacgtgttgcgcagcggaagaaagcgctaagaaggcaaaggaaccctcgcgatgtagcgcgcgtcgatgtagaggaagttgtcgatcgcaccaggtcgaccttctccttcccgtgcattctcctcgccgtagtaccacgccgatcagcaccgcaatgcagcggcgcctctactgtacagagacggaacgccacgcgcagatgcgctagcacccgcgcgcggctagggtttttctcgggaaggagagtagcggctagggtttctcacgtgattcaatacctccaccagtcacacccctcacgaatatataggatccatgactcgggccttcaaggcccgtaggactcctattcagacccctatccgaattatgctcatattggatctccatccaatcctcttattccgacctattaagcgtacgaccctataggttcatgcatactcggctgtaacccgaaaattctttttcggtccacgtgtcaacagcggcccctagcagaatgtactgactgactgggcatacacaaagatcatatcggttggacctctattgtatacttgtatgaaccctttgactcacgatatctattaagctcaaggctagatatgtgccatcctataatagctcaatcattcactcgaacttgtgatagattatgtaacttgtgattgactcttcagtcacctttggtatggctatgcacttctataatctataacatcgaggggcccagagatatctctccataggaggggaaaatcccatctttattattcatatcccactacatgtttcgtagcatacccgaagaatacttttataactacccaattacggagcatgctgcgtttagcagttactaagtaagctactacacatgttgggagtcatgataatctaagatctaaggactcaacaccaatactaaatgaaatcattgatgacacggcacatatggctcttgcactgtctcatgttggggctatccaataacatattccccaacatgtgtccatattattaatttaatatctcaataccatgatccatgagacatgatcatcaattaatacatgtgttgatcatttaaacatatttgttccatatatgatatttgatcagcgatcctttataaatagtaacatacaacataaagattctcatgaaagaatcacatattcattaaccaataatgaattatctatttcaaaaaacaatgtcggataaatatgtaaacatagtatgtcatacaatcacttttctccatggtaatgcgcatgactagtaaaaagaaagaaacattatacctacccgcacaatggttgttagagtagtgtgtagaattaataaatgattggctggagtgtccatgtactactaatcaaaagtctacttcgaaggagagatttaattggtttctagttatctaatttaatttaataattcactaatacactgcgtcacatatgtaacgtccttatacatgcatgttcgcttaaaaccagacatcatatattaaaaaaaaataaagcctaaaattgcacactcctaagtctaaaattgtacttggtatgcgtgtgtatgtttaccttttttaacagtacttatgatgttagatatggctttactttatttttatctaagattgaactttttgtaactagttttgtaaaggttatgagctgtaatttttgttattatttctatatgttaaaatatattgttcatccttttcgataagaaaaaaaagatgaagcaattgaaatcattgaatgtcatgtgtgagaatcacctagacagtcctaaaactaaaaacactactttacattgtgaaatggagcgagcatatataattaattggatctatgaacaatataattagatctgccttttgacgttaccttgtcacaaattatggtgcaaatatacggatcgagctacaaagcactactgtccgtctgccatccctgaccatttctttattgtccttagccggctggtgacatatttggtgacgcctaacaacaaattcaggtgatcaccctactgttcatcaagacactttagcagcacacactacagtgcaatggcgctgcatcttctctcactacgggagaaaccatctttggtcggtcaatcaaattccacaatagttccggatgcaataaaaaccgggactaacgatattctttagtctcgatcaaaaggttagagctactttttttataccaatcaagactaaagatcaatttttagtcccggttaaaaaacggtaggcggtgtcagacccctctattatctttagtccactaaagatctatttctagtctcggttgctaaacaaccagaaaaaaagattggcatgcgcggagaggaccaggcatgcgcgcgtgatcgaggaggaggcgcatgggatcagttaataagttagtctccttctcctccctcacatttatctcctcctctcctcactcaccccatcttttcctcttcctcctccggatccgccccctcccctctcctccccctcctcctcacatctcaggcggccgggcggtgatggcggtggcctcgcgtggcagcggccgggcggcggcggaggcagcctcgcgcggtggatccaggaggggaggcggccagaccacccccggcagctgcaggcggcggccggcacggaggcgcgcggcggcaagcggtggaggccggcgcggctacacggatttttttcttttttccttcttaaagtgtgattcgatctgtgttgagaatgaactatattgttctgaatgatttatgttgaactatgttgctgtgaatgatttgatataatgggcgtgagatatacaaaatagcaaaaaaaaaaaaagaaaaaaaacttggtcccaggtatttgaacttcgtagtccaggggttaccaaccgggactaaagatcgatctttagtgtcaagtatttaaaccttcgtagtctcgattggaaaaccgggactacagggggttaccaactgggaatacaaagcatttctccaccagtgtatgagaatgatcttttcttccgtggaattgctgtatatctgtcgacagatttcgatttcttcaccgtcaaaatgttctgaacactaaaattaatatatcttcctggcccatgcacatggataggatgtaaaagcacaaaaaaatgagtttgaaaagaaagtataatatatactcgctccacttttttaatgttggaccttaatttgtatatatatttaaccatttatctttttagaaactcacataattattatttattttgatatgatctagtttatttttaaaggtgctttaagcttggcttacaatttttacgtaattgtataaaagttttaaataaaatagcagttaaatgaatgaacaacagtcaaactgaagggagtatatcacagtccgcataggcagaaacaagtgctcaagttttcaacaaacttggatgtgttaatatgcagatgggggagctgaagaaactggttgaagagggaaagataaagtacattggactgtctgaagcgtcggcatcaacaatcagaagagcacacgcagtgcatcccatcacagctgtccagcttgagtggtctctgtggtcaagagatgctgaagaagacataatcccaacttgcaggtcaacataacaaacaatatatattaatctgcccagagtgaattttcataatattttcaattggacatatgtttctgaacatttcagggaactcggcattggaattgtcggctttttgtccagtggcccaaaaatagtaggcacaatgtccgaactagagatgaaaacggatcgaatacgctcggaaactagctctatcatattcgttttcatattttttctcgaaatcaaaatcggaatcggaaacccggatacgaaaacagaatcgaatattatcgaatacaaatacgaagcgaatatgaatcgaaacgaatacggtaatgtataattatcaaaatatcaagacccctcaaaataagcttcttaaaacgaggaagagatgtagccattagttttcaaaaacaaaacatcagtattctcaaattttatcagtattcttaaatgttatgtttattttccatacaaatttatgttatcatgaaacaaataaattaatgtgtatagctgaaattttcgtaagcacattgaaatttttgaaaattggttgaatattttaaattttgggttgaacatttcaattgaaagtttttaaaaatttgagtggttctttttcagaattgaatttttttatttgtttgtttgtggaccatttaaggacccgcatggaaaaatcaatttttccatacggatgacttaagaagccgtatgcaaaaataaaatttgaaaatttgaaactaatttatctcactcatatgaactccaaattggatgatttttttttcctaaatgtttttaaaatcatgctctatcatgttattgtgttcttactgctattattttggcaatttttttcttgtgactttattttatcaattaaaattttgaatttcaaaacttcaaataatattttgaagctgtaattaatttcagctgaaaaagtcatgaacataaaagttatagagctcatcaagacatacaacttttattttggtcatttcttcatccgataaagtgatagtagtattattcaaaaagtttacacatctctcttatagtttatagaaacaaatgagatagatgtaaattttatgaacaatgttactatcactttgtcggatgaaaaaatgaccaaaataaaagttatagatcttgatgagttatacaactttattgttgatgactttttcagttgaaatcatttagtatttcaaaatattgtttgaagttgtcatattttgaaattcaaattcaaacggttcaaacaaagtcatatagaaaaatgaccaaaacaaaagttgtagatgttgatgcgttatacaactttattgttgaaaattttttcatttgaaatcatttactacccgaaaaattatttgaatttcttatatttttaaattcaaattttatatggtttaatcaaactcggatggagaaatgaccaaaataaaaatgatagatctcaataagttatacaactttgtttttaacaacttttttcatatgagttgatttagtgcctttaaattcgttttaaagagccacatgtaaaatgaaaattgatttttacattaaaaaaatcccccattttcttcaccccaaccttatcctcttgactcttcctctcctctctctcacacacacactttctactctctctctctcacttcctctcatccacagggcgcaggtcgggtcgggcggcggccggccgagagcggtgcggagcggggcaggcggccggccgaatcggaaaattggtccggacagacggaaagtatccgaaccactttcatccctagtccgaacaagattaccggaaggtttcttttgcccatatatattttctctccgtgtttttaatagatgacgccgttgacttttatacatatatttgactattcattttatttaaaaattttatgtaaatgtataagatataaataaaactttaagcaaatgtataagatataaattatgcttaaatactttgtgtgataaaacaactcacaacaaaataaagtataatcagttaaattttttgaataagacaaatgaacaaacgtatgataaaaagttaacggcatcatgtattaaaacacggaggtagtatataacaatccatttgaccaccgtcatctctcttaaatcaatcatgacactatccaaaatttgcaaactcaatgaatggccattttctgtttcttccaggatctaccaagattccagccggagaacatggagaagaacacggtgatcttcgagcgggtgagcgtgatggcgacgaggaagggctgcacggcgtcgcagctggcgctggcgtgggtgcatcatcaggggagcgacgtctgcccgatcccgggcaccagcaccaccaagggtggccaacttcgaccagaacgtggcggcgctgggcgtgcgcctcgcggcggaggagatggccgagctcgagtcgttggcggcggcggacgtgctgcgcggggacaggtaccacgccagcttcctcaccacctagagggactccgagacaccgccattgtcgtcctggaaggaataagattgaatgataactacacaagtgtggctatgcctccattatccttcttggcgttgtgaaatatgcacttgtgttgtgtgtgttaataaattcttaatatgagatgttccctatacaaggtttgctatggtccaacagatagtacctcaaggtannnnnnnnnnnnnnnnnnnnnaattgatgggggcacgattggaaacgaactcaagccctctccctagcacaaatgagcacttgtatatagatgcctttcaatcttctagtcctcgcgtgcccgcatcgacaccgtaatctctagctagccctgcctacgaaaaaattcttgatacgatgctgtccacttgtctgctcctgtgaggtaccaaagttttgatgggcggtaaaaaaaaaaactctccccatatagtttgatagtgtaaactcttttatttgacggtatgtaatcacagttctccatcttacctctgccagagattttatagcttataataaaatcccgttgttcaaaaatttggggtttgagagttgtgctaaaatttctattaattatttagttccataaacataatgcagagatcagcagaaaaaaaaaaggagagtgtgctaattggtacacagttatacttcttttagatcaaatcattcattgatctactaaatacatgcacggttaccaaataattaacaaccagaattcctatttggacttttgattggaaattaagcataaacatacatagtattttgagtacatatgttttgaatttgaagcagaagaaaacagtgttttgaaattatgtgtttctgtagtaacaggattctaatataattggtgacaaagtaatttcagttatttctagtatactcaccatattgcgtgcttggtgagctcggcgtcaccacggacatttccatgcctacttaatttcattgacgctgcttcggtgtaacactaatctatctgctcatccatgttgctcagaagtgcatttgaaatccccccacaaatttttgatgcaaaatttgttgtattcaagcctagagctgggacatgggctgtgcattctggggccgaggcaggcccagggaaggcagcccggcacaacgaaaaacactatagcctcaggccgatttgaacctagccgggcagttgggccgtgcctgtgcctgaaaatttggcacgatggctgtcatgttaaagtcctattttggctccactatgatctggaatcatagttatgaggatcagaccatacgtcaaaccgttgaagccctcgatttagtgttcgctcagtctgaccggttcgaccactcgttcaacacgactcaaatatactagtactaatggccgtccttgatattttttttgtctgaactctaatgaaagaattgctttcgcccacacgtttcctaccaataacacgagggggaatgtgtttttcttttgctgtagggatgtggaaggatctacttgcaaaaagaagtttcatgaaggaccacaagaagattccaccgatgcaacaatccaacggttcgcatcatctggagtgaagatctgacgacctttgttttagacgtggacatggtaactttgcaataaaggattcttctttcacttatttagattagcgatttcaattaaattgtcaactgatacatagctcagtggtgtaagacaacacctgggccctaaggtcagggggttcgaacaacacggcaagcaccacaaagggtaacaattctgaggcgtttgtcgtctatatacataaagagagcagggtgtcatgggtctagtagtcgatgctatgcaatgaggctaaatagcatgtccacgtagccatgtattcaataaggcagtaaatgaaatgaattgaatttgattcctctcctgttgttcttcttcttcctttgtctccttctattctgcactagattccccagtctctttccatattatattgagttctcattgtattcgatcttgtggtagtttgtgtgattcgatctctcacgaacttgggtcataacaattggtatcaaagccgttccgatccatcgtctcttggtctgagcagtagatccaagcaaggttggtgtttatccttagcgccgtgattctgttccatggtttgagcagcgagaagatgagtgaagacggtggttgtcatgctcatggagacggtcatgtatgctttgaacaacacggcaagcaccacaaagggtaacaattttggtgaagctttgaaaagttagatgtcatgcttcacaaaggaggccatgtatgctcgaattttggtgaagctttgaaaagttagatgtcaatttggaccataccctcggttgtgcatcctcttccccagccggcctccgatgtaaattaatgcttcaccagcatcctcggatatcaccagtaatgtgaatggttgcaggagaaagaaagattgaggagattcagagagaatatgatttaggggggcaacgtagatatttcacgtcatccgttcacactgggacacctaagaaaacaatattaagaatttagaggttatatctccattgacaaaaacatctaaggccaaacctaaaaatggacattttcaaaagttgtcggtttttattgcgacaactagtggaaattcccccttggctacaacatttccactgttctcttttttttcttcttctttcctctctggctcagcttgctcggcacatctgttattttaatattttttaattcccagcttgcatcagtaaccacggcagcaacaaacgaagagtagaccaggcagcaggcagcagagcacaaagcagcagcagtagaaaatagcaagcaggagcagggatgggcagagcaaaagctagcgggggtggaagccagctagagcagatcgatccatctctttacgcctcttttttatccgttctccctttatttatttttgagagtgaatcgaacattagtctagatatcttaaccatgtactttcgtatcggatcagggacagtggcggacctaagatttttttatcttgggtgtgcccacgtaaaccttagtatacaaattgagtatttcattaaggttttaatctgaagatagaacggtactagagaggtgaaaaactacttgatgaccttatctaggctatgtttagttccacgataaaattgaaaatttaaagaaattaaaacgatgtgacgaaaaaattaaaagtttatgtgtgtaggtaagtttggtgtgacaaaaagttagaggaagaaaaaagttggaatctaaacaggaccctaagtcttgggacaaactccaagccccagttgcttgtcctggctgccaatgacccaatggccttaggcagcggcgtgcctttattctcaacc

SEQ ID NO: 73142 - DNA, 504 bp, Oryza sativa
gctgatggatggtcggatggaaccgagatggcgagatcgcacggtgcatgcatacgctggtactgtgaccctgcagcaaaggatagctgcgctgtggttcactggtagtgggttatgaaaactaaggatttaatatgatatcttgtgcgtacaaaccggatttcagaacgtttacctggtagttgtctggcgatcgcatggtattgtccaatgttagtcgcatagatttcggccgtttcgtcgatctgcggttcttcgaagacgttgctgaggtcctatcagtgcgagagcaaggcaagtcatgcattacaaatgatcatgatgtactcaatttacaaatgttccgttttctattaaatgttatattattttacaatatcatatgggatgggtcctattactcagccatatgttgttcaccttatgccattgataatttgggtattaatcggataagatgttggtttagaaaatgcttagccatgcttagatccactagctcac

SEQ ID NO: 73143 - DNA, 521 bp, Oryza sativa
tattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatacaaaggcttgctgggccgggccatggccgattcggccaagtcccatccctaggtccagcgccattatggctagcgttgagttcccagcccgcaagccatccagaaggcttgccgggctgggccatggacgattctgccaagtcccacctcagcgccgggtgggctggcgctgaggtccctaggtccagcgccattatgcctggcgctgagttccaagcccgcaaggggtccagcgccattatggttggcgctgagttcctagcccgcaagcca

SEQ ID NO: 73144 - DNA, 2447 bp, Oryza sativa
agaggaggacacaacgatccttaccactacttacacgaagacggacagtgaagggagaagccggtggcgagctttggaaggcagaggtcttcgggacatgccgacgacggtgctccgactatcctcggtgaagaagagagagcaactgaggttctccttggcggtgtgataccgacggtggcttcggcatggtcgggcggtgatgggatcagcggttggagatgcggcaacggcggactgcctcgggtgaatggcgacgaaggccttcctggggcctttgttggacgggaaatggaggcagggctttggcttgctgttgcagtacctacagtggaagtagcgcagcttggagatgcccgaggtgacgacgtgacacgaccgaaaatcggcggtggcggcggacagagaagacaagcgccgcggcggctctagagcacgggaaaaactcgtgttagggttggaaaagagagaggaggtctggggcatgctatttatagccaaaggaggaggagatcgaccttgacacgagagaatttgatggcagaagagctagggttcaaagagaaaacagaactcaaatcacacatcgaatccacgtgatttactacggaatttcctctgactattgagtggaaataaagaggagtatgacgcgaagaaatcccctcaaccaatttggggaaaacgaccacaaggccagtcggatttggtggtggagtcaggcggcgttgggctctgctgggaggagtccggccagaggtaggaggcggacctgacatgtggggttcggtcccacatgtcagcgggatcagggagaggaggcatggaagggacgcaaggtggacttgcagtgcgaaacaatgggccggcgtggtggtgtggctctgccaacaacactaactttgcattttttacaaattagttcttcatattttttgatattatgcaatagtctaatatttgtttgaatcaataccatacatagaaaattcgaaatgacattgacaattgcccaattacaagaaataccatcgacaagtgcaatttgccattctacagcgactttgtcctataaatgccatcgtcattagggttccacccatcccgccccattaaatgtattgttcagcctatagctcttaatggagggctactaacggaaccctaacggcgatggcacactacgccagaaccctacatctgtgacggcataccagtgacgggcctatgaattggtcatagatgaccgtcacctttgacgggtcgctaggtttgccgtcatcggtgaggcatccgggcgtagcccgtcacaggtattccctcacctgtgatgggccggaaggaaaagccgtcacaggtgaggaagtgatgggttttcctcccaacccgtcacaggtgagggtatcccctcacctgtgacgggccgtggcattatgagccgtcacaggtggtagtccgccacctgtgacggattttttttacggcccgtcataggtaggttaatacctttgacgggcaactcaattgaagcccgtcaaaggtatgaccaacacctttgatgggcttttttaatctaacccgtttgaggtgtgttgggtctataaataccccccaaaccgccaactgctttccatcccgaccagttcactgttcacaaatcggttgggagggcaaggggggcgattttttgctaaaatttaaggtaaaaaacacattattctccattccttctcaatatattgatcatcatatatttttcttcatatgttgttgatttcagatggatcgtagatggatgtactatgcacatcgttcgtctaccgagtatagagaaggggtcactgaatttgtcacatttgcggataatgacagaaaaagtaggatgagcatgcacatgttgtgtccatgtagggactgtaagaatgaacagatgatcgaagatagcgatgaagtgcatgctcatttgataatgaatggattcatgaagaaatatacctgctggaccaagcatggagagcaagaggcgcctgattgtcacgcccggaaattcactagtaatttctgaactttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaagagaagtaaaatagtggagta

SEQ ID NO: 73145 - DNA, 2163 bp, Oryza sativa
ctgagctcgcgcagaaggccggagaagctctccggcccgcagcccccgccgccgtcgtggtcgaactccaccacggagtgctcccagaggaaggacgacgacgcggacgtcatggtaagagtgtccgtcgtcgtcgaccccgacgggttcgtcccggcgctcctgcgccgcgtcgccgttgtcgacggcgtccccgccgccgatgccgagacggacacgctcttcgcgtccttgcagccgcagccgagcgtgaaccccgcgccggcgtggcgcttcttggccgaaacgccaggactcatcatgccctgtgatctcgtcactcgctagctaagctgcggatgcaaactgtgcgtgcgttgcaacctcaaaagagacttccggtttctctcgttggctcgcgcgctgcaagcttataaagcaacggagatggcaagcgtgcaccgcaagtgcgtggtcctcccaaattgcacacggttaaaatccaggggaaaaaagggatcaatgccgggattgtctcgttgcacagaacacaacccgggccgtcaaatgattcctcacccaatataaaacaaaaggcagtcaaaacaggctgtcgcatgcacaagattttctcttgttgcaaagctactgatctgtatctgtatgactgtatggttgtataatgtattgtcctgtctgcaaaatgtatactgcttagtacagtgtttacaattaactacgtgttggatagtacagtagcaccattaacttctcgcgatgggctgatggtccattggtccctggctccttgcaactgcaatttcggggtataccgttttggcgtttggcgtagctggtcagctcggggcatcgctgatgcatttccgtttggtgtttgccgtgcacggcagggtgatttccggacgcgcgtcttctgttaggctgttaattgctgtgcatgcattctgctggaattctgccgtcgttttcggaagtttgtaggtagtctctgagatttgataagttaagggcagcgcgaaaatgtggcgtactttcaagtccacgactggccatgatttgacttggtaaatgctctgttctgttgtgcagcagcagagccaataacatggttgagtcgaacggctaataacgtttctttgattatcaactatttttcgaacatcaatggtaattcttagtgaaagttacagtggcggagcctgatctgcgcgggagtttccttcgctgcggtcgtttctgtttgcatgaatgaacacgggcatgtgtagagtaaatggaggagcttcttaagttaggcaacaaaatgtgagaaactagtacagtagtgttccaagtacatgcataatgcgttcccgaaaatgacaaagttaaggatcgcatggtgaggtcgatggcgggcgcgtgtggataattgtacggggccgagagcccgagacagctgggctctgctctgaatgacggtattgatcgtgagagcctaactccacaccccacgggcacacacgattcagttttttggtagagaaaaagaggtagttgattcaatccaaaacagaaaaggaccagagccaacagcttcaacatgggctgtttgagtgtttgggacaaaaagatcgtcacacgtactattattgttttggtggattgaagatacgcacccatgttgtacatttacgtagcaggaagcttccaaggcatatcagctagatcgtaccaagattgctaacaatattcttgagggtccacttggctgttggttgattgaaacgttcatcgttagaagtctaaactagaattggaagggaaagaaaagaatttcgctagtgcaatctgtttcaagctaatcatgcccatcatctcctaagactgaaggaacgctggtttgtatgagtatcacatctcaaactgcatttaattttggaaaaaagtacgaattaccgcccaactatcgcggtcgtccgaattacccccctaaaccataaaaccggacattcttcacccccaactatacaaacaggatgaattaccctctcgatccaatccacggtggttttggtctacgtggcatatacctgcagtccagtcagcattctaattataaaaaaaaagttagacccccctgtcatattcaattccactattcctttttctcactcttcctct

SEQ ID NO: 73146 - DNA, 572 bp, Oryza sativa
gaaataccatcagaggagggttatctggagcaagtgcctccgcaacaaattgtggccccaaagatgaaccaccaattcctatagaaagtatttgagtaaatcggccagcaggggaagatggaggtcttatctgcattaagtaaaccatcacaaaagtagcatgataagttgacacaagacataaaacgtacctacaaaagatgcaatgtgctaatgatacaatattgtattgttacgacaagtaatacaccactaagttgtttggatgctctgttatcccacatagaaccagaacttaacaccactaaggccctgctcttttcagccacttcactggattattgtcacggaaattgtttcttctactgcattgtttagttctcttgttgtaaggtaaattcatcaagtttatttattagaatacttaatttatatccataatcgtgtatataatccactacaataatccggccaataatctgttgactacaatgctaacaggtcaaattattaaattaattaatattaaccccgagaagcagcctatccctatgacctattccatgccttat

SEQ ID NO: 73147 - DNA, 8833 bp, Oryza sativa
  unsure (1)..(8833): unsure at all n locations
gcttgggcaactaccttggggaaggtagttgagatacagcatgtggagacatgagcgccacattgccatgacattgatgagatgatttgtgaaagaaagttaaaactaaacaaatgttttcgactggggcggctggaggacttgggtggtgtccggtaaaggctagtgccgtccctagtcagttaaggaccgagccatgaagttaagcatgaaacaacccccgtacaaccatacttctcgtgtgggtatagacctagcggagtaaatagccgagcggatacccaggccgtagtggttttcttgttgtgtgtgaggcagggcctacggtagggcagccattggtaggaccgcgtggggcgggtgcctacagtggtgtcgccatcggtaggactaccatgtgtaaacctaaacttaactataacttaatgaatgtgtgagtctttccccctcgggagcgccagaactcctctcactgctaaaaaccttggacgcctagagtgcatgaggactaaagttcatggagcaggtactgccaatgtgaggttattgaaaggctttgccgtggcaagtctcattcattgagacgtaggctcatgtattgggcaagtcgcggagtacgggtaaagtgcacatccactgcagtgtgagtaaaccaaatctattcgaatagccgagctcgcggttattgagcaccgggacatgtattacacttggctagactctaatttcttaaactgattgggtgggatgctgcacgatgattttgttctggtggaacaacttctcgagaggcgagaaggggtagaccccagaaaaccatgacgaccagtggcgggaagctatccttgggaacacaatggatggtggacagaactgtcgctgtttaatgaacaacggaattaaaacttgatcagtttatgctaggtcttaggtttgtgaaatgatatttgaaaactcagctttacgcaaagtaaccatagccactccttgtattatcctgtacattactgcattttgtgtggtggcttgctgagtacttttgtactcattggtgctctatatatatcttgtagcagagtgttgaagagaagcccttggattgcggttccattctaggtctcgttcccagtcgactgcttgtggcatgtcaaccgggcccttatattattttggcttctgttggtgttctctgatagttggtggcctgcctagccctaatgtaagcatttaactctcttagtctgaattcattcgtgatatgttgtgattcggctatgtatgtgtgaaccaactactgatccagggattggtactgataaacacggaagatttctgatttacataatcggaggtcgacagttctttgaatcgatctctttattgaatccgcctcgatccaaatgtcgaacctggttcacaatttacaaaatttagtcgtcaacacaagccccccaagtccactatatttgtaatgtggcggatttgctcaatttccttttccgagccgatctagggtttcctttaccgactctgntttggccggtaccgcgttctcttttaaatagtaaccaccgctttgcacttttcacggcgtcagcttccattttaaccgctctaacaacaaactttccccaatccttctcctcgagccctctagcgacgatttcgagctttccgacgatctagagacgatcctcgcaggtatcaacttccgctagcgacaatgtcgtcttccgccagacctccgagcgcatcaaccgtggaatacgtcgaggtaagttcccatcggctaaaactcccttttttctgcatccgactggttcttcttcctttatcaatcctcgatttctcctcttccgcagcatctcgctcatctgattgctgtcccaagcattgccgataacctccagctcttccttggcccaatcggcaacctagatcccactgagttcataaatggtgaaaccaaccgaatccccttcagattcaccaacccaaatctcagtacttggaagggtaccttcaaatcctggccatcagccaaaaccaccaggcctgcttggtacaagaggatgtcggtcagcaaatcggatcactgggatgagatcggcatatcccaagctctggcattaactgcagcaaacatggcaaggaatgaacccatgatggcaacagctacctatttctggtgcacagccatgaatgccttcctgttctcacaaggaccgatgaccccaattttactagatatcaccatgattactggcttagatatcacctcatcgactaacctatccagccttaacacccaactcactcacgagtttaaaactagaagcataggcggttggggtggttatattgctaagtatatgggaactgggtcggttactccaagggaagaaacagcttttatcatgatgtggctagaaaagttcttgttctgtggcccaagatgttgtccaactgcaaactggcaaaggatagctgaaaacctggtggaaaagaaacattttccccttggcaaatatttgttaggctacttgtatcagactctcaatactgcaatcgacaagatggcctctggaaaaataatcggcataggaggtccatggtagttgctccaaatttggctgaatctgcacaccagaaaagttgccaatcggccagaactaaccgatgtggaatttccaagattcgagccgatcatcaagaacgatggagaaaaaagcacgacctgcatgataaatacagggcaagaatatcatatccagatgacatatgaattttatcatccgacaagtgttgcaaggcaatttggcatgggtcagctgtcacatcctgattttcgctttaggattcataaattatttaataaattatttttagaatttatattaaatattcattaatttacaagtgaagttaaatgtgagaaatcaaattttctaaatataaagtatggctggatttaatttttattaaattcgccatagttaattatactctctggaattttctttgatttttcggagctcaatttgtaattttaataatacaaacaacatttcagtaattattcacatattaaattaatcattaaatggtctgcttataatttttttaaatacttatagtgttcaagtactttcatgatttttcttgaaattatttgagtaatagaagtatttttaacaattcaaggaccatttcagagattaatttaattggaaaagtaattaaatcctcttttccttttcgggccgaaacaggaaaagtcctctctctttctcggcccaatctctctctcggcctgcagcccctctccctctctctgtcgaagtctgctttgtgtccctctttcaatcaggccttggaagaagaagcctagccgaaagtctgtttctcctccctgtcgctacagtggcatcttcaacctccagccagccgtccagagcccctgttcttcccgatccggcgccgttttctcctccaaatccggcctcttctttcgatactttgcaaaaaaaaatttttttgaaacgtaattaattgatactttgcaaaattaattgaggggatttgtttcccttatcctcctctatctcttcccccaaaaatctagttttatccctttgaattcgacgcgaatttggattcgttttcgagtttatctctccaccaaaccctaggttttcccggcgcgattccttgcgttccaagcccgatctctctctcccgtggctataaatagagtcccctccctctcctctttcgtttccaacccctaactcgagctcccgtgccctagccgtctctccccacgctcgccttctctctccaactccggccgccatcttcagccgccttttcccgtcgcgccggctgttctcgatcagtgacgccacttccctccgctccgcaaggttgatctctaccacggccgccagttcttttgcgccaaatcccgccggaaggttgccgtcaccgtgaacctgtgggttgttgccttggttcgatatccagccgtgccgttcgtcgtcgtccgtcgtcgccttcggtcgccgtagccttcatcggattcgcagctgtaaggagaacatcgtccaccacctcttcttcgccaaagatcgccagaaagccgttgccgtcgttgatcagtaccccgtcgccactcctgatctcgtcgctggccatctccttcgttgttcatcgctgcgtaagtgttggtaaggatcgtcgcgtcctcctcttcctccccgtgctaccggtttctgctgtcgtgctgccattcaccagtgtaggtttttccctagggtcttaatccaatctaacctaatccgttgtttgtctagcgtcatcgccgtctccgtgtattgccgccggatcatcgtcgtcgtctctccctctccgatcactttggttcggtgaggcttctatctgtgttccctcggtttaggttttaatctctcgtttgtgtcattgagtagcccccgtcgtgccacgcttagctgctgccctagtgtcaccgctgcgctagccgcctagccgtcgttgtgccgctccatgctacagccgtgctgctgctgctcgtgagtgccaagtcattgccgtcccgctaccgcagccaccatttgccgtcgctgctgtgccgtgtcgcattcgtgtaatcctaggttcctaccggtctattgtttgccgtaccggggctttactgtgaatcgtgtcgagctcaacggtttagccgcagccgttgttgagtcgttcactcgttcgttcgaaagaggtgtcccctgtgcttcattcgttcgtccgtgttgagtcatcctttagtttagagccgttcagagccgccggcgttgatcctgcgtggttgccatgtcatcgccttgtcagctgccgtccctgccatctaagtgtcacgccgtctctcagaacccacatggcagccatctaaaaccttagatcagatcaatccgagccatccaattttggtctcagccgtccaaaatcaatataaatcctgttattccttttcaatagcatattagttctttttactatatgttgtatactaaattcattccaataattttccagaggatgctttagtcttatatctcagatataaattatttgtaaattgtttaattaatttggaatagtcttttctttaataggtttaattggaattaatcttgtaaaattcataactaattcatatgaagtcagaatgaggccgttcaagtctcataattcatctaaaatcatgatctatatgtttgtttacttttatgtactgtttatttggtttttattagtctttttcttcgttttgcgtgttagcttgtcgtttccgttgttgcaaaggttcgtgagtgcattggaagtgattcagaagaataattgaagactgattattgcaaggcaagtcatacagatcccaaacacaatcctttcagcatgttgatcctatatttaaattctctatttatttcaactgtgcatttatattcgaatgtcaccgggtggtgtgaacctattcctttgttatggccaatttgcattgattaccttattccttgataccttgggtaataaattgattagcttgaaccttatatattggtttggttcagctaaacgctttatatatataattgcttagccatgcttagaaacattagcacatgattgggataactaatgttacactatcacttatgattatatttaatggtagctcacgatggtcagttgtgattggttaattaattattttgcaattaaaacttgtcaatggtgggttgtgagcacatggttttgaaggtcgtgctcacgacaattaaggaccggttcgtgagctactgttgtgagacattaaccgtgccaaccacaagctagcgtgcgcaacggctttaccttttgtatagcatggttcattacggggtgccagactgagaagcggcgagaagtccgtgggggtcgctggggagtccatgcctctggttatatttatagagggggtgattatgatccatgaatggtgcactgtaaagagttgtgttgtgcagagggtattgtcacagcctctattcgggtactttccagtatcgcgacgcatggtagacatgatgttaaggctgtgtcttgtgggtacagtggtatacctctggccagagtaaaactattcgaatagccgtacccgcggttatgggcgggttgagcaatgtttttcgtgattagtctcacacctctcacaataattattgatgctataactggtaataatttgcttagctcctggtttggagttagatctgtacagccgggtatggttgttcaggatggttgggcctgtgcagcatgggtgtgctgtgcagtgttgattaaaattgatgattaattactctactgttttactactcttaaatgtttgctaaatgctgcttttgcaaatgagcctatattatgccatcctttggtatccttgtgcacttgcatatttgttgtgtggcttgcggagtattccatgtactcaccttgcaataatcaatcaacctcagttgaagaaaaaggatccagaaggaaaagaaatttggcttataccccagttgagctgcctgtgggagtggagctgaagtcatcgctagaccgttaattccgctgttgtttttcttttcttttgtaagtatgtaacgatgttattatgatggatttgtatattaaattgttagtttgtgtacctcagctgattcctggacgagggttttatgcacaaataagtccagaaattactagtgaatttccgggcgtgacatcagctgccaatcagcctattcttttgcgacaagatccaaagcagaggagagattacatcattccttatgatggataggctactgaacctagaaggaccacctttaggcagtattgagaacatcaagctaaagatattcaggagtgcagccttcgaccgatggtggatagagtggaaaaaacatatgttccatcaatcgccatccatgtatcttacaaaccttttccctgacgatgtcccttaggtaaaaatcatctccttcaattaattttcatcaaccaccagccgatgcattatcttatatgatttttgtttcttgcagacaacagaaacttctcctcctcaccaaagcataagtggtgttgaaatcgaatatgctccaggactcctccccaatggtggtggactaacacctccagtcatcggctataatgcccccaagacctccacactgctacatggtctatctcgtaatattcccaagcaaagcaatctctatactccttcgaaagctctattaacttggttctaaactctgccgataattttttattgataaatgtctgccttggcctatctcctgggcctatgtcaatctcttctaattcattagccgacatgaccatgtccttggtgtagaaattcgaaccctccacgacgctctcaaaataataatttggggtctccatcttcacttggctgtatatcacaattggacacttttagaaaatctccatcccaaacttttccagacagtcaatcaatcccatccatctcccaaagagctaaatcggcactagcaactttaactgacctgtcggctggcacgatctcaatcttgttaccttgccattgaatcaagtactggtgcatggtcgaaggaatacaacaattagcatgaatccaatcctatcggagatatgggcccgggggtatgcgaaatgagggaaatctaccttcccatcttaccacgtgtccctacagcctggccctacccccgcattccgcgagtcgcaggagcggccgggagggggggcctcggggtgccacgtcatgcccctcgggcccttgcaccgctttgccccgaggccctcgcccagccgccatttggcggggggagcaagcaaggagggggcccaggctaaacctcctttaatgcacgcagcgccccaactgccccctgccgcatttaatgcagtggggcagacgtgcggcgtgctcgactggcgcgcgatagtcaagaatgaccggtctgtgactggcctgacgccggtcacgtctgactggacggacaaccgtgctcccacgtcgcatctgcctccggcggagtggaggtaggaatgacccgtcccatcggagggtcattcggagggcggtcacgacaagtcttcacccattaatgagggaatgacagggttgtcccccgtgtcaggcgagggacggcgctgggccccgctcaaggacaagctgtggtttagcttccaggcaaaggcacgggtagagttccggtcaaggtagggtgggtccccacctgagagaagagtaggtagaggcggtgcatgtggtatccccttgaggtataaaagaaggaccttgcccaccaggaaaggggatgactctgagaaaacctaagctcggggaggagggaactaagattgttctccggagtttaggaacccttgtaactctcagtctaaatcccataaacaggagtaggatattacgcttcatagtggcccgaacctatataatttggttgtgtgcgagctagctaggagccttgggaacagatacgtgatttccagaggcgagctttttcccccggccgaactcacgaaaggggggtctcatgatctcctgctagagaggatcactccttgacaaatcccttccaagcaacaggctataggaacccttcccatcgatgacaaaaaatgttgtagggacagtcttgctgccgactgtcagctccacatttaaaactcccttgatctccgatggattgcggccaaa

SEQ ID NO: 73148 - DNA, 4910 bp, Oryza sativa
cacactcatcaatgaatttctccaatgatgggaatgcacccatacctacacacaaagcaaacaacaaacgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaatgacaaaacgatttgcaaagaattctagataagaaagaaaggaaaattttcacaaattatgttttcggaaaattagtccttaaggtttgaccatttggcttatcctacagtcaagatggctctgataccaacttgtcacgcccggaaattcactagtaatttctgaactttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaagagaagtaaaatagtggagtaattaatcagaaattttaatcaacactgaacagcacacccatgctgcacaggcccaaccatcctgaacaaccatacccggctgtacagatctaactccaaaccaggagctaaacaaattattaccaagtataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctgaacactcctgacgcactcacgaaccttcgcaacgacggaaacgacaagctaacacgcaaaacgaagaaaaagactaataaaaaccaaataaacaatacatataaagtaaacaaacatgtagatcatgattttagatgaatttagcaacttgaaccacctgaaacggatctacggttatttagttatgattttccgaagatttaatctattagaaaaaagggaaaaaggaaggatgatgatgtcatgctgacatcatccatggcggccgaaccacgatgacgacctcgccggagatagagcggccggctgcggatttggagggcatgtacacgtagaggacgacgagacgaacccaacggtactcaccacaacgacaaacgacgtccgacgacggccggcaacgacggggaacgggcggcggctcgggttgaccgacggcggcgagctacggcgaccggcggcgaagaaggacgggcggccgggcttcctctctcctcggcgcacctcttggcggcggcggcaagcggcggcgacggcaagggcggcggcgcgacctcgccgaagctcggccggcggcggcggcgagttggacgacgcggcgacgaggctacggggcactagagagctcgggaaaaggggcaaacgaaagaggaggactagagggtcctatttatagccttggattgaagagatcggactcctcccgcaagaaatcgatccgagaaatcaaaaactcggttttggagataaacccgaaaacgagtttgattcgagcaatatactcaaccatttgctccgattcttgaggggaaagatagaggaggacgagaggatcaaaacccctcaaaaatccggaagaaaaagggccggattggatgcggatttgagggagaaaaggggcggctcgggctcggcatgcacggctcggctctgtctccagccggctggagattgaagatgacactgtagcagggaggcaaactagacttttggctgggcttctacttcttggcccgattgaaagagggacacaaagcagactttggaggagggataaggccagccgaaaggaaaggagaatgggccgaggactgaagctgaacttttcctatttcggcccgaaaaggagaaggggattttaaatacttttccaattaaattaatcactgaaatgatctttgaattgttaaaaatacttccaatgctcaaataatttcaagaaaatcctgaaaatacttggacactcaaagtacttaacaaaattacaattagaccatttaatgattaatttaatatgtgggtaattactgaaatgctctttgtatgattaaaattaggaattgagctccgaaaaatccgagaatattccagagagtataattaaccatggagaatttaataaaaattaaatccaaccatgctttatatttaggaaattttatttcccacatttaactttacttgtaaattaatgaacatttaatataaattctattattaatttattaaataatttataaatcctgaaacgaaaatcaggatgtgacaaatctaccccccttacaaagaatctcgtcccgagattcggaacggctagaaagaaaaaggcataggtaaactgcagtctatcttattccataactccgataattattctaaggctttaaagaaaactactgccgctttgaaactggtggctgagttgtaacacttgaagacgcaactcttgaagacgcaactggcactgcattggctcctgtgacgacaatgttgttgacttgaccttgcgactgcggatgcttcggcttcggacactctcttgcaaagtggcctggcttgtaacagttgaaatatacctgctgctcccttccactactgttattcgactgatcctgctgaactagcaccggctgatttgcttgctcgatgttaacttcattgctttcattagtctctgatttgatctcaccaccgatgttcaactgttgcgattgtccttgaccagcggaagaagattcactaatttggagtggcttgatacgctgcctctggctactaccttgtgcctcctgggatacagtcattttccttttacggttatccatcctgttcttcttgtcttcaagtcgaattgctttgtcaaccagctgctgaaaatcaacatagtcatgagagatcaacataactgacagctcatcctttaagccttccaaaaacttctcctgcctttcctcgtcagtacgcacatcttctggagcataacgtgccagacgattgaactcatgaagatactctgccacggtacgatccttgtgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaatgacaaaacgatttgcaaagaattctagataagaaagaaaggaaaattttcacaaattatgttttcggaaaattagtccttaaggtttgaccatttggcttatcctacagtcaagatggctctgataccaacttgtcacgcccggaaattcactagtaatttctgaactttatttgtgcataaaatcctcgtccaggaatcaaccgaggtacacaaact

SEQ ID NO: 73149 - DNA, 1689 bp, Oryza sativa
cgtctcgcgccaccgcctgcccaccgcccggccccgcgcgctgccgtccgcccgtccgccgctccctcgtctcgcgccgccgctatccaccgggaggcccccgaggtcgacccggccgcggcgcgcagcctcccggcggctgccgcctcgcctcacctcgccgctgcctccgccgtcgccgtttgaacactgaaggagaagagagaaagagagtgagggatagaagagagagaagagagagaaaaactgacaggtggggcccacctattttttaataaataagttgctgactggactgccacgcgtacgccacgtagaccaaaaccaccacggattgggtcgagggggggtaattcgtcctgtttacatagttgggggtgaagaatgtccggttttgtagttcaggggggtaattcggacgactgcgttagttcgagggggtaattcgtactttttcctataattaaatagaaaggggttgtgattggttgagaagtggaggtaggtaagaaaagtgaatggtaaagggttgtgattggttgtgaaatgaatgttggttgagaggttgttatattttgagacaaatcctaagtgctaaaagttgttatattttgggacggatggagtattaatatatggtcccacctgtcatacacacattacgtcttggagtccgtgctgcagctggctacagatctgtagcctgctgctcttctctctcatcttttatctcattaaattatgtttatagctggctaatagtctgctattgtacctgctctttagacccaagattcagcatcgcaccctctcggtcaccagaatttccaattagctcgtcgatatcttgtcgatgccttctctccttgtagccgccttgtattccagaagtatactgaatccgtccattaggcctgatctagccatccttgttatcatcgacattgctaagagcaagtataatagtaggctataagccagctaaatgctgagttggagaaaagaagagaagagagagaggagaagcgggctgtaaactaacagccggcttggatataagaaccaagaaactctgtgagagagacaagtgggccctgtattaattatgaagagctaactattatatggataggctgagagaaggctataaagaaccttatagccagcaggtcggctgtattattagccttgctataaggaaccactatcttcccttcttagcgtagccaccttttatcaattggagagctttagatctagccatcaggccagattcatataccttggatgccactggcaccgccatcgtcttaggttactgccatcgagccatagttggccactcgggtaccgctgtcacctataactcccgctatcttcattcacgccccatctttcgcctatgccaagatgttcgtcgtgatgtccttagcatgttcaggttgtgcatggcctatcgaatatgtgcctcccctccaactgcctctccatacttctccgcgaggcatcactaccacctatctaagcaccctttctcgcaacctcattagtggcctcttcatgtgtctatttgccggcattagccaactcttctgcattagagaaaccgcacgcacgccaccgcggggtgccttctccatcgccttcaccaaatccggtgcgacgggtgtggggggggggggggggggg

SEQ ID NO: 73150 - DNA, 654 bp, Oryza sativa
ttcaccaccccacttaataatcctcccaccggtcacaattcacaaccaaattccggtcgaacttttctttggggaagggaagaaacaaacaaaggttgtcaaggcagtcagcactcaacagaccatatgaatatagaataagacatgacattgcttaatttgaacaaacatgttagtaacacaaaattagtgattgcaaaacattattttattattagcacacgtactgcgtgcagtgcacaggcttatagaaccgcacttcacacaagtaggttgtaggcacaaacatgacgaaagcatagaacataacacaatacagacagacaggacatctcattccaaatatacgtgatgtataacaggagcaagcagcgtccagcgactgatgaatacgttctacaaaatcttgtgtgcgctctgccattcagctattttggaccaggactttgtatttgaacagatgaaaacaattactgagctttccaagatgacaagggaagggtctcagaattttggcaagtagtggtgggcatcgcctgaggataccggtcgcctcgaacatcatctgtgccttgcgtagactcgagttcaccatttcctcaggtgtgagcttcacagatagtgctccaattgtttggttaaaatctcgatttt

SEQ ID NO: 73151 - DNA, 7315 bp, Oryza sativa
gtgagaattgttttggcttcaaaagttgcgaggaaaaaaagagttacaggacatgacataatccctgcggatttgggttttcccatgcgccgagacaaacaaacaaacgggcgccggtctggtcactggtcaggtggcgcgcgcggtgccgtgggcgaggaggacgctggtgggggagaagacgatgccaccgccgccgccgttgttcgccggggtggcggccgcggaggcttccacaggctttcttgaacggccgcgtccgcggtggacgtgccgctcgcagtacttgtgccccggcaccacgtcgcgcgagcaccgccacttcttgccgtccgtgcgcctgcaccgccctgggtccggctccatgctgctccggtagtcgaagcacaggttccccaaccccatcactgccactcaaatgtcaaaaacggcgtccacattatcgaatgatcggaaagctcgacaccaatcaggccaaacgcaatgagaagaaaaagaaaaatatcttgttggcacgtacgggaagggaagcggtgcgggccgaaggaggaggacgcgacgctcttccagatggggagcacgaggtgcaccggcacgggcgcgcccgcggcgaagtagcggtagatgagcacctggtgctccagctcctgctgctgcatgaacgtcagcgccgtcgccttgtgcgccgccgccgccgacgcttccacgtcacgctcgccgcggctgtcgccgccgagtccaagccccagcccaagacccaccggcggcgggggtgctgccatggtcaccactcctacgaaaacacacacgccagacttatcaacacgacttgcacacaaacacgattacatgttcgctcaaaaaaaaaaaaagaacacgcttacacaaacacataccggcattcgggtcagcgccggagaggcgaggcagcttggacggtggctgcggcgagtcggcttccttctcctcatccattctgacaactcggcttgtaactcctcgctcctcggtttcgaactcaatggaggtaaggtttggggttcttggtgggaagaggaatgaagaaagaagatggggggcagtgagttgtcagaggaagggtgaaggagtgggcatatatttatgcgtgcgacggctccccgtcgtctggtcgcccggtaacttgtgcgcagaggtaataacggaagctgaggggatgtgtgggctgtacattgcttgcggtgggcgcgcgcggaggtgtcgcggcgtcggcccctggcgccgggagatgacacgaatgaaaatactttcgacattttctgggcgttggacggacgggcttgacagcctttttatcgcttctgctcgtttactacttttcgcgttggatggacgcagcaacgtgtttttgtgaaaaacggatgctcggatcacgtgttactatggttgataaaccaacgtgttattactactattgtcgctctctcatcgccaattctataccgggaaaaagtgcaccatgcatttacctatataagttttggtaggccgacctccattgattctaattctgcaatattcccatcttacgaaaagaaaaacagtgtatatagaatgtcgttttgtgctaggttggcaatgggatatgacgagagtgggttggacaagaatggccctgccccaaaggccctaatccttgattccatcttccacaaccaaccgtgctagcttctttaggcagaaacttgatggggcccaaatacctgatcgggccattgcacggtcgttggtgtgcaactgagacacaccaaatggtaagatgcaacggtggaggagatggagatagcagggtgagagctggtgaggtgccacgctagtagaggtggatgtgggcgcatagaagccaatgcatgcgagacacgatggtaaagacgtgaactcgtttatgagcagcaagcggtggaaggtggagcacgaacctcacgcaggacatgatcgcgactcatgacttgtaccgtaggcgacgttgatgccactggagtcacaagcaagaagtcaacggtgggttggtgtaggtagcggggtgacacaaatcgagtggttaaaagaggaattggggggggggggggggttggtggatctggcaacgtaggttgccaaagatggtggacgcttggtggcgtggaggaagcttgacactggagttatagaagaagatatctactcaaccatgcagtccatctagatagtaaagaggaggtggccaaccgtggtgtcgtcaaggctatggtggcgatgacgggcgcatctagatgtctagtgaaagctagaggaattagaacggatagaggggataaggttttggttcatgaatcttggtgagatctcaaccattggaatttgagtgattctttccacaagacgttcatatgacactagacaaccccggtttgtattcgagcctactaaatgggttttcttaagaattatgagttgtttctattggccttatcgttttcgaggcctcatggtaggaatggatccctggccttggttatgcacaatggaacatcccccctcctcgcgcatgtggaacccatggggcaaaatctactccgtcccaagcctcataggggcagagacataccccaatgggatttggccacccttaatatatatgcgtatgcaagtatgcaaggaaaaagaactcgtgatttctaggcctaccaggctagttgatctacaatttgtctagactcatgtcaaaatatgcacatgttaatatatgtatgtgtttggtgggaccgtacgttcctcgtgcactaaaggctagacttccgatctctttttagtttagcttttcctagtatgtttggagtttggatacgcgcgtgtcccctgaaatgtacccttaaatgaatatagcaacccatcttcaatatttttcccaatttagaaataggtgctatttccacagctttcacaagcttgcctcgttttgcttgatgcatttgtttttagatattgaatagttttctttccttgacttgctcacatgactaaagatttgtagtagcgatctcgtccaagcgagcaattagggttcccggtgaccatagcttcttgcaagtaggattgtccaaaaaaggctcgaaggctcccaagcaacacaaagctttgtcggcatcagatttgtgttatagtgatgaagggtgttttggaaaactccttgtaggatcataatcctatattatcatttgaaataaagttttggacaccactgaattctataaaattcctatcaaataccttaatccatacaagttttagaaaaatttaacatgtgatcgaatctcacggagagtttctttgagtatctacctttcctaaaattcttcttttttttatcaaatggtaatttttgtatttttacatgttttacaattctctactttatatttatgttgttgtaaaaaaaagtctactccctccaccccaaaatataacaacttctcccccaaaattctcttttcgaccaatcacaacccttcaccattcaatttttccacctacctccacttctcctccaatcacaacaactccccatttaattctaccaactttcttaataaccgtgtccaactataaaaatgtttatattctggaatgaatggagtaatgtattttatattccatttttgtcaatcctatgtttcaaagaaattttagggcccatttgatttggaggaaaaacataggaattttggatgatttcaatcgtataggaaaaaaaatccattgaatgcatttgaaacaaagaattgaatcctatcttatcatgtgaaattcctatggaatggacaatcctatagagattttggaggaaatttagtaagagctttaacctcttgaaaaattttctgtgaatctatctctcttatccgattcttgtgtttttcctgtgatacaatcaaacggtcaaatcctatgtgtttgcaatcttttgttttgcactttcattcctgtcagaagcctttgttttttctatttctatgttttttcattccgttagtgaaactagtacgtaggctttgtttagttccaaactttttcttcaaactttcaacttttccatcatatcaaaactttcctacacacataaacttccaactttttcatcacattgttccaatttcaacaaaatttccaattttaacgtgaactaaacacacccgtagtactagcatttctttggatggatgtcggatggagtgagaacgttccatggacattgagtgagaaagctcctccttttccgcgcacacgcttcctaaactactaaatggtgtgattttttacaagaattttctataggaaaattgctttaaaaaattatattaatccatttttgcaagttaaaatagttaatacttaattaatcatgcgctaatgacttacctcgttttccttatcttcccaatcttctcgatcttcttctcctcaaactcaccctaagtacggacaaagttatttctctccaaaaacatgaagagaaaactattttacaattgctgtgtgtgagtagtttcaggctttgtttagttcacgttaaaattgaaagtttgattgaaattggaatgatgtgacagaaaaattggaagtttatatgtgtagaaaagttttaatgtgatggaaaagttaaaagtttaaagaaaaagtttgtaactaaaccaggtctgagttaagcccgcttggatctactcgcctgtcacgtgaacattggactcctcctctgacttctgacaacatgtcagccttttgtttcgttccgcgttttctattgcctcggccataccgtgatgaacttcgagagagaacagaagaaacgcacactgacgctaacccgcattacaaatacggactcatttgtaaacaccgatcgttaacagaacagagagaacgaagaagaatgagaaactaccgccacaggcaagtggcaacctgcgcgtgcggcgagccggggaggacgtacggtaaaacccagagaggggctgcaaaggaggctggttacatccggtctccaccaaatttttttcccagcgcaaggccttgcgtgattgcgtgaacgtttttggccacggaagatttcgcggtggggatagctagcgagcgacggaaaagcggaggcgatctgcttcgcttccttcctttttctactaggtcccccctactggcggttgcgcatgcagcttgcagcagcagggttgggctgggctcgccgcgcgctgatctccgatccagagcggggcggggcccgtggatcggcgcgtgctacggatactggagcgagggcatggcgtgccgttgctcccgccgaccgcggccgcgtccaccgtttctgtccgcgtctacgcacgtcagggcgtgattgtgctgctacgcgtacgtattctccgtgctcgcgatcatggtgtcacggacagcgaggctgatcgcggtggggggcgccgtctttggagttgcgttgctgcaggggttaccccacggcccagctgtccaactcgtgtcgctacctgccagagctggcctgcatgccgctaggcgtcgacgtcgtcgcgtgctgttcgggaaggacggggaccgagtcaccgagaacgtggcgtcggaaggtatcctatctccggccggggatagctatgatcatcggagtctgataatctgtccatggcaaatgcttggtgctggagcctggcggcctctcaatctactccaacagcatctactcagaggaccgggaagcagataccctatctcgatagctttgcagcatgcgaaccgttcatacagccacatagaccagtacattaacaatttacagcccggcggctcaatcagtcaagatgtcagtccgcccgaattgtcgtttgccgcgctttgctctgttggccgccggtaggcggtggtagagggagtagagagcgagaagccgagaaccgtcgttccacgagcttcttctgcacaggagcagttggaagatgcgtggccatgcaccgcagtgcccatccgcggcgcggagaggcagccggcagccaaaggcgtagaaggccaacaaggcaacaacccgcccatctactgatctacagcggtctaatttgactgacaaaatcacaaaatatagagtttaaaaaactaaagactgacaaaatacatggactttgttgaaaacactggatcattacaaatgtttacgatccaaaacaaggacttaacagaaaattgataggatagttagggatgtaaatgcattgataacagttcaaaataaagggtctggttgcagaaaataggatcaggcattgataacagtttgaaataaagggtctggttgtagaaaataggatcgctccaatggtaggatagcctaggcatcgggcgccgaaggaggagtggaaaaattggacactgacgcatgcgtgcaaaaccactataaattatttttatcttaaattatttatccaaatcatgatctgattgcaccattacattcgttgcaattaaatctttaaaacaagaccacacatggatatattccaacgaaatttttttagcttattattgaattatttttaaatgttgcataatgttccatcaagtatatcggaattgtttcactaagtagatcgaaaatgtttcagttgtttaaatcagacgttgtttcaccttatataaaaacaatgtttcagcaaatagtgaaagaatgtttcagttcactgcaacatttgatctatacataatggaacattacgagtacactaggtgaaacacttttggtggaaaaaaaatgaaacgaattcccttaatagatggtttccaaaatatgtgggtgatttgttgcaaaagaatgtttcagttcactgtatgtttcagttcactgtaacattaaatctatacatagtgaaacattatgagtacactaggtgaaacatttttagtggaacaaaaaataaaacgaattcccttattagagggtttctaaaatatgtgagtgatttgttgcaaaaaagaatgtttcagttcaactgattgtaaggattctcgcgatggcagcggtctgaaacagggacgtaagtgtaaaatagggctaattagatgggccgcataaaacagagaagtgttgtaggttttatttgggccgtggtgcgctaggcgttctgggctcatccgtattgaatgcttccgcgaattttttttatttataatttttcttattaaaagttttacaaaaacaattttccattttgaaaattgacggaaatagtcgcctacgggctgcagg

SEQ ID NO: 73152 - DNA, 8542 bp, Oryza sativa
gtaagagaagctttggagaagaagtcctaggtggagtcctggcttatatcccagttgagcgcctgtgaagatggaaccataggcccgctagtccctgctagtccgctgctgtttattttttattgtcaggtctgaagtgcctttgtaataatgtaaatattatcgatataataaagatgtgtcttttatatcatgtttgtgtgctgtaccccggcttttcctgggacggggattaatacactagcgttctggaaaaggtatttttccaggcgcgacaagctggtatcagagccatctcgactgtaggttaagccaagtggataaaacctaaggacatattttatacatgaaactatttgtgaaagttccttttttctccattccctaatgctatttgcaaaaggtttactcccttcttccttcttcgaatttcaactagtactagatggtcatctttgcgaagaagaagatgccgtcaattgtctgccaaagctccggaagactgttgggtccgctagcgaagcaaaggaagctgtgaagccagctgtgaagcaggagtgaagatcttggagaacccgtcacagaacctaagccaccctctagggtagagtcatagtcgtgtgcttccttgcttgtgtgcgtagcgcgtggtttgcatcagtggggtgtgatgtaaccatgctaggttgtttgcttaatcaacttgtagaataaacctaacatacatcataacagaaaaagattagatctgttaaggtgctatccttagtttctgatctgtccctccccttttgttttccctctctccctctccaaacctggtaacagatggctgacaatgaaaaaggcagtaaggtcagaaatcaggacaagggtgcctcatgctcccaagtgaataaagcaccagacaccagttgtgtggtagtggtccaacacctaattaaccagaacaaattgctcatagatctattacaacatcatcagacgccaattctgaacccgagtcagatgcaacctcaagtgcaatttgaggcagatcaagcacccacatcgccagacaacgtgccactagcatcccaacaggcccattgtgccatgccacatgtggactcaaaagaagctataatcatttgtcttatctacgatgaacaagggcactatgcaaggaactgtcctcagcagaaaagaaaagcaccaatgcgaaccgatgatgaagtccgtaagatgaccattaccggcacagaatggcctccaccaggaatgacaaaacgtcagataggaaatttctttcgtggtgcaccacagttgacccaacattttttagctaatggaggtagagtgtctgatagtgaagattcagatcaagtctcctcaggggatgaagatgagaagtctccctaaggtttcaagcagaataaaatggaacataaggcatgctctcgttgtggagaaatcggtcatgttgctagctcatgtgtcactacctgccttcattgtgagaaagaccatccacccggcgagtgtccaatgagcaggatcacttgtttcttgtgtgaaggaactgatcatgtaccaaaagattgtcaattcagttttctgctgacgaagaagatggccaaccaccccgccagttccaacaaagagaagcatcaagaccacgtaaatcctcgacaagaatacagttttcagcctaactccagagtaggacagaggaatcaaaatgggaaaagcaaatcccgagttcggcaagatatcagttgcttaaattgtcaagaaattgggtcatttcgccgccaggtgcccgaaactgagaaacatagctgccagcatgtcagtccatgcaactccccacaatcagaagcttgttccttagcgaattgtcatccatgcatcccgaagcagtcgtatagcctgagttgcaacaactgagtgcactaccacaaaggtgtcaatgcttaatttcagccccagccaccagttgacaagacagaggccaatatctgcgttgtacctttggatgttccagtacagcagccgagaaattaagtacttgatgaagaacttgggcgtaagaaagttattgtttgttacaactgcagtgaagaaagacattactccagaaattgtccacaaccaaagcgtaacccgcgccatcattccggtcgttatgcacgaagaagacatgaccacaatatcagggtcactggagcaaatgcagtacctgttaagcctagtgctagtcagtagcaaccataatactcttgtatcggtgttcaagaacttttgttttatagctattccccgtcaaccatgtaataagagagaaacatgaaataatgaatgagtttggcatgtttatgaaggatccatgttaagattgcaagtgctgtgagttatgtacgttttgttgatgattaaggagacctagggtctcatttccgtgagctcctactctattatgaatcaaataacctagttgtagatagaaaagaaaatcaagtgatcaaccaaagagatatttgtttggactaagagtttcatatgtgtctttttctgatcaaaggcaacgacagtcagtatagcttttgacgaactacttcaaggtttctccgaaaggcagcagggcccaaggacctcattgccccagaagcacccacaacacccggagcgaagagtacctggttgagaaaggtcaaaaggtgattgatggaagagatcggaaaatatgtttggttactgggaaaagaagtaggtcgaaaggtgattgataaaggataacgagaaacatgatttgtgtcactcgaggaagactcccgatagcaatcgaccctacaacagtcaccctgtcattaaggtagaagaatttgcgagtaagcaagatgaccacaggtagaagtacttctatgaggacaaggaagtcaagaagttaacctaaacagttggaatctaaagctcggttcaaccttcagctctatgtccgttagtcgagatgtcatggcactggattagtacgcgggtggtctcacccctatgtgtgtggcgcacccggtctaggtcctgttgctaggggctcaatcctggccctgcctgtccgggatactggccgtaggcagggttgggtcggtacttttgttcacggctaggatgggtgaagggttatgtcacatgtttacgacaggttccaaggccatggaatgcggagtaaagatgtgtctttgggtaaagatgcacacctctgatcagagtaaatctattcgaatagccgcgctctcggttatgggcaagcctagcaatgttcccaagttagtggtttaattcttaaaacttgcttaacaactaaaatgtggaatggttggcttgggttgacatgggacgagctgggacccaggtcgggttactagtttggtctgaatcatcgtaggcctttggttaaggcaggttcgtgtgggttcacagccttgattaataatattgtgtagctctaggatcgtgtttacaaaatagctttgagcaactaagtgtcttttaaatgctgtttactgcaaaacataacccctattattaccccttgtacccccttgcattaatcatgcatctcccggtgtggcttgctgagtacggtggttgtactcattcttgctctatctttcccccccttcagtaagagaagatttggagaagaagtcctaggtggagtcctggcttataccccagttgagcacttgtgaagatggaaccgtagaaccgctagtccactgctgtttattgttgattgtcaggcctgaagtgcctttgtaataatgtaaatattatcgatataataaagatgtgtcttttatatcatgtttgggtggtgtaccccggcttttcctgggatgaggattaatacactagcattctggaaaaggtatttttccgggcgcgacaagaggtgtacaaatttacccataagactcaactccacaatatgtcaccatattaccatgtgcccatgctgaacatgtcaccatttgtgtagttatgacaagacccctcgcatagctcaactcaaagcagcgcacctttcctggataataatcaccccctcaaaaaaaaccagaggcatggactccccagcgacccccacggacttttcgctgcttctcagtctggcgcaccacaacaagccttgctataccatgtgtccagccgttgcccattctggcttgttgttagtacggtaaatgtctcacaacagtagctcgtgaaccggtcattaattgacataagcacgaccttcaaaaccatgtgctcacaacccaccattatcaagttttagttggcaagtaattaattaatcaatcatgatttgatgcgcactagagttcccgatcttccaaaaggttctgataaacaacgatttgggtggagtcacgacacaaatagatccggcttcttgaacgcgcacactcttgagccccgcaatcgtagcaccacgtctcttctgattatcacccgtgtcaaaacacggatgacctcgccgagaaggctaatccctgtttgccaatcgaagaacacaaacaagaacgagatagaaaacaaccaaaattacagatgaatgattaagctcacgagttggggtcttacaaaccgatctagcggcgaaactgttctcgacagaataatctaagcaaaacgcaactctaaatgatgacagctactgaattaatatgattaggttcgtcctagagttgccctagggcccacaccccattgggctaagcctacgacacaattacaaggcccaaaactcaaatcagattcggactagatgaggtatgtggcttgttttgcagattcctggcagctcggtaggaattttgatgtgggaccaaaaccatcttaaaatagactccatgagctttccaacaagtacttatgggccccgaaattccttctagatcagcagctaggtccgtttgaaattgatgttgtcaggaggcccaaatccgaatccaaaacgtgtagaactttatctattgtcttctatggactaaaagtgacgtggtgagataaaagaagacttggagaaggtcttggtttggtccccaatcaacttctttaatcatccatgcattagttatgctcgatctcttttccttcgcccaagcaagtacctctacaaacgaaaacacacaaaactcattgtgtagcaacgtttgttcaaatatataacaagtaaatctaatgtagaacatatgcacctttatttgattaatacataaggtagtcatggttatatccgagctagttatgtcctcatcacgattgaccatcgagagctaccattaaatataatcatacgtggtagtgtaacattagttatcccaatcatgtgctaatgtttctaagcatggctaagcaattatgtctaacatctagctgaaccaatatataaatctcaactagtcaaattataataacccaaggtatcaaggaatagagtaatcaatgcaaagtggccataacaaaggaataagttcacaccactcgatgacattcgaaaataaatgcacagttgaaataaatagagaatttaaatataggaccaacatgttcaaaggattgtgtctgagatctatgtgacttgccttgcaataatcggtctttaattagtcttcagaaccacttccgacgcactcgcgaaccttcgcaacgacagaaacgacaagctatcacacaaaacggggaaaaagactaagaaactccaaataaacagtacataaaaagtaaacaaacatgtagatcatgattttagatgaatttataaactttaacggcctcatatgaattagttatgaattttacaagattaaactgattttagccttataaaaaaaggaattacgatttaaataaaggattaatgatgtcatgatgacatcaccactgagcatagcactggaccacaccaccgctggcgatctagggcacgtcggtgcaaaccgagggcatctacgtgaagaggatggcgagacgaactcaccgagggccggcgctacggaggacgacgacggaaaacggccggcggcaaggtcgaggtggtggtagtattcgggtcgatggtgtcggcggttctccagcgggtttcggcggcaacggaggggtggacggggttctcctcgcagctgcgaatccaaaggaggtggcggcgaccgaaggcgacgacgggaggtgcagcagggcctcgccggagatcaaaacgcgacggtgaacttcgggttgatggtgacgatggagctccggtggatttaggcttcggggaagtagaggctggtcttctccttcttgcgaacccaatggcagcagcggcgatggatggagcggctggagcggctggagcggctagcggcgacggagagagaaggcgctcgcgggagaggcggctagggcacgggagctcgtgctaggggttggaaagaaaagaggaggtcttggggttctatttatagccacgggagggagagatcgggcttggaacacaaggaattgcgccaggaaaacctagggtttgcaggagagataaactcgaaaacgaatccagattcgcatcgaattgaaagggataaagtcggatttttgggagaaaagatagaggaggataatgggaatattttccctcaactaattttcgcaatacaggagagaggaggccggatttggaggcgaaaaaccgggagggcctgatccgaaagaaaaaaatcgggagccatccgatgtgggagaaaaaaatcacaggtcccaaaactactacaggcatgcacagaaatattatttgtactcactgcatacacagaacatgcagccatgcatgtgtccactattttaaataaactttaaactactttttctctcaaattacttatctaattaacgatccgattgcaccactaaattcgttgcaattaaatctttaaaacaagaccacacatgaatataatcgatgaaatgcattcacagaacatgcagccatgcatgtgtcaagttttttaaataaactttaaactacattttctctcaaattacttatccaattcacgatccgattgcactactaaattcgttgcaattaaatctttaaaacaagaccacacatgaatataatccgatgaaaaaaaattttagcttattattgaattattacttttccaattaaattaatcactgaaatgatatttaaattgttaaaaatacttccaatgctctaataatttcaagaaaaatcatgaaattacatgaacactataagtatttaacaaaattataagcagaccatttaatgattaactaaatatgtgaataataactgaaatgttctttgtattatcaaaattagtaattgagctcagaaaaatccgagaaaattccagagagtataattaatcatggagaatttaataaaaattaaatccaaccatgccttatattgaggaaattttatttcccacatttaacttcacttgtaaattaatgaacatttaatataaattctaataattatttattaaataatttataaatcctgaaacgaaaatcaggatgtgacaatattgtccttcttttcatacttatagctgtatcagttgagtttgatcttatgagtcatgattagaatctcaatctctagcctgcttcttggtagccgattagggtagtatcagggtttcagccgatcttacctgattgaactacaatacttgttttatatgcttcgttgatatgttaaatctgccctttatgctaagatcttatagcatttaaatatattaggctttcgtttgatatattctgcttgctttaatatcttaatatagagtggtatcggagtattagccgatacatgctaaatctacctgattggctatgctatgaacctatatagtcccattattaatatatatttcgatctaagtgatttatactgtctcggcatggcgaccgatctatcccaatcacttgatttaagtatatatcgatataaggagtatatattgttaatatctacagccaatcgagtagatttggttccttcttgtttactcatgactgtcgatcgatacatatatgacatcggctcaaaaataaatgatatgtcatcggccaagggtcgatcggctgtcatttatgaatttaaccgcggtttctttgtctttgttcttgttgattgcaggatcaaatcaactggcacgcttgcatacccgaaggcgagttttggacctgcactggagttaagcagatctcccaggcctcgtgttttacgtcaacacgcttttggcatgcccggtgggactgattagaagtcagagttttcctcatggatgagaagccgccagcatcgttgtctcggctggtgaacccggctctgttaaagctaagatccagaagctaggtctatctgaagtcgaagaaggcaacatcgtgaatatcactccggacaagttgacacctgatcagcagaaggatcttgaagcaatgatgcaacaagcacgtaacctattcttga

SEQ ID NO: 73153 - DNA, 588 bp, Oryza sativa
ggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggtttacggaagttattgttttcatcagggacaatgtcaagtaaggtctacatttcagatagttcatggtgaaggaaatattagatttggtccagatggtgttgatctgtcagattttgtaatgacatctaag

SEQ ID NO: 73154 - DNA, 727 bp, Oryza sativa
  unsure (1)..(727): unsure at all n locations
tagcaaccagcgtatttataatagggatcaatgaaggtgaagatatccaggtgttagataaatacaatagttctcttgttaattaaatgtagaagctggtgatgggattacaatttcccgcagnatttgcggatttctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgactttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 73155 - DNA, 1271 bp, Oryza sativa
ttcctgcagccccaagcttcaactgatgaaacatcaacatatccctacaaatcgaagtaagaaaaaatatgtaacatcaaaagaatttatacataaatattttgatataatacaaagaaacatgtaaaacatatatgggatgaaacatggaaaaaatgacaaaaaaatatgccaatccaaatctaggtccttcttactctccgatggctggatctaagattccttcgatgaactcgtgcctatgacgacccagtgctccttaccttcgatgatcttgccttcctcattgtcggagtccacagcaacggccatctccttcattgctggttcgccacgatggggtcatccccctcctcctctccactggtgacctcctagatgtcttcttactctgcccgccacaacagtcgttctccccgtcactatcgccaccaggcggccatggaaacaacaataccatcatcaccgcaaccttttcatgtatgtggtgtgaggtttagagagagaagagagagaataaggggatagagacctagaaagagagaaataaggacatataagtgagtggtgcgggtattcgattttttaaccaggatcggatgcccaacccagtgtttttaagaaagtgttccaattttaagaactagtgagcgtgcacgtgcaaggcacgtccatacatacatactctctcaggaattcatcttggctctagctgttgggcgcgtggctccagcgacaagttggaggcaatagcaacggtgattcacgacccatggcgcagctcaccctctgccgttgatcatgatccatcctgttcataaataatcgcacaggttactaatgcaatgaacaaagatatctaaaggaacaatatattcttgcagtgtgtgctatagtccttccataatttgtccagctcatatggcccaaagcaaagtatttgttcaaaatatatgtagttctgtgaaatttactttgaataaaattatgtctgactaccttcaaatgttttgcatgcctcttgttcaagcaaaattgggtgacgtaataagaaagtaggtctcaagcaccatagatgcttgcctgcaaaatagcaattgacataatattggaatatttcctgtgcgaaatttgttatctacggccagtagcccttatgtgaagaaatatcagattgatcttaaatataagaaaagaaaaatattgattttcagttgcttatccagtgtgtagcagcatggcagttactgaggatgacaatatgcattggt

SEQ ID NO: 73156 - DNA, 1509 bp, Oryza sativa
ctcatgagaaatggtgagtctctcataagaggtctttagctcctcatacaagacctccaaagaagcatgatccttctttagagccttgaacttgacaatctccttctcactataagcatggagctcctcaaacatactcacaagctcatcataggaaacatcatcacaatcatcatcactctcactatcactaagagatgttaccttagaggaaccctttgccatgagacaaagtggagcgaagagtgatggagcctccttgatggcaacaacggtcatcttcttcttcttggagcttgcatcatcaccaccttcttcctcggacccggatgaggcggagctctcctcatttgagtcccattccccgatgaatgcctcaatcttcttgcattccttcttgagcttcttcatgagcttgtagcctccactcttcttcttggatgacttgtctccatcatcatccttgaaagggcacttggaaacaaagtgtcccttctcaccacactcaaaacacctcaagttggagagagtcttgttgggtcttctatttctactcctatttgagttggagccccttcctctctcctttctccttcccaagagatcattgaaccttctagcaagaagggcaatctcttcctccaagtcctcattgacttcattcaccttgcccttgctcttatcttcaacttcggcttggagagcaatgcacttcttgaaaggtgatcaatcaagtgccacactagctctacaaatggaagcaatgcacttgactcttggctaattaaccctctaacacactagatggatgaacacaaagctcaagtgggtgtgagagaggtgcaaggggtgtatgcaattgaattgggtgtcaagagagaccccttgctgctggagggagagtatttatactcccaccaaccaaaactagccgttgggggcgaaatcccctaactttgtgctctgccggtctaaccgaaggtatgcggtcggtcagaccgtgctactctgcaacggctagaaaactagccgttgtagtgctgtcagagggcccccatcggctgccggttagacgggcgtggagtgggcggtcagaccgaccttggctcggtcagaccgccatcgcctcggtctgaccgaatacggctccgtcggctctgtatcggccaccccgagtagcaccatcccggcctccagggggacggtctgaccacgcatgtccgccagtcagaccggccttattcgccggtcagaccgccgtcttgcggccggtcagaccggccagggcacgccggtcaaaccgccactatgtggccggtctgaccgcccctgatcaggccgaaaccagtgaaatcccaagtgattgtgtgtgtgatgaaaagcgagcacaagtctaaatgcataatgacctaatgtggcaattaaaatcatctctttgctaggtcattacccctcttaatagtacggcaaaactaaaaaataaactagcaaatttgatcgccctatacc

SEQ ID NO: 73157 - DNA, 6092 bp, Oryza sativa
  unsure (1)..(6092): unsure at all n locations
aggcgttgttttcttttcttttctttttttgataatttgtggttgactgagatgtataattttgtgattcattgtacggatctaagatgtataatctgtgatgtatttgatttgtgtgtaatttttttaggatttgtgatgtatttgatttgtatgtataagtaactttaagatttgtgatgtggatttgggatgttactttgattttgtgatgtggatttgggatgctattttgatttggtgatttggggtttgatttagggatatgcatgccactcgatacgagagaaaattagaaagagaaaaaaggaaaaggggaccatttggactgccgctaccctctctgtagttccggtttttattaccaaccgggactaaagatttagtcccagatttctactcccggttagaaactcggaactaaaggggttaccaaccggagtaaaaaaggtttctccaccggtgttggtacgagtaaaatgtgatttttatcactaaaatacctatattacctttactacctcttggttttattataaccataaataatcctagcctatatatactttactcatcccgagaaaacgatcaatctttttatctctccttgatagttgatacccacaccaaacactaaaacttgctatattcggggatgaagggtgcaataaatttcttttttgtgtttttgattgtcacatagtttgcaaaaggcatttcatgttagtaggggtggatttgctgccagcgatccctagtgaccgcccgagctcggcgacagacgcacaatgggatttgtttttttaatgaattgaaaaatattttcacaccaaatgtttgatatactaatattttactaggcttcttttatttttcatgagatggtacacattttttactagacttcttgtcaagctgttaatagtcaaatcggcagcgacggcttttgtatttaggttttcgatttgcctgatgacatcggtttgctattatgttgaatgaagatgatggttgatatttgttcatttgttctgcatatgctggnangtntggtcaaagcgtcgtggatacgttcgtcgctcgcatatattgtaacattttaagatgtggaggctctttattctattttttataacccttttatatcatacctcgcttagtattaggctcgttccaattgcagctgcaaatcaacagccgaacatgcccatttaatataatctaccttgttcaaggaaaaaaaatccctacaactacgataaaaaatcaaacatcataactcaatatcttataatctaaagctgaccagcgaggacaggtaatggacggtagatattccgacttcacaacaattatttaatatcgcaaacaaataaactaaatataaatataaaagttggaaatgaattaaaagaaatatggatgaagaaagtgttttttttaaacaaaacacgttgtttagcaccttgataagcacatccacgatgatctaactttagaacaaaacgtcccactcaaaaatttcaggccaattttgatgtaccagtaggaagactgtagtaggatagatacgaaactgtaggatattcacggactcaccgataaacaggacgacgcaaacgccttagaaaattttcgccccaaatttttgtttacccggtcgtgtctcacgaacagccgcgagcgcgcggggagccacatattgagaaatgagtaaccaaaaaaaaagctagcgagcgagcaagcgaaggagcgggccgagatcgcgagcgcgacgcgcgtgagagggacgggacgggaggcaagtgggcgggggcacagcacagcggtggtcagtggtaagtggtggtctagtctagtggctggctggcgctctgccgcccgcgcagccacaagcccccccagcgcacgccgtccccttccccgttcccaatctctccgcctcccctccccaaccaaaccaaacgcacggccacaccgccgntgcgccaccacccacacactcccacccaccatcacgccacgcctgcagagccagagactttgagccgccgtgccgacgccgacgcttacgccgagcgcccgcacgctccgctcccatggtctccgccaaccagccgccgcccgacgcggccgcggcagcggcgggctcggctggggaggacgccagcaagaaggtgcggaagccgtacaccatcaccaagtcgcgcgagagctggacggagcaggagcacgacaagttccttgaggccctccagctgtaagcaaaatcgcggaattgccgtgcctttttccttaatttcaccccgtcttttgccacccaactcgatgcgtggttttgctcggaattttgcaatcgtgcggtctttgaggtgaagattgaatgtttttctagctcttgtgatgcgttagttaggttccgatgtttttttgctgtcttgtgtattattgatataaaacagtagcaaaatagcttacttaacttgttttacgtaaaaaaaacaaaacttgtttgtttgttcatttgtttttaaatttggtcttggagtagcatatggagagttttttagtcaggggatcttttaaagatttcttgtctgtactgagatgaagccgtgtttcagaatttcataagctgctgttgtgcacaaggacaataatcagtagtactggtacaacctttgggcaaagaggaaatctaaggatccaatttgcagattatatttttttgactaaaatttgcagattatatgaattgaaataatagcacaaatttacaaactgaggtgctttgtgttcatctagtgatgccatttgtccgggtatagcacccccactggatattttaaggcctcaaagcatttgctctcgtaattagccaaaagtcacaaattcacaactcacaaattagtacagcagtatcctgcagttctctgcttcgtagttttggacttttggtgctataatacttgatatttctttgacctggttgagcacacctgaattattggacattttagtaatcataattactatgaaatgcttccaacgtattggtccccctatttgcatatgattgccaataatgtgttttggcgcaccaaaaacactgcatttgttgctgttgaattcaagtatctgtacaaaaggtttgatattcaattgtaggactgtccttttacatctgatattcatgtgtaataccttgcttcttttcagctttgatcgtgattggaaaaagatagaagcttttgttggatcgaagactgttattcaggtgggcaaattataaatggaaaaggggatatcctctggcaaatgaataaagggaattgtggcatcaaatttcgtcacaaacctagcagaactgaatccctgatttgttgatatatgtcatatatgttgacctataataaacaactaatacacaatgcctttttttgtggtgtaatacacagtgcgttggtgcttgtgtccatgggttcaaatcccttttctccacttctcacaataaaatatttgcagacattgcacacgatcaactctccagtgaaataatttttgtttaccatctcaacttgattttgcagattaggagccatgcacagaagtattttttgaaggttcaaaagaatggaacaagtgagcatgtcccacctccacgaccaaagcgtaaagctgctcatccataccctcaaaaggcctccaaaaatggtagatcctcatatgctcataagttcagcacgcacccaacacatatatctttgatactaacagtacccccctctgcacaaaacatttacttcaatatatattctcatcttgcagagccaggatataccataaaggcagattcatcttccatgcttagagaactcaggcatgaatgccactgtttcgtcatggacacacaattctatcccaccaattgtagcctcatccatggtgaaaggtttgttgtccgtggtacctcttccttataaaaattcaaatgcaatatccatcagttaatccttatcttctttcactcagaagatttaatccttatcttctttcactcaaaagatttaagtgctggagcaatggcccccaacaatttttgctctaacagtactgaaggccctgcgagggcatggcaacctggtgaaactaatgatcagataaatcaagttccgtcactccgccgttagtacctcttaagatttttctttatatagttatctttctgcagtttgagtcatattgcccatttttattgtttctgtggcttctgttttgatcttcctctctgtgcacttgttttgtttcaatctttataacacttggttacttgtttagaataacaattaccaccaacaaattactgattctgcttgaggtgttttagaactgaaaagtagtgttacacgacagcacagtccattcccaggtcctggcaccttacagatattttttttttcatagatttgatcagtaacaatattgaggtttctgtcttcaaccaatgctttatttacatgattcaaaatttcagactggcattgttaacttttaatcttttaatgtagttatgccagattttgcacaagtatacagcttcttgggcagcgttttcgatccaagcacaagtggccatttacagaaactaaaggagatgaatccaattgatgttgagacggtatgtgaatcatggataagctttgttctgctcagttaaagtataattgtacgtgacaagtcaagacaactgaaacataagcataaagaatgttctttgtggtacttcactcaagcaatatgtatgcttttagtcagcattttagattgttttgttatctttgttgaaaccaacaaaaggcatatttaattcataatttccttagcatgcaattttcaaactcgacatttcaactgacgtgtgtccatttttctcccctttaggcattgttgttaatgagaaatctctccatcaatttgactagtcctgattttgaagatcaggtacgcagctctccagcatgcctctagaattcagtttggctgtgtactgccattacttccttcaaaagaaagaaaaatgcctttagaatttggatcatgcttgtgtatggttcactgctgtttgttttacagaaaatgttccatgcaacagaattcaagcattttctgtctgctgcattttccatacttgcctttttctctgtgatattttgttgacttcttgaaacatatgaaaggtaatgttagcaccacattgtgcatgtgctgtagtacgctaacagttattgtttactgtggtttggaggtaactagttctgaaaatcccataaatgcatgtatgatgagtattcgtttctgatttttaacaccttcattttatcaatatcataatttatttctttcatatggataaactaaacatgattttagaagcaagttcatgccttattggacttaggtgtctgtgttcacattctgtgcttctagcagggttgcccatttgccatggtttctggtactgtctgtgcagaatggctggaatgtatgggcagctatcagaaaatgtgtgcaaagtcaccaaattttagcaaacttttgaaactatcagaaatttttggtatgtaccaatatcaaattttctccagtacagcaggtcttaagttctagcccttctcttgtaacacacaattgagatgatgtatataagccataacattatgaagcatgagggcatccaaaataataataataataataataaaaggttgataccatattgaattttcttttcaaaagagttactcaccactgaaaaaaatagctttctttagtatgttggacatgctgtgcatcatagcaatttgaaataggatgtcatttacaaggctacacaattatggcattcagtatgcttccattacccaattagagcatatgtctgttcttctgaaaaaaggaactaacctgtgtcctatgaaatttattatagaagaagttgctatcttcatacagtaccccgtctgatgggcttgagctaggaagcaccagaagctcagttctagctgatagaccattaagtgctccattcatgt

SEQ ID NO: 73158 - DNA, 10564 bp, Oryza sativa
tatcctcccgcgccggccgaaccccggtgagaactccctccccttctcttcctctcacgcgcgccgccgctccccgcatgcgcgtcgccgcgaagcgccgtcgcccgcatcgccggccgccgccgtcggtggccgcttgccgccgccgccctcgccataaccggccggccggcttgaagccgagccggaccgaccgggcgcctcgccgcttcccccccttgtgacgctgcccagtgggcccacctgccagccgccccctctccctctcttagtgccgctgaccagtggggcccgcatgtcggcgccgccccacctcttgctgacgtcagccctggggcaatattgcgcaataaattgattaaggcttttcttttatagtaataaacacagataatcttctaaaaatcataactaattcatccgagctccgattaagtccattcaagtctcagtaaattcataaaaatgtatagaatccattaaaaatggttttgcttcctgtttcagtagtcttatagcatgttttgcttgtgtgctttgtttgtcgcgtagaattcggccgtttcgtcgattcgcggattctcgaagacgttgccgtggtctcatcagtgcgagagcaaggcaagtcatgcaatacaattgatcatattgtacccattttacaaatatcccgcatttctattaaatattgcattgttttacaatatcatgtgggataggtcctattactcagccatatattgtttaccttatgccattgataacgtgggtattcaaatgactagatgttggtttaggagatgcttagccatgcttagttcaactagtgcacaaagggggatcacattaaagcatagacttgattattggcatagctttgatttagtgccaccgtaatggtgttggttaattaaaatacacgtcatggtgggctgtgggtgcatggtcttgctagtcgcacccatggcatttaaggaccggttcgcgggatgccctggggggatcttatcgtacttaccacaagccagcgtgggcaacggctgggcttgtagtgtagcttttttctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctcttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgactcaatacactgtagttcaggtgggttggttgggcctgttcaacgtggtgtagcgttgatcagtggagattcaatattactttaattactcaacagttttactgttttgctcaataaaatgttttacaaccgcctttatgcaaatagccacaaaccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacggaaggggctagatcggtgcttgtggatagacttggggtgggacgtagcctgccgaatactggaggattgaggccgaagcgaccttggaccgcctcgctgactcgtacgcctgctgttgttcttgcatctgacgaagcatgtcttggagtcatgtcatgttatgtcgcatggcttccatgtcggctttggtttgtgtttcggggtcagggttcacttgtacagcggcgagcgcagtcgaggccgctgccggctgcgacggagtggcttggggcaccagcagttggcttgtcgaaaggatctccgccctggtctagagtgcccttgccgtcgcggctgccttcgccatgtcaactatgttcggcacctacgcagaggcggcaggagccgaaggcggtactgatggcgcaggtgtggaggcagacagcgctcctccatcttcggcgatgggcgccgaaggctctctgctccctcttcggcggacatctcccccccggcttcgctttcctttcgccttgtaaccttctccttcacgaccctcttcggtggcattcgctctcagtggtttcgcttggaggtccccacggtcggcgccagctgttgtcgaaaggacaacggcatacgtcgaaagacgtggccactcaacagtagttggaaaagaagtaaagtgtataaaattgagaatttttcttcggatcccccattacatgaccctatgggaacatttatagccctcattactggttcttactactagggttttggttatacatgggaaattacatggttgcccttatgaaagggacatttatatgggtacatagtgtaatcgagattcatgggcccctgatgggccgtcgggcgatcatcggcccaatagcccctaggcttgatgggctggaaagacttcttcggtccttgcgggggcgaacttgctacggcgaagtcgtctcccttcggcatatactcttcgccctgcatccttcgcccaagaggccttatggcttggcaaggtacccatgtgattccccgcctcttgccgtcgttattccatagtcttcgccatggggggtcttcgccctgactaaccttgatgtctcgggcttgaatccccactgttcgcatggcttcggcaggtttggtcgaagggcctcatgccctatgggactatttatagccctcattgccataccgccaacaagcccctcacgggcaagggtgagattggagcttcggccgagaccgtgcaaaccatgtggtatggtatgtggcgccccctttcgaccgatgctcatgccgaaacctacattgttcctgcaaataaagtttattgtctatgtgacaggtattgttttgccgctcttcgcctcctgcggacgcgcgggcaggtgaagcttgcccctaggaagcggagggttcttgcttcctccgattccgatgacgtggacgacgtcgaagagtgtgatggcgaggaggaaggggaggaagaagaggaggcggaggccatggctgaaaaggccgcggacgaggcggtcgaaaaccgcgtcgacacccctagctacactcctactccaagtccgggacataacgagactggggtggaatcgaacagctccccccttcagaccgaggaaggatttggagggggcgaaggcgctagttgccttctcggcaggcaaggcggtgttaatgaccaaatttggtaatatcatcatcggaagtgaagatgagatcgaagcgcaatcagagataaggattgctgtgggaacagagtaagaatcggctgagtccagatcggctacgaccagaatcggctaaatccgaatcagactgggttaggtgatgcagccgattccgataatacgacttggtgtacaacatcgggttgagttgatatgcttcaagatgattgccgcacgtggatagagtcctgagaaggcaattgtatctattaattaggatattttatgtaatttccttagagatatgcttgggcaaaagtctgccgcaaagacttatggtatcttagagtttgttagagataatagtcgtgtccgttatggacatatcttgtaattctcgggtataaatagacccgagccctatgtaaaacacacacacacgttcaatacaatttcggcgcatcgccacctttttgctttagttttatttcgacgagttcttgcttttgggttgagctgcatcggttttgatcttcaacaagaggtaaaacttgttatgatggattgtgttctcgggattagtgcttccatctttacgacactctaatcttatttatgtaattcgtcaagttatcatatatcttacataatcttcgacaatatcgtcatctaacctacaatcggctaacatttgtcgacagaaggcagccgattaggttaaatagcgacgttgacctagattatataagatatctaccactttatgaaacatccggtggcttgattgtctagatattgttcttcctttcatacttaatgttgcgtcagttaagttcgatctattaagtcgtgcttagaatttcaatctctagcctgccttctggttgccgattagggtagtatcagagttttagccgatcttatctgatttaaccatatttgatctatatgcttcagtgacatgttaaatctgccctttatgtcaagatcttattgcattcaagtatattaacttttgtttggtatattatgcttgttttgatatctttatatagagtagtatcgaagtattagccgatacatgctagatcaatctgatcggctatgctataaacatatataatcctgttatttatatatatttcgatctaagtgatttatactatctcggcatggtgaccgatatatcccaatcacttgatttaagtatatattaatataagaactatatatcgttaatatctacagccgattggatagatttagttccttattgtctatttataaccgccgatcgattcacatatgacatcggctcaaagataaatgatatgtcatcggcacctagccgatcggctatcatttatagatttaaccacgaattctttgtctctatttcttgttgattacaggatcgaatcaactggcacgctcatacattcgaaggcgagctttggacttgcactggagttaagcagatctcccaggcctcgtgttttctatcaacacacttttggcacgcccggtgggaccatcaccacctcatggccgagaaaccaccaccacaaccatccccagctagcccaggctctgtcaaggaaaagatgcagaagttaggattgactgacgtcaatgaaggaaacgtcgtgccgatcgatccagaagaattcacacctgagcagaagaaagagtttgaagcaatgttgcagcaagcacgggatcagttcttgaactcattcatgcagacccgcaaggggacacttgttcagaagtacaaaataaaagtggttgctgatgatcctgggaccagttcttctaagaatggagacaggaaacaagcgccagacggctcggctcaaccgagtgacaaaggtgctaccgacggttctctaggaaatcagggtgacaattctcaaggagtccatgaagtgcaaggtaacggggtgcatggagttcaaggtgatggtgctcaggggttgcagggaggaaatcttaatcagaatagtgaggcggcacaagattttttcaataatttccaagaccgggttgactacgctgtgcatcatgctttgatcaatcagtatggggtgttagtcaataccttatcaaacatgatgaagtcaatagccgatagttcaatagctgagcatcaggctgcaggctcggtttatttgcaaggaggtgtctttccaaattgctgaccgatgttcagccatctattcaggcgattcccttcgttgcaccaacagctcagccaacggcaccggcatcaactcccctacctgctccgtcagcaatggcgccaggctagccggtgaaccctcggttgttaatgagagagcagccacagcatagtgggtaggttgcgaatcggctgacccaggatcaggttgctgccacgtttctgccacctcaacctgtttttgatccaatacaacatcagccgattcaacagacccccccaatccaacaggtcatgcaactagttcagcaaacaccaccaaggcagcagcctctgcagccgattcagcagatgccgttaagacagcaaatcgttcagccgattcagcaccaaggttcaataagcgcatcggcacaatttttaaatcaaattgtcacagaacacttggttcaccatgtacagccggatggcacagtaatgcctcaagttgttcttgaacacttagtacgccgaaccttcataattaccaagggggcaacttgaattatcaatatcagcctccttccccgcaagcccaatatcagccagggggactgactcaacctcagtttgcacctcaatacggttagttcgagcccttgcaacaacagtcacagggagcagctcagcaatgaccatgggccgatgtgattgctgatgtaatgagggaacagtttgggcttaaaccaaaagagactggaagcttgtatcggcaaccttaccctgactggtttgagaggattcctcttcccaatcggttcaaagttttagatttctccaagttttcggaacaagatggtgtgtcaacttatgagcacattagtcgattcttagctcagtgtggtgaagcatcggttgtagatgctctgaaggttagattgttccggttatctttgtctggatcggcttttacttggttttcttctttgctgtatgggtcgttcaatagttgggccgatttggagaagcaattccacagctatttctatagtggggttcatgagatgaaattatctgacttgaccgcaattaagcagcgtcatgatgaacctgtgcatgagtatattcagagattcagggagatgaggaacaaatgcttcagcttgagtttaactgatgcccagttagccgatctggcctttcagggtatgattgctccgatcagggagaaattctcgtctgaagactttgatagcttgtcacatctgatacataaggtaaccttggatgagcataggtctgcggaagttaggaaaaactataagaaggttaatcatgtttgtccgtacatgtatgggtcggatgatgatgaggatgattctgaaatagctgcagccgaatgggtgaggagtaaaaaggtcataccatgccaatgggtaaaaagttctggaaaagaggagaagtatgattttgtactaaagctgacaagatctttgatctgctactccgagagaagcaaattcaacttcctgctggtcatacaatcccatcagccgaggaattaggcaagaagaggtattgcaaatggcataattctggatcccattctactaatgattgcaaggtttttagacagcagattcaggtggtcattgagggaggcaagattaggtttgatgatttcaaaaagccgatgaaggtcgatggtaaccctttttctgttaatatggtacatacagctggccaaacagccgatagggtccgtgcaaagggttttcaggtgaatttggctaagattattaacaaatatcagatgaagtatgacaagcagcaggagaagcatcatgaagaatacgattatggttttgatcctcattggggttgtgagttctttagattctgctggaatgagggtatgagactgccatctattgaaaactgccctgggtgcagtgacatcatcgagagctcaagccgatcatataataggggcaatcggctaaggcagacaagagtttctgttcaccaaagattgggtccagtgaatcaagatcatggccatcaggacaatgtaatcagaaagaatcaatggtgtccttctggtattttcacgaagaatcaaaagagaagggttcaaagattgaggaacaaggagcgccttcaggaggtcgaacaagaaattaatcatcggctgaagaaagaaaagccgagacaggagtggcgtgttaagaatcaggttcctgtagccgatgatgttgcagccgatgaggcaaagaggttggcaaaagggaagagtgttgtgacggcaccggttaacatggtctttaccctgccagctgaattcgggatcgatcaagccgatgtcgacgaggtggaagaggaatcagctaagttggttctatcaccagaacaggcagtgttcgagaaacctaaggggacggagaatcggcatcttaaaccattgtatataaacggctatgtcaatgggaagctgatgtctaaaatgatggttgatgttggggccgcggtgaatttgatgccttttgctatgttcaggaagttgggtagaaatgccgagggtctcatcaagacaaatatggtgctcaaagattttggtggcaatccatcggaaaccaaaggtattctaaatgtggagctgacagtcggcagtaagactattcctaccacgttttttgtcaccgatgggaagggttcttacagcttgttgcttagaagggattggattcacgccaattgttgcattccttcaactatgcatcaatgtttgattcaatggcaaggcgacaagatagagatcgtgccagccgacaggtcagttaatgttgccagtgctgatttagctctttgggagatggatggccttgattgtttgtccggaaaagtttgggatggagattttctaaaagtgtccgattctgatatacagccaattgaagatggagaacccaagctattattttgagggcgtcgtagagggttcatgtctacactaaggacaccgtagatgatctcgatgacaagcaaggtcaaggtttcatgttggctgatgatttggaagaaatagatataggtccaggcgatcggccaaggccgacatttattagtaagaacttaactccagaatttagaactaagttgatagagctcttgaaggagtttagagatagcttcgcttgggagtattataagatgcctggactcagccaatcaattgtagaacatcggctacctatcaaaccaggggttaagccgcaccagcagcctccgagaagatgcaaagccgatatgcttcaacctgtcaaggctgagattaagcgtttatatgatgctggttttattcgtccttgccgatatgctgagtgggtttctagcatagttcctgttatcaagaagaacggcaagttgagggcatgcattgattttagagatctgaacaaagctacaccgaaggacgaatatccgatgctagtggccaatcagttggttgatgctgcgtcagggaacaaaattttaagttttatggctgaagaagatatccataaaacaacttttagatgtcctggtgcaatcggcttatttgagtgggttgttatgactttcggcttgaagagtgctagagctacatataaaagggccatgaattatatttatcatgatctgattggctggctggttgaggtctatattgatgatgtggttgttaaatctaaggaaataaaagaccacatagccgatttaagaaaagttttcgagaggaccaggaaatatggcttgaagatgaatctgacaaagtgtgcctttgttgtatcggctggccagttcttgggatttcttgtccatgagaggggaattgagataacttagagaagtatcaatgcgatcaaaaagattaagcccccggaaaacaagaccgaattgcaggagatgatcggcaagattaattttgttcgaaggtttatttctaatttgtccggaaagttagaaccttttacaccattgttgagattgaaggccgatcagcagtttacttgggggggcagaacaacaaaaagctttagataatatcaaagaatatcttagctctcctcctgttttgattcctccacagaaaggggtgccttttagattgtatctgtcggccggtgagaagtcaatcggctcagtcttgattctggagttggatggaaaagaacgagttgtattttatctcagttgtcggctcttggatgctgaaactaggtattcccctgtggagaagttatgcttgtgtttgtatttttcatgcacaagattgaggcattatctactatccaatgagtgtactgttatatgcaaggccgatgttgtcaaatacatgctatcggctccaatattgaaaggaagggttggaaagtggatattttccttaaccgagtttgatcttcggtatgagtcgccgaaggcgattaagggacaagctatagccgattttattgtgtgaacatcgtgatgattcaatcggctcggttgaaatagtgccatggactttattctttgatggatcggtgtgtactcatggtagtggtatcggcctagttataatttccctaggggggcatgtttcgagtttgcttatactattaaaccttatgcgactaataatcaagttgagtgtgaggcagtgctcaaagggttgcaattactcaaggaagttgaatccgatgctattcaaatcatgggggatcctatagagtccccctgcaggca

SEQ ID NO: 73159 - DNA, 7354 bp, Oryza sativa
ctgttggattagtgccaccgctttggtgttggttaattaaaataaatcacatggtgggctgtgggtgcatggttttgctggtcgcaccatggcagttaaggaccggttcgcgagatgccctggaagaacttatcgtacttaccacaagccagcgtgggcaacggctgggcttgtagtgtagctttcctctagccgacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaacggtcctgtcacggcctctttccggtatgtcgtggtggcatgtcggcgcacggaaacgtgtcgtggggctgtgtcttgtgggtacagttgtacacctctgatcagagtaaaactattcgagtagccgtgcccgcggttatgggcggtcaaccagattcaccgggattagtctcaccctagtgtaatcttttgaatttggataggttaggtggatggttgggcctgtcgcaacgtgggatagcgttggacagtggttagttaataataattaattattacaactgtttaaatctttcaacttctgtgtataaatgctcgctttatgcaaatgaaccactctagctctcctttgataattccctgcatcatacccctattccgatatgacttgctgagtacagtgggtagtactcagtcttgctctattttttttcccaaccccagagttcgggtatgtgtcagatggaggtttctccgaggagtaggcttcgtccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcataccaggtggttcagatgaggagcagcaatatgttagcgtgcaggtggagcacgtggatgatcaggaaactgaaattgttagtaatgatgttaatgatactgttcagcactcacctcctgttttgcagccacaagatcaacctattgcacatcgcagaacaaaaaggagttgtggagctccaattcgccttattgaggaatgtgatatggtttattatgcttttagttgtgttgaacaagtggagaatactcttgagccagccacatacactgaagctgttgtttctggagaccgtgagaactggatctcagctatgcaggaggagatgcagtctcttgagaagaatggcacatggaagcttgtgcacttgccaaaacagaagaaacctgttcattgtaaatggatcttcaagagaaaggagggtttatctcctagcgagcctccgaggtttaaggcaaggttagtagcaaaaggtttcagtcaaattgctggtgttgattataatgatgtgttctctccagttgtaaagcatagttcaattcgcacattcttcagtattgttgctatggatgatcttgagcttaagcagttagatgtgaagacaacatttttacatggagagcttgaggacgagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagtggtctgaatttgatagctgtgtgtatattaaatttgttaatggatcacctatatacttgctattatatgttgatgatatgctgattgctgccaagagcaaggaacaaatcactacattgaagaaacagttgagtagtgagtttgatatgaaggatcttggtgctgctaagaaaattctaggtatggaaatcactagagacataaattttggtttgttatttcttagtcagcaaagctacattaagaaggttcttgagcattttaacatgcatgatgcaaagcctattagtactcctattgcagctcattttaaattatcagctttacaatgtgctagtactgatgaggatgtaggatacatgtctagagttccatattctagtgctgttggttctttgatgtatgccatgatttgctcccgtcccgatttatctcatgctatgagtttagttagtagatacatggctaatcctggtaaagaacactggaaagctgttcagtggtttttcaggtacctcagaggcacaactgatgcttgctcgaagtttggcaggactgataaggggcttgttggatatgtggattctgattttgctgcaaatttggataagagaaggtcattcacaggttatgtgtttaccattggtagttgtgctatgagttggaaggcaacattatagcctgttgttgcccagtctaccactgaagcagaatacatggctattgttgaagcatgtgaagaatcagtttggttgaaaggattgtttgctgagttttgtggagttgattcttgcattaacttgttttgtgacagtcaaagtgctatatgccttactaaagatcagatgttttatgaggacaaagtacattgatatcaagtaccattatgttcgcgatgtagtcgcgcaaggtaagccaaaggtatgtaagataagtactcatgataatcctgctgatatgatgataaaatctgttcatgttgctaagtttgagctttgctcaagcttagatggtatagtggtttaggccaagaggctatttggcgccgaaagtgtttttttgtctttgttgtgttcagggtgaaggattgtttcatactacaagaaggaatttgtctcaaggtggagtttgttgagttgtgatccaaattcatttgcacttaataaaggccagcttctgccgtagtggagcggaggcccgtcgccgggaggcttgggccggagcatagcagggacgcttggggtgcgggggcggagccaccgcgaaacggatcatcatcccttttagggttccaccatatatatatatatacctcttgtaagccgccgtgcggcgttgtaatctcactccagatatagtgaagatattttgctggctggtgcccgtggttttttctctcctgttttaggagggtgttccacgttaaatctcgtgtcttctgtgattgatctattattttttatcgtttgttcgctcatcgtttcctaacaaaactgattcatccttgcggcatgcagcgacgatccaacgacgattggtcgccatttcgatcgatcgatcggctggtgatgtatatgaaaggcgttcgttaattataattaagttgggcgcctagcttagcattgggtcctgcacatgcagcggcgacggaatcccctgcagtcgtcgccgcccatgcagatgtggtcgcagttggcttgtatcatgcacatcccgctgaacttgctgctttccgtctcgcattccctcgcctgcgctggcgccatctctgatcgatatgatcatcacaaaaaatatatatatattccatacattaattaacaccactgaattaatttcccaatattgatggttgatctctttgtccgctatcgaaaataactgcctgaatatcacaccgtccggtgttggtcgttaaaaaaggaaataactgcttgaatactaactagatcccacgcacatagtacagatgataaaaaagagagtaaactttactttggactatgttttattaccgaagttttgctagcttttataccacctttaactaaggaaaaatattggataaaggatgatacaaagtgaaatgtacattggtaataaaagatagcccaaagacaattctactcagaataaatcattatgtatatattaattgtctcctattgtacctgtgttgataacaagcaggaggaggacagcaatggccgggaagaacttgcgtgatgactccattgtttgttgttttttttctttttgtgttgaactgttgattcttgtctctagtttttctgttactgatgattgttgtctggaggcagaagtgtcatgcttatatatgcagatcactgcaggctgcgtcatgcgagcgataatgaccataggaatttttccaactctaataaaatagaactggctaatattagtcgatggctactattgctttgcattgtaatgagtaatgctagagactgtcgctcccaaaatatcgcagccattgttaattagttaacatataaaataaacaaatagatactcaaagcaatcggattggttaattggaattatttttaggataatgcatttcttgtattccagtaaattcaaagcttatcgaaatttaaatatatttttgaagtgaaataaatcatggtgcacatataatttggcaaggatcatttcagagctttccctaattcatgcataacaaattagtatatgaaaccaaagaaactggtaaccctgaaaattactgtattaagttctatataaaattcaagactcaccagatatatatcaacttttagttataatgtatgctacttaaaaaaactccatctcataatataaggcacaacatatttcatgaaaatttttaattttatttaggctaatataaattaaatttcatttgaagaaaataaaattgttgaattggcatttgaatttattttaactaaatgttaaagataagtggtagacaccatgacggagcgtggggctcctcaccgggagaccgcgcaggcccccctttgccgtttcggccgggggcgctaagttaggttcttcgccctcgatctgaggaacgtcaacgggagaggaagtgcacaagacacgggcgacgtagacaggttcgggccgctgagaagcgtaacaccctactcctgtgttctggtggatctgtgcgtgaaggaatacagagacccggagagcgagagtgagttcaggctctagaaccccttccccagagtcccaaccccctttctcctaggcctgggcctcctttttatctggtcaggggtcaccacatgggcctctagctgcctaagaagggaaacatgctttttacaatgagggctagtctacagccggaagtgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgcagcattaaatgcggcgtggcgcgctcgtccaacctgctataaatgcggttaggtgagccccgctgtgctcacctaacccacacacgtggcgccaaaaccacagggggtcggggcgccccagccctcggggccgaaacgggggcgccccagccctcggggccgaaacgggagtggcccgacccctcggggagacagagggaggggtggccacgtcaccctcgggaccgaccccccctacccccgagggggtcaggccacgtgggtgaccgcggctacccaagcctctagtcacgatacccccggccccatgtcaccgacagtagcccccggcgttacgccagggcgatcgccccctcgagggaagcgctcgggcgtgacgccactccttaggcccggtgacaggtggggccggtccctacaggcgggcagaaacccagcagtcacaaatcgcgcgcatcggcaagggaaaaacgaccgacgataatgagcggcctctttaagaccgctacattactcgagcagcgcgcgaatcgggacgagccggttcgtttcgcctggagacatgatgatggcgcttttcacggttagcgagcgtagttaatgcgcgcacgatctgccccatctcaaccgccatggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttctttcctctcgccactcttccccttgccttcgccacttgcgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctaccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgcaacttccagccgcgggggcaggtgctgaaccgctacattccctgcgtcctccgcaaaaagtgggacgactggaagagcgattggttctacacccccctcgccgacgaagcgcgcctccgacttctgagccagcccccggcgcaggcctccagctggcgggcggcggtagatctgggagacggctacaacgccgttcttgaccgcctggcgggtctgcgatcccaggggctcacggggtccatggtgttcggcgactaccttcgtcgccgaatcgcgccgctccagcggcgcgcccggggcgcctaggagtacaccgggcccgaggactacgtgaggacccaccaggggcgcaaatgggactgggaccctgaggacttcaggatggtggtccaacgggtgctgaatctcagctccggggaggcatccctcatcccccaaggggtcctccccctctgctacgatccagagcgcgccaaga

SEQ ID NO: 73160 - DNA, 2729 bp, Oryza sativa
atagtaaagatatttttgttggctggcgcccgtggttttttctctcctgttatggaggggtgtttcacgtcaaatctcgtgtcttctatgattgatctattgttctttatcgtttgttcgcttatcgtttcctaacaagtggtatcagagcttgttctcagattagggtttcgcgatggcgtcgatgaagtatgatctatcgctgcttgactacaagacaagattctcgctgtggcaagtcaagatgcgggctgttctgatgcaacttaggatcttgatggggcgctggaaaccttcgggaagaagaaaacgactggctagaccgctgaggagaagcggaaagatcgtaaggctctgtcgctaatccaacttcatctatctaatgatattttgcaagaagtgttgcaggaaaagactgctgcagaactttggctcaaactagaatcgatctgcatgtctaaagatctaaccagtaagatgcatatcaagatgaagttgttctcgcacaagtttcaggagagtggttctgtgttgaaccacatatcggtcttcaaggagatcgttgccgacctaatgtcgatggaggtacagtttgatgatgaagatttaggtcttttactgttatgctcattgcctagttcatatacaaatttttgtgacaccatacttttaagccgtgatgaagtaaccctagcggaagtttatgaggcgctccaaaacagggagaagatgaaaggtatggttcagtctgatgcatcgtcctctaagggcgaagcattgctggtcaaaggcagatctgagcagagaacctacaacgatagcaatgatcgtgacaagagtcagagtagaggccgttctaaatccagaggtaaaaagttttgtaagtattgcaaaaagaaaaatcacttcattgaagaatgttggaagctgcagaataaggacaataggaaatcagatggtaaggcctctgttgttaccagtgctgaaaactctaattcaggagattgtcttgttgtttttgctggttgtgttgctagtcatgatgaatggatacttgatactgcatgttcttttcatatctgcattaacagagattggtttagttcttacaagtctgtgcagaatggagatgttgtgtgcatgggagatgataacccacgtgagattgtaggcattggctccgtttagatcaagactcatgatggcatgacacgcacgctgaaagatgtgagacacataccagggatggcgagaaatctcatctccctcagcacacttgatgcagaaggatacaaatactccggttcaggtggagttgtaaaggtatcgaaaggttctcttgtttacatgattggtgatatgaattctgcaaacttatatgtccttagaggaagtacattacatggttctgttaccgctgctgctgtttctaaagatgaacctagtaagactaacctgtggcacatgcgtcttggacatatgagtgaacttggtatggcagaattgatgaagaggaacctgctagatggctgcactcagggtaacatgaagttctgtgagcactgtgtttttggtaagcacaagagggtaaaattcaatacctcagttcatcgcaccaaaggtatacttgattatgtacatgctgatttatgggggccctctcgtaagccctctcttggtggtgctcgttatatgcttaccattattgatgattactctagaaaagtgtggccttatttcctgaaacattaagatgatacatttgctgcttttaaagagtggaaagtcatgatagaaaggcaaactgaaaaggaggtaaaagtacttcgcactgacaatggtggtaaattctgttcggatgcttttgatgattattgtaggaaggaaggcatcgttaggcatcacaccatcccgtacactccacagcagaatggtgtggctgagcgcatgaacagaaccatcatctccaaggctcgttgtatgctgtccaacacgcgcatgaacaagcgtttttgggcagaggctgctaacaccgcctactacttaatcaacaggtcgccttctatctaacttaataagaaaactcccattgaggtatggattggtatgcctgctgattattcacaattgagagtttttggatgcactgcttatgctcatgttgataatggaaaattagagcctagagctattaggtgtctgtttcttggttatggttcaggagtaaaaggatataagttatggaatcctgaaactaataagaccttcatgagcaggagtgttgttttcaatgaatctgttatgtttaatgacagcttgcccacagatgtcatatgtcacaccccgaagttctcctcccaagcctaaaatttaatttataaatgaccctaagaaaatgccggtgcaaatcatgagaaaaccctaaggaagtaatacaaataataatcgaatctgacatgtggaatttttcttgagttctacatgtcgaaattcattaacaggatttttagtggaattttcagagccctagaaataattttgaccaattaaaattgagcacaagcaatatttaaatccctgaaaattcctttcttcctttttcttttttttctttttccttttcccttagtgggccgccggcccacttcccctcctctctcctcgcgccttgctgggccggccgcaggccatgccccagctcagcccgcgccccctcctctctcccgggg

SEQ ID NO: 73161 - DNA, 15715 bp, Oryza sativa
ccgcgcgctagcctccaaggggcagaggcagagagcccctctccctctgccgagtcgccctgctccctcctccttttcccaaatcggcaaaggggcgagccccctttctctccctccttttcctctttttctcccctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctcccccattcgcctcctcaccgttgccgccactcccgtgctctgcctcgcctccgccgtccatcgccaagcgccgggagagccggtgcgttcgtggacgcggaaggggactccgggcgcgccctcttcttcctcttcctcggcccgaggccggagagatcactcccgcgccgttggcctctcgtcacagcgcccctcctcaccacggtagtgcctctctccgttcctcctcctcgctccatctcctccccctagctttcggtagtagcttgagtagcctccccgtagttagtcggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaattgacctctcgtgacctcgtcgccatttccctcttctcccgccaccggttgccaccgccgcaatcctccgccgtcgagcaacctccggcgaatccgagccgttggctcgcctccccttgtcacgtgcaaccgcccggtgtgctcgctgttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgcatgcaccgcgtcccttctccgcccgcgcgcgtgcgtcgcgtgctccttccgcacggtgagccgagccgctgacaagcgggtcccacccgggaccgcgtgtggtgagcccggtccaccggactctctgtcctccctcccgcgcgcgcgcgcgcttgggccgtcttgggccggccggcccgttaagatcggccggtccgctccatttcccttgggccgcgccctagccgcccgagagaagtctacttctcctccctcttccttttctttctcaaaatggatttaatttaatccttttaactttagaccaaaaatccaataatcttagaaattcaatatcttcccaaccgtaaatccgtttgactccgttcaacttccaaaattccccaaatctcgagatctatctaatggcacgcttagaggtcattaatagggctttattttcgccgtttgttgagttgtcccatttcgcgtgtagtttcgaagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatcttttgtcccatctgcaaggcagattggcggacctaccagacttgttgcatttgatccttccattgttaattgctatactatgtccctttgtaaccacccagttgcgcctcgataatcgtgcactctgtgcgagaatcgacggtcgccttcaaacttaaaatctgagtaacaacttgggtaaaactggagttttacaaaagacttggaaaaaacccgacacctgggtcggtgcttgtgaactaaatgaattcccaaaaccgcggaccggggaacgtaccgggtgtacgattacccgctcttgcacctaaggaccgtttccttggaatttcatccgaacataagacaagtacgaccacatgggtggaatgggacacccttggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgctcgtgaaattgctgttgtgaaaatgggttcgatgtttgaaaaatcagcagctgacgggatcagctaggcccgggtggccgtttggaaagttgttggcccgggtggccgtttgaaaagttgttggctcgggtggccgtttaaaaagctgttggtcgggtgccaaccttgtttcaagatctaaagactgacacattgcacatactccgaccggacgagacgcactgtctcatccgtgtcgtttgagaagcactcacttagttgcttttagaaaagagttcaaataaaatcaattgctaaaacaatagcctttccttgaagcctgcattaaacacttatttcccctggcttgctgagtactcccgtattcacccttgctctatataaataactcccccccagttgctgaagaagatgaagcggatcctgctgatgaggagttcttccaggagcaagctggctacgatgagttttagggtttcggcctagttcccaagtcgcgcctgtgttgattggtccaagtcctggcttccgttttccttttgtaatgcagttgtgagctcgggatctgtccgcagcccaacatgactgtactcctactctataataaagagacttctgttgctgtgatattctgtcttcctgtgataccagcactgtttcctgggactggtatcgattaacaggttaatttggagcgtcactgtaacatacccgaaattttaggacttaaaatttcttgtcaaaatagttagaggttaacttctccaattttgagagagagccaaaaatttccattttaatttaggtgaagatcaacttaaaccattgcatgattaaaatttgagaacaaaataaaatcttttcattcccaacattagactagaaatgtcaccaagcatacatgtacataatgcatgcctaggctcgagttctttgtgcatttggagttttggtcttgcattccataatagatcccatgagcataatctaaaagaattacttcactaaacaaacctatagttaatctgttaatcttgggtgataacatgtggacttaatattaaactcaaatatcatcttcttagtctaaaagaaatttaatgtaatccctataataatattagatgcaattatgaagtgggaatacatatacaaacaaaggtcatcctaattctctaaaatattttgtgcaagataaaatcatggaaaaatttatgtggacagtgattagcacaaacttatcctctgtaattttggtaacatgttaacactcaagttgaaatctcaaattaatcggtcgaagcagacaactaaaagaaatcaaattaaatttaatcggctaaaaccatatttcatccaaaagtacatttaactgcacataagtgaacatgggaaataatttattcaaatattagattagttatcatgaataaatgtaatttttctagatttttcctcctctgtttaagcctcctaaaaattcaatctagctttctaatagcccatctttgtttaatttctgtgagcagtccacccattatttttgagtgcaaccaaagaaaatggaatctaggtgtaatcatctaccaccagtaaaatctacactaattcttctggtctacacattaagttatgtagttacaaagttagaggagaaaataattccgaaaattaatctaaaaatcaagtttaccagtcttctacccatatctctctccctggcctagtttccatcgagttggccccacttgtcagtgccttaggctaggttcagccctgtccaacacttcctccttctacacctctctcttgcctagtgggaccccattgtcagcctcacatccctctccacacgggcccacgactcagaccccgcgcgccacgcgtgtgagcacgcgttgagcgcggaagagggcgagctcctcctccccatctccgccggcgaccgtacttaacccgaccggccgaccaactcactctctctcgcccctgtctcgtttcgcggaagaaccgaggtaccccgcctcggattcgccgggaacgggggtgccaactccggcgccggtgagagaagtcctcgacgccgtcgcaatccggtgagctccatttccgttcaataagcgttctgtatttccctctcaatgccgtctctaacgccaccaagaacgcctcttttggtgcagccaatctccgggaacgcgaccgcatcaactcggaacaccgtcgcgctctggacgccgctgcttcgcctttgctcgtcgcccagcttccacggttcgtgacaagctgagccacttcgccacgagcttcatcaacctctgtagatcaagaatcccgaaggaatcgacgcgaggtggaccacggtgggagatcctcttctttttcttccaactctggccgccgacgccattcctttctttctccttctctggtgagcttcggcgcaatctttttcgcctagagctaccttgtgctgatctaaaccgaagcatgcaccctctatatgcagtagaagcccgggagtacaccgtcgacgacgaccgtagcagttgcgccgtcgccgaaccagtacaccgtcgccaagacttcgccgagccgcgtttgattcttggtgagcctcctagtagtccctagagtccttatcgtacgcatgcacgattaaatcgagcctcaaaacccacatgcatgtgcaagccgagctgagccaccgcctctaacaccctaacagccgctatagagcaccaaatcttgccagaaagccaccaataggttcgcacggttgttctctacactttttgttttgggagcttaagctgaatcgccgttgttcgccactggtgatgctgtgaagctcgcggctgtgctgctgctctgctctgtccagagcaagggcatggcttttgaaatttaaagactcccagggatgtattaacaactggaacagtcacttacaagtaggaccagtaataatctgtaaataaactaaaactcaagcatcgttttgcatacaaacctaaaactaggggactgcaggatctatttcccgagaaaccaggggtttttgcgcaaaatgttagtaactgacatatgggcctaggactgcgggttgattcctagaaaactcaagggcctttgtgcatattggtccctcacagccatgtagacccatcctttaaaatctgaagaaaaattaggaaaatgcccaaacaaatatatgtttaacagaaaaatgcacaaagttgtaaaatctatataaaatcaaatatagctcattttgaagtgattccagttgctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaactcaaaaactgcagattcatcatcagacacactctgattaggttaaataaaagtaatgacttactttgcatcaaatggctctaaaactattatctctataatgattagttttagataagctaaactttagaaattcatgtagaacccaatttagcttcaatttgaataaacttaagttatgtaggatcactaaaacatgtatttccaagttatgaaataagattatatacttgctgtgtagtaaaagtctctaaatattcatataaggatttactaacatagagcagccattaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagggttgtttaagtaatacataaacatgtataagtatatatatacactttaggtctaattaaacctaaataaaaacttgattgaccagtgaagccatagttccattcccatccactaaaattagaagaacttagctcatataacaatttctaggttaatataatatattgctagtttagattagagcatctctagtttataaaatatgaaccatagtagtaaagaccataaacatgtgaactaaaaatgttttagttaagcgaattattccttttattcaacttaaacaggaagtagcatgttctgaacctataactcaaaagtcatgaacatataaaacactatatgcctaaaacacgttgtaacttgtaaaatctataagaaaatcattataattccaaaaattgtaaaaccaaatgtgttagtcttagaaaacacatctccacacccctgtgaagtctaatctaataaaaatcactttacaaaagtatttcataacactacctaagactatactattgtaaaccgataaaacttctaaaattcataactcctaaatggaataaaataaaataggaattatttcacctaaattcattttagatcatttccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaccttgaataattgatcctcttgctgtttgaacccctagaaatgattagagtacattcattgtactcaaatgggtttatatatgctctatgtgcaactacttgcttagccatgcttagaaatatgcaaatgctcattccatctataattaaaatgtgaattttgatacatgaacccttgctggaataaaatgaatatgatgggtatttgcgaactaaaatgtgtaaaatgtgattttatacttgggcggcaagtggtgtgcatatggtgttagttgcataccgataggggaagtgtttgcccaagcccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttatgtgactaagtctgtccaatacaacggtattgtgccacgtggtgggttcccatcgtgtccgccaccacggcgttaagtttaaggcgtgggcccgccacttaacggttctaggtatattccaagtatgcctaggatggaggaacacgtatcgtactggtgcaaggctaggctctaagtagtgtaaaggcttcgttatgacctctagatcacattcaacatgaagagtgtggtggagtcttgcaaactcaaaacaaactagagagttcatatcatgtgggtaaacctgtacaaactctgcagagttctttaaactaatcgattagccgtgctcacggtcatgagcgctttggtgatgtgtcatgagtatagactatgttttaaaaatgtgatcatgtgacattggtttgaaattgataaatgtgttgagttgtgtatgtggtgatacattatgacttattgttaagtatggcaataagagattgtttatgatggaattatgaagaagttaataatgaaacttaaaacttgtctttgttaattgaagcatcaactcctttacaaaagaattgcaaaacaaaacttgctttatgctgaaattgaactacatattgccttcctttgaatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggtcggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacagtcacgggctagttccagtcggggctagctcggggcgtgacacctaccatcccgccgccacccttctgccactgctaccttcaacagaggccgcctcccgccgcctgccacctccgcacgccgctactaccggtgggtcgccgtcaggtcggttgagaggaagaaggggagatgaatgaggaggaagagaaacagagaagaagagatgagaacgagaggaaaagaaagagagaagaagagataagaacgagagagaggtgggtggtgggccccaccggctcgactggttttttttaaaaaccgacacctataataaatttttattataggtgtcggtttgaaaaatcaacaactatattataggtgttggttttttttatagaactgacacctataatcactgaaatgcgctggtttttgtattttcggaccgtggagttgagaaaaggtctaaagataccggttttaacactttccggtacctatagtggtgacacctatttgatgttttacgtagtgaaaacacgtgttggcagacatattgataaggagctggggagggaaaaagaccttgctgcataagtgcagagtgcagactttgctgccgccctgccggaggacgagccacagcggtggcttccatcacccgccgcggcctgcatcgacccttcatctcgaccaggcagacatggaagagagcaggaagaaagactaggaagaggaacaaccaaacatcagcgctacaagtgcgctctactccagatcgatggagcagtggaaacgtcgatttccccctcggcctgcttctctggcccatgtcacgtgtgacgtgttgttgtttagcatttgattgggccaggaccaggggtccaatacaatttcctaggggtgtcccacgttgtatacatacacaggctatacttggagcgtgggttataagctctcgagcggacattccctcatcggcttcttgtctattgcatattatctaaatagtcataaaaaatatgaaaaaatttatgaagatagattaatatgtgatatatcactacacaaacatacaaattaaaatatgacttctacaatccataacaaaaataacaaattaaattgtgaatagtatacacatactcacaatcatatatttgttatttttgctatggattatagaagtcatattttaactttcatgttttttatgactatttggatagcatgcaatagacgaggggacgtcccctcgagagtttaaaacagtttccgctatacttgccttgatcctgttggttcgatggccagaaattaaagtctcttttggccttccctttttagccaaatttagtatccaacagcagagtgcttctccaataccatctaccaagagacaccacttaataagtattcaactagttttaaagtaacagacaagatggtgttaggaattaatataccacatgcatgttgagaaccacttccattccaccttcgatcggacttatttcgcaaaactataaaaaacttgtaatgatcccgtactatcaagaatatatatacttaaatgtacaacggcagatccagaaattagttcgttggtgtcataacgtgcctattggtatcatagtatactaattgtacttaatcatagtgttataatatatagacaagcagtttaaccataggttttaccgaatatcatcggtgacgtctgacaccggtgtttacactgtagatccacccctgaatgcacacacatctcatataaaatttctaattaatcaaatccattttaaaaaaactggaataaagtttgcatgaaattttccataccgtcagtatagagcagctcacgttaatcattaattgatacggtacatctatctatactaatataaaaaggagttgcccccgtccaatcctacaggccaaatcacccacatcaatctctaccgtccatctgcatatcttgtgatccgtaccgtccatctgaatatcctctagaaacgtacagtctacgcgggcgaagaccacgcgcgatgactacgcgccggtgcgagtgtgacacgcgctcctcttttctcatcctcctcctcgcgtgtgctgccgccgccgcctcgcaccaccactgtccccaccggcgcatctcgctcctcctcctccaccaccacgtgccgctcctcctccaccaccacgacgtgccgctcctcctcagtactcctccttgcatgtgctgttgctaccgcctcgtgcgaccgttgccctcgccggagccgagttcttccccttccgctgccgccgtcggagccaaggtcgtccccttccgccgccgccgtcggagccgaggtcatccccttccaccgccaagctgaggtcttccccatcagctgttgtcgccgcactccacatcaatatgagtgtacacgtagggtcttgacccatcacgcacgcgcaatccccaccgccgcggcaaatcctcctcactgacgcgctctccccaccacaacgcatcgatacatccgcacaaaccctaccgcgacgcaatcctcgccaagacccctcctccgatgacaacgctgctgtgccgctgctttgcctacatgccgaggttgttcctgcaaaagtcctcggctgtccacgaccgtacctattctgtcacgcctccagtgttctcggtgacaacggcagtaagcggaggcgttcggctctacttgctggatggcaggggaggggagatggtgtccgtgcgtactgtcctccatgtggtgctcaacttcgccttccttccgcggacctccctccgacgtggtgcgcgtgcttgccgcatcgtcgtcccccatcacaagagggtggcgatcaacctcaccgccctccttggacctctcgccagcatggtgcgtggactcgctcgccaaccaccccagctctccctaagccgtggaattgcagtctctccaccacgcctgacgattccacggcctccctttgtcgcgcgaagggaagtctgtgagggacttcccagtcatcgagggacctccttgtctagcatttggaaacatcggttcgttcaatctctcctctccagttcaccccttttcttggttcaatttgaacaatcaaccaatgaagtaaactattttctgtatgtacgtgaagaatctatcggtgtattgtgccctgtaggtgttcgatgaattgctgttgaggaagggataatcagttcacacccattaatttggttgttcacttgctttcagatgacataaaactatcgacattgtggcctacttgcatgtcccatttttcaggtatttagaattcaccacaaatggaatgtattcaaggggacatcacgaatacgagcgatatgctcttcttccatggatagatcttaaattatcccgctgaagttggagatggatatgttcttgacatggaaggcagcaaaataggcctatcattttcaagatcaagggcagctactgttaggactctctaggatcacctaggtttagatctagtcgggtggttctatttgggttgatgtttgaacaacaatggatgagggagagggtttagagagaccgaccggttgaggtgttggaggatgaagatgtgccgaacatcgtcgttgtcgtcgcgggcttgatgtggacggcggcgacggtggtcgtgacggtgacggcggtcgtggcagtggcggttgcacgcgatcccggcgaggtcgtggcgctgcagtggcgtttcccgtcactggttgcgcccccttgatcggattagggtttgtggggtggagtggcggtagcgacgaaccttgtgttgtgagccgccccggcctccaccccttttatatggcgcagtgtgacgggggccaaccagccattgggctgggcgcccccaatcagggcgagggtcaaggcccccttgtgccgttgggctcaaggggagggagatccatctaacattctcccccttgatcttactatttcttttagcctttttctattccatcacagatttacacatagagcatgcttcatcgtcacagtgaatcaccgatggattcgacagccactatacacatatctattcagaaatagatactttaacttttcggccctatagtccaggattcataaggcttcccttaaacccatgccggctacatgttccttgaacacgttgggcggtaggcctttcatgagcaaatccgcgagcatcatttctgttctaatgtgctcgagactgattgtttgatctcggactttgtccttcacaacatagtaatttatgtcaatgtgtttggcagcaccacttgactgattgttgtgacattacattaccacgggttcgttatcacagtataactttagtggtttctcaatactgttaaccacctttaaatccggtatgaacttctttagcaagttcacctgccccgtggcctcatagcatgctataaactcggcatacatagtagaccctgcagtgatagcctgttttgagcttttccatgaaagagctcctcctgccagggtaaacacgtatcccgatattgactttgtattatcttttgcaaagtcagaatctgaatacccactatctggagcgattctgacagcatgaggccttttgttccttgcaaataatgcaagactttctttaccaatttctaatgctctgggcctggattactctgaaatctgccaagtaacccggtaacaaatgccaagtcagggcgtgtgcacaacagcgcgtactgtaggcttcccacagctgacgcatacggctttttttttcatttcgttgagctcatactgatttgtgggactttgccatgccccatacctttcccctttaactatacgagcaggtgaagcactgcatctgtacatgttgaatttcttcaacacattttctatatatgccttttgagaaagtcccaatgcatactttgttctatcttggtgaatctctatgcccaaaacatatgaagcctcaccgaggtctttcatgtcaaagtttgaggacaagaatttctttgtttcctgcagtagactgacattaatactagccagtagaatgtcatccacatacaaaattaggaaaataaatctcccattcttaaactttgaataaatacagttgtcctcaatattctcttaaaacccaaatttctttattgttccatcaaacttcaagtaccactatctcaaagcttgctttaattcataaatggatctctttagacggtatcccatattttcgtttcctttcatgacaaaacctttcagttgcacaatgcatgctttttcctccaaatctccattttgaaatgctgtttttacatccatctgatgtaattccaagtcataatgtgccaccagtgccattattatcctgaaggaaactttacaagagactagagaaaatgtctcattgtaatcaatcccttctcgttgcgtgaagccttttgccacaagtcgcgccttaaacttttctatattccctctggagtcatatttggttttaaagacccatttacagcctactgttttggctccttttgggaatttcttctaaatcccagaaatcgtttagtttcattgatttcatttcatctttcatggtttccaaccattcagatgagcgtgcgcttctcatggcctcttcatatgaggtgggatcatcctccatatgcgactcttctatattataaacttgatagtcatcatggatagccgatcttctgactctttcagacctctaggggcctccacatttggcacgttctgtacctgaggctcttgttgagtctcctgtactggcacattatctgtctaaggctgttgcagctcctcctctggtgtggcaataatttatgttgaatcctgtagaacaggttcctcactttcattcattgttgccacaggaggggtaacaacaggtgctggtaccgcaacgtcatgcattgtaggcacaacatcaacaggtagagagaagaaaggctcctgagtcgacagagcgggtacagacccccgccactcctcaagatcaatttctcgaaataccgagctccccctaatcatttcgtcttccaggaagacggcgtgtctcgtttctacaaactttgtataactgtttggacagtagaaacgataaccatttgatctttcaggatagccaataaaatggcagctgattgtcttggggtctgttatcgaaaggacaacggcataagtcgaaagacgtggtcactcaacagtagttggaaaaaaagtaaagtgtataaaattgagaatttttcttcggatcccccattacatgaccctatgggactatttatagccctcattactggttcttactactagggttgtggttatataggggaatttacatagttgcccttatgaaagggacatttatatgggtacatagtgtaatcgagattcatgggcccctgatgggccgtcgggcgatcatcggcccaatagcccttaggcttgatgggctggaaagcttcttcggtccttgcgggggcgaacttgttacggggaagtcgtctcccttcggcatatactcttcgccctgcatccttcgcccaagagccttctggcttggcaaggtacccgtgtggttcg

SEQ ID NO: 73162 - DNA, 972 bp, Oryza sativa
ttttactctggccagaggtgtaccactgtactcacaagacacaacctcaacatcatgtcaaccatgcgtcgcgatacttaacaagtacccgaatagagattgtgacaataccctttgcataacacaattcaaagtagtgcaccgttcttggatcataatcactcccttataaacaaggcatggactccccagtgacccccgtgggcttatctccgccacttcacaatctggtgctccacaatgaaccatactatacaaaaagtaaagccgttgtccacgttggcttgtggttggcaccgttaatgtttaacaactgaaaatcgtgaaccggtccttaattgtcatgagcacgaccatcaaaatcatgcgctcacaacccaccagtatcaagttttagttggcaaattagttaattaaccaatcacgattaaccatcgtgagctatcattaagccatcattaaataatagtgaatcataagttatcccatttatatgagctaatgtctctaagcatggctaagcatcctaaacacttttagctaaaaccatataatgttctagctaatccaattattaatcaaacgacaaagtatagataatcaatatcaaagggctataacaaaggcaataggttattcccacccaatgacattcgaaaataaatgcagtagttgaatagaaacaatagttttaaacgaaatcaacatgctcaaaggattgtttgggatctgtgtgacttgccttgctagccatggaactcttcaaagtcttctcccgcaaaatcggacactccgggaacgtcggaatctaagcataaaagagcaaaatcaccaaaacagcacataaacaatcatgaatagtacatttggatatttttaacatgtagatctcaattttagaaaaaattagagacttaaaccaactaaatccgagttaagatgaattagttatgaatttttaaagattaaatc

SEQ ID NO: 73163 - DNA, 6214 bp, Oryza sativa
cagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacataatatttgtacggtaacattccaaatatgccctaaaaaataataaaattgtattttaccagtcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcggccccccgcacagtgcaaaatcgccctagcggagggcggcaagggggccgcctgcaaatttcgttgacggccgtcgcccgagagcgaacggccgtctgccacgtcagtttcgccgccctctgggagggcgatttttaaaaatcgccctcccagagggcggtaggcgactatttccgttaattttcaaaatggaaaattatttttgtaaaacttttaataaaaaaaattataaataaaaaaaattccaccggttcgcaggctccggctagcgcctcactcccggcagggcgcaggcaatgagacatactagcaatctactccctcagtcccataatattgcaatctatgaccggataagacatttcatagtacaacgaatctggacagatgcatgtccagattcattgtactatgaaacatcccatccagttctagattgttatattatgggacagagggagtagcatgcaagctgcacagcacaagaaggaaatcgaagattgccaacatgtcacacgaggaacccatgctagcattttgactaaactttaattggctttgaagaacgacccaacaacacaaaaatgtattttatacatagcatataagaaataaagcatattttaataaaaattaaagatgcaaaaaaacttgaaacttatacacaaacttccacgttttaagagctaaaaaatcatatttctttgaaacttctaataggataaaacaattattaacttgtatgtccaaaaggatattttgggtattttgaaataatggcctaacacaataacgtattaaaacaattgatgaaatcattgttatattatagaaatagataatattaatggcaatcccctgtttcgaaatttccaaacccctagcgctggggtggcgacgatggcggcggagccgcgtgggtcacttcgccggcggcgggggagtgcagcaagggtggccagcccgagtggcggctcaccctcacctcacggcgaggagctcgcggccgccgccaccgagcgcgacaacctcgcgacctctgtcaaggtccaagcacgagttctggctctctccccgtcagggtttcccaaaccgccggggccggggttaccgtgccccggcggtaagcacggttatcgcgcggtaaccgcggtaaccgtgaaaaaccgtgcaaaatttatcaaaaattcaaattatttttaaaatttatttgaatttaaggaggttaccacggtatttatatcaccatactccgcggtaagcccggtaaccgcggtaaccccgcggttaccggcggtaaggtaaaccctgctcccggccacgtccaactccccaccaccagcagcaggaatccgaaacgctctcgcatttgggatttgggagtccgtcgcagactgcgcgacacgatggatccactgcctactactatacggtgtgtgtggttcgacacacacatagcacatagcagcagcttgtctctacaatcatgtcgtcgcttgcgcatctcgccaagatagtctctctcgatgctgtcttgcgttcagattgcgtcgtgctattcgtgctattagaaacagactcgatgacaaggacgtattcaatgtgagcaaaaatattgggtgccgaatctctgaaaacagtcttgacgataaggacgtactcggaataattaaaaaaaaagagttcaaataaatgttgaaaattctcttggttatgtttgtgatggatctaatttgagaaagagtaatattgcaataggtttatatataggggctattctttcaacctatgtgcttgtgaatatgttgcattataaatcgtttgaaatcatgaatctttattgctaatttgagcttaattgtaatatatttgattcatgtttatactacgatgcatgcttgttaactagctaatgaatttatctctcttgtattccaaaacatgaccttgaattgctttaggtacacttcaaagctctcggaaaaaaaatagaaaatagaaaataaaaaaaattggttattacaagtggcaatcatgacatcattgcatttattcttggtgaaattattgtcaaagggagtgaaatatacaaaatgtatgcttcttgaaaggggagaattgaattgttttgattttaaaaatagccgattttgtactttgattgcaaaattgatgggagaaattctttcttttaaaaagggggagagtttttctttttcacttttgtgatttttgtttttatttttcaagaacacaaaattatattttggtgccaatgtgttcatcaagggggagattgtgaaatcattgtcatgattaatattttgtgatgaacaattggctatgcaaatgatttaatcaatgaagtggtttgaaaagatgtgtggatgttggtgtgagtgcgtgtgactaatgtggatcaggttgtgatatctgtgctcagaaatggttgttttgtctgattgtgtgcaggtgacttgaggtcagccttggtcaatggtgaggaccaggactatgctcagagtagtgcagaggtctagtgcagtcgggataccacgtgagaaggtgactagagttaggattcttggggtcaacttcggtcaacggtgggatcgagactagactcagggaggaattgagatgcagacggtcaaggatactggatgacgaagttggatacgagatggcacatggtggatgaatatcatgtgggagagattttcgtaacgggcttcacgaggtatgcgtgcaagcgtcggttttcgtgaaggagattcgaagaaactggagaggagtactccctccgtcccaaaaaaagacaaaccctgctttccgtgtccaacgtttgaccgtttgtcttatttgaaaaaattatgaaaaaaatttaaaagataagtcacgcataaagtattaatcatgttttatcatctaacaacaatgaaaatactaattataaaaaaatttcatataaaacggacagtcaaacgttgacacagaaatcagggtttgccttttttttcgacggagggagtatatatggtgctacagtgcttcgggtactgtagcatgcacatgtatgcgtactatacagctagcttgcttttggttgtgttggcgttggctggttggtccaggagcgagcttggcgtgtgcatggaggcaggccgacagacagcaggttgttcgggtggcaagcggcagtccgagtccgactcggttggatggcaggccgagtcggcccaggtggcccacgcggcaggaggcaagaacgatttgcagtccgactcggttggagttggctgcggtttttatttagagattgaagattgagttctagaggaactaggaggttcacttctactttgtctaggaggattttgagtataaaactacatcaacttgaaaagaacaccaacaaataaggtggaagaatgacaagacaaggcagcacatcggtgacaatactaccagtaacgatgagccccgccatggccgctagaagcgagcttctccggccggcatttggtgaagcatctccttcgctaggacggtttgtcattaaccctcacagctgcagctacaggtggtggcacatgttcctgatcatgctggtgttgtactcggcatgggcatcgccgttcgagctgtccatggagaaggcagcctccattgctcttgttgtcacagacctggtggtcgatgtcttcttcgccattgacattgccttatccttcttcgtcgcataccgtgacacctccaccggcctcctcataactgaccgcaggaagatcacaatgaggtacctgaaacggccgtgtttcgctctggatgtggcctcgacgattcctttacaaataatctaccagcttgtgactggcaaaagacaaggactgtgggggctcctcaatcttctccgtctttggcgactacggcgcgtcagcaagctctttgcgagggtggagaaggacatcagattcaactatttgtggaccaggcttatcaagctcctttgtgtgacactgtttgcgctgcattttgccgcttgcatctacctgtggatggcattcaactacaagatcaaggagcttacatggataggcagccagatccatagctttgaggaccgaagcgtgtggttttgctacacctgtgcagtgtactggtccatcaccacgcttgccacggtcggctacggtgacctacatgccaccaacattggcgagatgcttttcagcatagccttcatgcttttcaacatgggcctcacatcctacatcatcggcaacatcaccaacctcgttgtccgtgaaacctccaacaccttcaagatgagggacatggtgcagcgggtgtcggagttcgggagaatgaaccggctgccagaggcgatgagggagcagatgttggccagcgtgcagctcaggttcaggacagatgagcagctgcagcaggagatgttgtcagagctgcccaaggctgtgcggtcgggcgtcatgaagcacatgttcaagagtgctatcgagagctgctacctattccagggagtctccgacagcctcattgtgcagctggtcgcggagatgaaagcagaattctttccccccaaggctaatgttatcctagagaatgagacctcgacggactgttatatcatcatctctggcgaagtggaggcattgacaacccttgcagatgggacagagaagcatgtgaagagaataggacctcggggcatggcaggggaaatcggggtgatgttcagcattccgcaaccattcaccatccggagcaggagactcacccaggttgtccgcataagccatatccatctgcttcaggctgtccggcctaacaccgcagatgggtacatcgtgttctccaattttattcagtaccttgagtctctgaaggtgcaaacaaaggatgtggcttttgtcagcgatcatctttggaatggaaactcaatggttttgagaagggcaaccgaggttgctgtagatgaatcaaaagaggccgctcacaaaatgttaccatgcaaagaacccaaacgggttgttattcatgagcaacttcccaacgcgactagcacagcactgcatccttcgccggggaagctcgtcttactcccagattcgatgcaagaactgatgaaactttcagaaaagaaatttgggaaggccgtgagagggatcctcactgtggaaggagccgaggttgaggacattgaagtgataagagatggcgatcacctgttatttagttagtaggatatgccatatgctgtggcagattgtaaatgtatatgatatgagcatttatatatgttcaaaaagataatattaatggca

SEQ ID NO: 73164 - DNA, 5065 bp, Oryza sativa
gtcttctgtatgggcgggcatcttaagtgatacacctgggaaaaaccatctctattccaactccttttatattctccactcccatctctctctttctcccactcctacctaccctggccactccccctctctgccccactcctcactccggccacctcctctccctacctaccgcaacagggcatcttaagtgatacacctggaaaaaaccatctctattccaactccttttatattctccactcccatctctctctttctcccactcctacctaccctggccactccccctctctcccccactcctcactccggccacctcctctccctacctcccgcaacaacaggtgtggtcgacggcggtgcccccctccgctctcccttgcgcggagttgatggcgtgctcgagtgggaggtagcgggcgcggcagatggcattgtggtggcaggcacgggctccggcgacaggtgcagatggcggcggcggcgcagatccggcctccacgcgcgcagatccactaccgtcgacgacgacggtggtggccgactagggttaggattagggtcaggttttgatttttagattaatatttgtgattttccattttcacatgagaatggcttaaatgcccgcatgcgggtgagccatatggaaaaattgctatttcacggaccatttcggacagacggctggtcgaaccgcaattgattttgacagtttgaaaaaaatccctttttagtagtgcatgcttaaagtactttaactaataaaataacttacaacaaaataaattattattacgtaaatttttgaataaaacgaataataaacatataaaaagggtcgatggcatcatctatttaaaaaacgaatgtaaaaaacgaatgtagtatatataatctgacacacgaacagcccaagacagatatatacccaatagattcaacgagataattattatcagtgggtgtggttcgagaaatgacactaataaattttctttgtgccgcaatctttaatgcgttaacagtccgagaaaaaaaatgtacgagacgaatagcatatatatacttcctccgtccgtacatagtataagggattttgagtttttttttattgtttcatcactagtcttatttaaaaaatttgtacaaatataaaaaacgaaaagttatgcttaaattactttagataataaagtaagtaaaaaaataaataataattctaaaactttttaaataagacgagtgattaaatagtataaaaaacataaaatattttatattatgagacggagaaagtatatgacaaggtaccacgctatcgctacctactatatatacccagcatgaaaatgtcgtgagtctctctctctctctattggaatctttctactactggtagataaacaagtctttaatacgctggccttctactgatcaagaacaaatgaatcagaatgggacaaggttgccagaaataaaaataagcagattagcagatggtacacatccatatgtaggatggctgctttttcatcacaaacacgactcatgcattctaacatagagaaaccaaaaaattcaaaccacgtgaattccaggccaaaggaacgtacgtatacctgactaacctgcattatattatcctacaagtcattttttgctgaccttaaatattgttttgatcgaagaatagtttcatttatctatatatatttttagtactcctttcgaatgtcgatctaaaaaaaaatgtgcgtgtattgattagtacttgtagtacttatactccctctgtcacaacaatatctaactctgaagaggaacacatgttcagatcattcatctatggaattggattttttttttacacagggaagaagtacatggagtcttaatcctgagtgagcatagggaagtctaatactaattgaacgctactggaatgaacgtcagaacggggcagttgggatagggagatgagggaattcggcagatgaatccacgagtggtatactgttgatcgacgtcagcaagcaccggaatttctgcctgcagggccattctcctccacacaagaccatcatatgtaaatggtctcgaatggaccggcagcagttagcgtgcagctcttggtctctcaaccatcgtactactccctccgttttataatgtaaaaggatcttaagtttgcttatagtgtttgaacattcgtcttattcaaaaaaattttagaattattatttacttttttatgacttactttattatccaaagtactttacgcataacttttcgttttttatatttgcataaactttttgaataaaacgagtggtcaaacactataggcaaaaactcaaaatcccttatattaaggacggagggagctaataactaattagcactgtacttgttttggaagactcagcgtacgtgcttcatgtttatcatctgccagaatctagcggcatctttttccttgcttaccacgagcacgtactgtacgttttattttttaaaaaatcatgtagaagtccttttcaaaatcaaatgaactaatttttaaaatttctaacagttaatatttaattaatcatgcactactagcttccctcttgtttaatttcatttggcaccgacttatcaaatcctacggctctatcaaactaagggtatcaacaatgtattatttaccaactactccctccgtccaaaaaaaacgaatctataattagatgtgacacatctcagtacaacaccctcattttacataccttcagtacaaatctggacagaacaatacatcccttataccaaataataaatattgtagtacataccttctaaaataagttcattttacacattccacctaccaatgtataaccaacacaactagaatacccttactttcttaaaacccaatgccattattccttactaagagtaacaatgcttttttattccttcctatgaggttgtagtgctattactacctgatattagttgcttagtaccttcacaatgtttactaattggtactataagagatgtatttatcgcttactatacccttgtcccaaatatgtatttatcccacggtaccaatacaagaccaaaacgaccataataccgttacttgctgagatgatcaatgtttttttattccttgctagcaggttgtaatgcaattgtcacatatttgtagcttactacctccaaaatgtttactattcggtataagtgttgtatttggtgcttactacaccctcatcccaaaataagttcatgtttcacacatctcacaccaatacaaaacaaaaagaccacaatacaatagttttctcaaatgacaatgaaattcttgctaaaagaattaatgtttttttattccctactagcaggttgtagtcctattgctctatatgtgttgcttagtacctccgtatgtttactatttggtataagggatatatttattgcttattacaccccgctcgtaaaataagtttatttctcacacatcccacacatagcaaccactatctatttaatttatttatctattttttcttctcaaccaatcacaaacttcatccaattatttttgttacttctttaatatccatgcccacctaatatttgaacggagaaagtatctattttgtgacaaagacagtatccttttcaagagttcattctggaagccctatgccttatcctatataaagcagctagctagctagctaaagcaaccatcagactaccacactacaatagtatcagtgaactgctagctgttgccctcccaagggaaatatactagtatgtctacttccatccctctccctttcttcttctctcatggtgttgtgcatgctaggacaggccatcctccaatctggccgccggttgggctcctttctgctggtgccccggcaaaagtctccttccgacgacaaagcaatgcgcatcgacatgctgcacaagttgtgtccacacaatcaatcactcctgcgaaggaggtgtctagctttgagccctctgtgtggggggacttctttatcaactatgacacaaagccactacaggtatacattttttttttcattttcatattgtgtacattttgctctacagcaaaactgtacaactgttctgtagaagaatatcatctggttttctagtcaacataaacatataacctgatctaacaagcatatcaaaagattgctgacaggcctgaaacaaatttcaccaccatgttatcacgtacaaaacccttaggaattaatatatctgttcttgtttacttgtcaccttaaccaccttttgaagtttggaaatatttatcgatcactacacggttacgaaggtgataattctcattttgcatatgttacccatatgcatgtagaagagattacatatcccaccaacatatgggtattttggttgtttcattaaaaaaagttgattacatgggtatgtgtgcatggtcaatagtgagcaataaacaaaaatggtgggactaataccggcacatgtttaacgtcaaacacgctccggctgcctaggccacgcaggcaacttgtttacgaagatccgaattttcccagataggcatcaaaaccacacacaaaaaactggttttcactggctgacacgttaagatgctcgagtgcataagatttttgctcaaaaaacaaaaaaaaatccaaaataataaaattctagaaaccctatcttgatatccaatacaagcatcatcgcaatcaatatgagatgacataattaaggaataaggacggaatgatgcgacataaagagtgactagaggtcgggcagattgatgggcgtatttattttggcttcgccttttcacacgtggtcctattatgaggccaactaggattgtttttatagacaattttgggtattttctatgaaaaatacgattttatcgaccgggtctttaagacgggcacctaaaagaataatcctatttttagacgcgcctcctaggaagcttgcctatgaaaattgactctcacagtag

SEQ ID NO: 73165 - DNA, 548 bp, Oryza sativa
tgttggcgcgtccgttcccggtgattgggacgccgttcaagggggaaaatgggggaaatcaaagaggaatcaatggagattaattccccctatttaatttggaaaaagccggcttgaatggggtggatttggaggaggaacaacgctagggttcacgggagagagagagaggaaggaggccggcggctggaggtcggggacgcgcctggcaggcgggacccatgcgagaggcgcgcagtcaacgcgcggcaacggcgcgcacgcgcgcgcacatgcgcggcacgggtgggaggcgcggctcggcttgggccgggcaaagccgaggcggcccaggaggagaagaggagggagctgggccgaagggaggggaggagggaggggcggcccgggagaaacagggaaaacagagggaggattgaaggactttgggctggactcggcccaaaggagggaggaggattatttttagtttttctttttagttaattgttgttgttgcttaatatataattccggtgctctgaaaattcaagtaaaatttgagagct

SEQ ID NO: 73166 - DNA, 19500 bp, Oryza sativa
tttaggcgactatttccgtcaattttcaaaatggaaaattatttttgtaaaacttttaataaaaaaaattataaataaaaaaaattcgcgtcgcgcgggactccaaatttgccgtggcccaacaaggcccatggggcatcaccagtaagcccatgatgccgcgccacgacgcgacgcagtgcgctggccttgcggacaaaacgcaccggcggctttgcgcccgtcttcacgggaaatcgaggagccgagcgagacgctgctaggagagagcgacgtgccgtgttttgtcgcccaaaaacgtgtgggacggtgatggatcgaatcaaatgatagcctgtctggtttgcaggtgagacgtgagaccgcgcgttgtgtaatgctggaattaagtatattttgccttttttttaaaattttttctacaaaatagataattgaaaaaattattctaggaatagactttttttcaatgccaggaccctagcgccgaggcccatcatcaaggcgccaacgacactggcgctcataccctcgccccctgcggaagctaagtgactaatgtaaagagagttggtattgaggacttacagatagatccccgatgctagtgttattgatgccaaggacatatttataagaaaaaaaatatttatattttaacccattttggatttgttttttttacaaataggtcttcaccactagtgttattggcgctgacctcttttacatcaatgacttagcatttgcaacgggtgagggtgtcaactcggtgccgcaccaaggcattgaacctcagcgccaatgacgttaacgtcaaaaaaaatgcatttttttcagaggtatatttgtgttgacggaaaacatggcgtcctgggagctctacttaatttcaatgcaagtctaaggttagcctcgagtgtgtcaagggcgtgccagctggtttgatcctgcaaccagcaagaaaataataaatagagtgagtcagccgatagttgatcggtcgagataggccgacgacgtatcactggtgatcctagccgatgtaattgaaccagaccggctgtggattggtatataaattaagcacaaaaccctaaatatacctcatcggctgtaatagcatctactcagttgtcaaatatattttggatgataccatagaaatataaaataggtttttagaaaggactacaaatataaaaaatccaggtgtgtgatgcacgtggtatgaatctcggcacctatttcgttgctggcattaaatttcgtcaaatatctccttttttttttttcagatttggacatggactggcctggctgctaatctgagagattgatgctacgtttacaagggacaggactcgcgaaatgttcaacgagatcacacaaatggtcaaaaaaaaaatgggagcaatttgagctgcggtagtggactatgaccgataacaggagaaaccacagctgttcagtttgattctaggggaaacacactcaagaagaggacattagatagctgcaaattccatgtgcgatattgggaaagagagaataaataatgaagctgttgccctgattggagttttggaccaggaccaattgtgcgaccaaggacctgtttggaagattagcccagggctaattttgagagttaatgtttagtcctgaatttgtaggctaaacattagcctagggtggcatgtttggatcgatgggctaattcaaggctaaaaggtggagagagagtagaaagagagaggagagagagctgtttttttatggtccccacacaaaattagccccattagcatcccttggaggggctaatgttttgagggaggctaattcatattagcccaaaattagcccacctgtttggatccttgagagctaaattgaggctaaaaggtgatagctaaacattagcccatggaaccaaacagggcccaagttttggaccagtattaacttccacatttgcctttaaatttaaaaggcctcttttcagcacgcatgaacttttcaatgtgaagtgaactaagagaaaaaattgtactgaaattcatgtgagcatttctacgtttaaccgaatgaagttgtgaaattgcccaaacgggaattaatagggaaatctaatgaaatgtttgcaacctcccaagattttagaaaagaatatctctgttcaaaaaaaaaacaaattacgtccaaatttacaatgtttctatgagcgaacatgtttcgattttttgcatgcgatctccggaatggacggagaatgcgccgtcgtcgacgctcgtcgtcgtcaccgtcgacgacgacgggcacgaagcggcgccggagtcgtcgccgtcggcgttctgcactatggccagcgtgatgaagctccggtacgtgggcgctagctccggcagcggcgcgtcgccatcgaggacctgcaccaccagccgcatcggcggcctcgcggcgggcgccgggtgggtgcagaggaggcctagcttgagcaccagcgccgcctcctcgtggtcgtagtctccgcggagccgcgcgtccgccgcgccggcgatgtcccccttgtgccaccggtcgagcacccagtcggcaagcacgaactcgccgtcgtcgccgtcgtcgccggtggcgccgccgtgctcgatgggccgccgcccgcacgccacctccaggacgaacgacccgaacgcgaacacgtcggtcgccggcgtcacccgccgcgtgtgcgcgagctccggcgcgaggtaacccagggtgcccaccacccgcgtcgtgcgcgggtcggcggcgccgcggccgtacagccgcgccagcccgaagtcgccgagccgcgcgtccatctcgccgtcgaggagcacgttgctcgccttgacgtcgcggtggacgaccacctgctcccagccctcgtggaggtagagcaggccggcggcgacgcccctgatggcgcgaacgcgctgcgcccagcccagcggcggcgcgctctggccgtgcagccaccggtccaggctgccgttcggcatgtagtcgtagacgagcaggagctcgcctctccggcggcagtagccgagcagcggcacgacgttgcggtggcggaggcggccgacgctggcgacctcggcgacgaactgcctcatcccctgctccgcgtcgtgcgacagcgacacgaccttcacggcgacctccgtcccggacgccgggaggacgcccctgtacacgcggccaaagccgccgacgccgagcagccgcttgccgtcgaagccgcgggtggcgcggacaaggtccttgtacgcaaaccggtgcgggccgaactccacctcccagtcctcccggacctcggcgtgccgccgccgccgccgccgccataggaggacggaggcgacggcgacgaccaccgcgagcgcaaggagcggcgcggccaccggcacgaggaccttgagcaccatggaccgccgcttggtgctggcgcgcggaagcttggggagcttcgcgtagtctagcggcggcgccggtccgtccatggcgaagctccagccgagcacgtagtggcgcgtcttgtgcggccccgtcgacgacgagaggccgacgtacgccgccgcgtccgccgccgccacaaccggcgagaggtcgacggcgacggagaggaggggcctcctcggcctgggcacctcgacgggggccagcgtcacgtcgatcgccgcggcggcgccgtcgtagtccacccagacctgcatggcggcgccgctgaagagcgtcaggttctcgaactcgccggtgtcgtcggcgtagtagccggcgggcatggaggcgacggacgccagcccgttcacgtcgacgccgacgtggttgccgttgatgtccccgaactcctggttgcggatggtgtcgagctcgacggcgaacacgcggttgctcgcgttgccgttgttctcgctgttgaagaggcccaggaactggctcggcagcgccgcggacaggttcttgctcggcgcgacgaagaaggcgagcccgttgccgctcaccgtgacgtactcggcggcgatggcgaacacgaaggtggtcgagaaggaccgggcggcggcgggggcagtggcgttcggcttcggcggcggcgcgacgaagcggagcggcgccgggtggaacgcgtggcccttcatctgggacgtgacgttggtcagcatgagcttgccgtccggctcgaccatggccatgccatcgaggtcgagcggcgcgccggcgaagccgtcgtacctgaaatggtcgctatcaccaccggccgccgccgccgccgccgacgactcatggctaaggataaggacgtggaagagtagtaacacaaggaaggagacgatggagttaggcttgggatgcatggatggatcaatgggattttgccgtgcaaagctgaataactcatgtgtcctaactcctaagtcgtaattaaccaattctagttaggtaggatactatcaggtctgtttatttttgcaaaaaacaggaatttggttaagcaagcaatcatagtaaatcaatagggaatcgctaaatggcatttgacattaaactgatgaggccaaaatcttgcaaattttcgactttaagattgcttcacgattcgtgttctgaaatcccagtttttctcctctaactccagcgaccggctgcaatctaacaagttacggtttagtgtcccgggttagagtggcagtgggaggtgggaagggaagaggaggaagatctttgggctttaagggatggtcatggaagacggcgagatgccggtggccgggctaatgacaaggcactggcatggaagccacgaggatggaggatagcggtgggccgacggcagggtaaagtaaagtttatggttaggaggcgactgccgatggtggcaaacctggtggcagtgagttgtcggagacgaggaaaataacagggatgggacaccttgtagctatcagcttaaggagagaaggaatggggcgacagccacagtgttctcgccagtaccattggcgtcctcccgccagacgacaagactgaacggctgcggagcatcaagcactctcctctcgtggcgacactaggagtgaggggggacgagaggagggatggagttaacgttaggttttcttgcatgaatcttaaagcaatctaacggtcaagaattatagatagacagtccatctatattactttctttttagttttttacactattaaagtattgaacttgcaacaccacactcaaaacattttaataaatacacctacacctatatatttactgtacattactatagcttagggagtttgatatttcacatatgtggaacaggtttccaaaagaggataaggagggagaacatggtaagttttgtttttttttcataaaaaaatctccctcctatggaaaaagtacgaattaccctcccgaactatcgcggtcgtccgaattacccacctaaaccaaaaaccggacattcttcaccccaactatgcaaaaaagacgaattatccctctcaacccaatccgcggtggttttggtctacgtggcgtacgcgtggcagtccagtcagcattctatttataaaaaaaatatgggacccacctgttatatcctctctcactcttcatctcactcttctctctcttctctgtcgcactctgcggcaggcgggggacacaaagtggcggcggcggcgcgcacgcacacggacggggccggaggcggcggcgtggccgagacgcgcatggcggcgaggacgacggcacgcacggcgcggcggcgcgcacgctcgcggatagggggacctccggcgtgtcgccgtcgacgcgttcgcgtggctcaaggcgcggtgggcgtgcctccagaagcaggggcggatctacagtactagggccggtgtcaggtgacaccaacgactttcggtaaaacctatagcaaaactgattatccatatgttatagcaccatgatctaagcataattagtatattatgacaccgatagacacgttatgataccaacgaatcgattttctagatctgccactgtccagaagcgcacggaggtgaagctccaggacctccccgtcgtgctcggcgcctgctgcgtcctccacaacatctgcgagacgcgcggcgaggagctcgagccggagcttcggtacgagctcgtcgacgaatagacctcaccggagacccccgtccgctccgaggccgccaagcgcgacagggacaacatcacccacaacctcctccaccgcggcttggccggaaccaccttcttctgacgatcgattcgatcacaccgccgccgcttcttgatttcccccttggtccacttgcagcatctccattactattgtgatttgtcaatgtcctgcagacctgcagtttgattgctttgctttgtcgtcggcgtgaactcttcattgtttgattgcctcaaaggctggttgattgtttaccagtactccttgattgcatcttcgttctgccgcgacaatgaagccggcgctggcaaccgcgggggcaccctcctcgagatcctccgcgggatcgacgagccgccgagcaagctcgagctccagcacgcgggatcaacgagccaccacctcgagttgggctcgctggagacgccgacgacgacgcggaactcggcgtggatggggcggcgcatcgaggaggtcaaggcctcgagcctgcggccgggtgcttgccgcagagccgtgcatgccgccgtcctcgccgccgcctccggcccctgtccgcgtgcgtgcgcgccgccgcgccgtgcgtgccgctgtcctcgccgccgcctccggcccccgtccgtgtgcgtgcgcgccgccgccgccacttcgtgtcccccacctgccgccgtgcgcgtgagagagagagaggggaagagtgagacagagaagagagagaagagagaggaagagtgagagagaggatatgacaggtgggtcccacattttttataaataaaatgctgactgggctgccacgtgtacgccacatagaccaaaaccaccgtggattgggtcgagggggttaattcgtccggtttgtatagttgggggtgaagaatgtccggttttatggttcaggggggtcattcggacgaccaccatagttcggggggtaattcgtacttttcctcgtcctaaataggttctagtggaaattaattttggacgaaaaattatatataccagtaataatatttttaagaaatctcacctttacattgggattttttgcgactcctcttctttctaatggtctttttactactcaacgttctttgtgatggcagcgctcaaatttgttctcgcttttgtgatatcatagcagtgtgctgtacgctactattaaaagtttgattgaaattgaaacgatgtgacggaaaaattgaaaatttatgtgtgtagaaaagttttgatacgatgaaaaagttgaaagtttgtgtactaaacaaggcctaatactcgagctaggcagccggtcaactgagtcaccattaggaccaccaaagctaggaagaacacaggaaagttcctggttgattgttacgctcgccatcagatttgtgctgctcaaccatagcccgccataggattttttctgcggaatctatggcttcttgtttgtctgtgtttgacaaacttgtttccacggttttatctctataccgttcatgatggaggatttggagctattttgaagaacaaataattataagatagaattaaataattatgataaggcgaaaaaagagtcacgatattcatttaatcattccaaaggtttaaaaacagccacgcttaataggagaaacgaaatatatatatatatacaccgtttatatcgtgattagtctaaattaaaatgtaaaaatgtgtaaattgaacaatagtcatatacaaaacacatttgtatttatgaaagaagaggggaccattgtatatcaaatccaattctattttgaatcttgatcctcacaaaattacacattaaagacctctatttataatgttatctatctatacttaggcttcgatcgttcccgggtgttctggaagattgagagagaaaacatctcgttttccgcgcgcacgcttcccaaactactaaacggtgtgttttttgtaaaaaaaatctataggaaagttgctttaaaaaatcatattaatccatttttaaaatttaaaatagttaatactcaactaatcatacgctaatagctcacctcgttttgcgtatcttcccaatctcctcaatccccttctcctcaaacacacccttagtataaaaaagcaacacttcacttcttttctaggtataacccagaaaacatacacaaaaattggtttttctttcctcattcatccgatctactcatccaacgacaaaagagggaagtatatggctgtcgtttgtgatcttttttttttagggggtaaaagcaggagctctgcctatttcatataaggagaagagagagaaaccaaagtttttacaaacaaggttacaaaaggatcccaagcggaccctcctccgataaagacaggttggagacaagaatttttaggaaatggaaagcaactaatgtgaggatacgagaactactcatctaagttgtgagctccatcataggctttgcacatatcgattatggactcaacgacttgcatcactgtgctgtatgccccattgaaaatcctagcatttctttgaagccaaatgccccaaactgtgtagatgaagaggccatcaaagtttcttctttgttccttcgccatctctctcctgcaggccgtccaccatccaagcatgtctccattgtaagcggcggctggtggcatatgaaggcccgctttctgccaaatgtatctccagacttgctttgcgaaggatcattccatgaggaggtgggtggctgtctccggttccacaccacaaagtgggcagatgtggttgttgtcccagccgcggaggctgagtttgtcagctgtgaggatcttcttatgtatcataagccaaccgaagaatttgcatttgttttctacttttgccttccaaaagaaatctgacatgttatcttgtacgcctccaacgaattgtatcatgtaagcggattttgccgagtaggttccgtttggggaccatcgccacataatcgtgtcctccgttccttcttgcagaacgacctgctggatttggtgccataggtggatgaattctctgacttgggctgtggtgttcattcttcgcatctgtctcaaccagcggttgtcctgtaactcctgcgccaccgttctgttctttcttgttgcaatctggtagagtgaaggagatagctctttaggggataacccatcgagccatctgtcatgctagaattttgtcttttggccatttcctagtgtttgtgatcatacggtgaattcactaattctcaatccttcccactgagaacgcgtgactccatctccatggccctaaacaacgcatgattaatcatcgccactcccttgcacgccatccccgctaccgtgccagggccatccatgcggctgtgccattcgcctgctatccgcctccacctaggatgacgtgtcctcgcattacggacgtcgctgcgcctcccgctgcaaatctcatcctcccgcattgccggcacttcgcgaggaggcgaggccgctgtcgcaaaacccctcgccggtctccagccattgccacttcgccatctccgttatcctcccaaatgttgcgcacctcttgccgcaaatagcttcctcccgccgcaaatcgcagcctccccaatccccccgctggcaccacggtagtccgcccttacccggctgggttgctccgtcttggtcgccactgcaatcgccctggtgttccatcctttcctcgtgcagccatcgccatcacaatcctctcttcccttggcatcgccaccctgctgtgtccccggtggtcctgccatccgtcagcgtcgccgtcctctcttccaccagcattgccactctgccatgcccccgaaggcaaggccatgccgttgccatcctctcttccaccggcatcgccacttcaccactcccacagtggtcctgccttgcactgccattgcaaggggctctcacaatcagggaggaaactgagctaattagtaagtcaatcgtttcccatagcttcaatcttcactaaaccttataatatagctaggttcaaggtcatgcctcatactgtctattggtgttcttgttcccattggcaacgttgcacggtaggtgctcaacggaatgtttattcactgcaaaattatgcattgcagtggagcaaagaacacaatccaaaatatgaactgacatcaacaaggttgttgtcgtccaatctatagtcttttcacattgatcatctaaaaacctcaacaatcaattcacagcgttagaatgctgaaccatccaccacataggtctcacgtttatttttaatcttcctattgaatgagctaccacgtggacactatataccttgtttcgcggttgaatgatatgaatcgattctacctatatttaagggagtcaaattagacttttaccgacccaagtgcaggggtcacggcgcatggggcttccttgttgccacggcacaacgcccatggacatctcggcgaccaggccaccacctgctagcctgtgctgctgaccatgcgctccacctatagatggccaaatgggcagctcgggctgaggtcagtcgggctaggccatgcccacccacgggctgcactaatatctcaagcacggcccaataatactcaggctgtgttgggccagtccgaagacacgagagcccatcgtgcttctccatggaataagtctatttgtcatccctcatctctttgaaccttgtcttatttgactgtaataagtctattgtgtgtccctcttctctttggttgtgccttatatagctaattaaagtctttggatccctcaactatctttcttcctgctcattggaccgtgtcgtgccgggccagcccaccataccaaggcatggcccaactatcagatcgggccggcaccagtcgtgctatgtcatgcttggaccggcatcagtcgtgctgtgtcatgcttggacccggccgaatagccgtgccatgggccggccgtcgtgcctccggccttatagccatctttagctccttcacgctcacgcgttcgcgggcacgcgggatttctcgtcacttcctcctcgacaccggaagccccgcgcgcgacgcgacgcgcaaagccaaactacgcaacgcacgcaaaaaagggggcctgcctttgtaccagcggccagtgcgctgccgactcgtcgacacttgcacgctttatcaaaggcaaagaggcctctcccctgctcctcacgccccctacatctttcagcttcttttgagcctgagcttatttcgaccaaaccaactctgattttggaaagagagggaaaaaaaaaacgagtaccgaagtgatttcaaggcgagatttatgaccttgctgatacatacattcgtgcatataccgtatatattaactactatacgtccatgatgttggtccatgcattgtacaaaggatgagtcttctctgcaatactaatatttagcgtaggttagtttatatgtcaaccactcatagttaaagggcaatactgcgtttctgtcaagtacgtatggagcaatgccgtcatctcacgaaacttcagttcatttcgttcccattgttcactccttagcagaggtgtaaacaaatacacttttccatcatcttaaaaaaattaatcactcatgacgacgttctaatgatgatttgaacgtacagtagtactaccaaagagagggagcactaagatggatcatgatggccgccttgtcgttctcataaaagctggaattattcagctcctcaaccgccttactcaccaaagtattatatgccatggcagtacaacaaggtcgtagtaattaatttacccatcaagaaatcaacaatgatgatatacatgagtacattggcaccactcaccagtcaccaaccatgcattgtatatatataattatatatatgagataagaccaattaacaactgcttggacatgatgaatcatatatattaatatatatataagtttcataaacaaattatctaacaagtagacaccacactttaattaactccttgattatttttttgagtaatttttccttagtggctagttgcaggtagcagctggaatcttcacctcacacttcagcacagtggctccctttcagcgtaggtcatttcggcatggcttcctctttgttttggcccataatgagacgacaaaagagaccctaaaagataaaagagatgtgtaggagagataccaaagcaatgcccaagaaaaagccacaccgaccgatccaatctgagctaagtggtgaccatcctgctcacccttagcttttgcctgcagatgattcaggtaaaaaaaaaaaaaaaggtatatacatcaatgaatataccatgaacaatggctatatatgatgaactgaatcaagattcaacaaattctgaacccaaaattcttaccaccgacaccgccggctcttctgacgaaggagaggaagacgatgacgagggcgacagccgcgacgaggccgatgatgattgcaagtgttttcccagattcatctgatgaacaattggaacagatcacccacagaagaacagtcaaaagccgaactaaatctactccttgtatgtgatgtgagtgagtgagtgtatatacagagtgtagtagctttgtgcaaagcagactagttaaaggtttaaagctacacgaaaagggcagaaaaaaggctgagcggtacactacccacaatgggataccagagatatcctacccctgttttcaaattccaatgatacaaagctggatcattttgaatccactttgtgatattcacagcaaccttattgacaccaagaaagcgaatccacatcaaagttcttgctaaaagttcagagcaaaagtgaagggaagaaaagttcttttgggggttcttttgtttgctatacacctttgtggcttgcaccaaattaaccacaatttgcttctagctaggctgtactatctgtcatcacattggcacaccatatacaaaaactaatatactatgcccatgcaaaatatacagttatacacaacacaggttagatttgaattgtaatgtctgactagtacacattcagatttctgtattattgcagtgtgtgtaattgaagaaggccaagcagatcagaacgttctatctggtggatcaatcattgacactctctaagagagaaatgtgggggctactcatgcagtgtcatgcctaatttcagatgtacatttgcacaacactacatggaaacccctgatttcaggaagctctgcttactttcttgtgttggtcaagaactggatcactcacatccaactgtgatgtcgatccctaatcatgtagcacacaatgtgtaaatttctgcacctctgactacaaggtctatctctaccaacatcagaatttcttcacttgaactagcagctaacttcagatagttcagctaacctgaacagaagagactgggtgtaccgtgcttaacattaactactgcaagtctaggaaggctaaaaattattagtgtcatgcaatgatgttcgtgcactcatcatggcagagacgtaggaagtacccttgggaatatataaagtctaatttcagtaaatgactaatgttaatgattcaatagtacgtgtagtttaatgttgcactgatgatcccagctatggttgcaggatccaacaaatattcagaattccgtaaaaagtagtgacccagatgtgcaggctctcgcatcaacgccatttctttaacgcccgtttcgatgcaatgtaatgtactctacggttatcaagataacggtgagcccagtaagatccacaatgtacaatcatcaacagctagattatacaactggatcggccaatgtgcaaaggaaagcaacctaaacacttcagttggaaactgggaaatccccaataactaatacttataccttaaaatccatatatcactcaagaagaaaatcaagaatgtgtcatgtgtatcactatacgaactgcatatcatttggctttatgtattttttattaaaaaataaagatcaagatatttttaatttgtcccgcaaacaattaaaattgttttatccccaagtgtctcctttggagttttcacaataattagtctaattatcgcggttcgaaagatttctcatgttttactacttgtaaaaaaaaattagtgatgtgatggtaaagtcgtgggtgcataacaaatcctgttgtccacagatttttatacatacgcagttgcattttcaatagaaatttagttagaccaagattcacctcttgccactagtctccatctctttgagcgtgtgttaacgggagcgatttagtaggtgttgagtgtggcatgcttgtgtgcaaatagccattttccatgaattaaaaaaaaacagcagcatccaaattttttactactagttactgtagggaaaaggccatgaaaaatggaacggccagaagaatggaaaaaaatggttttattgtttgccttatgcttatatttataagtcaaaatttaaatttttgaacttaagtttttttatttttttcatcgtaatttattctacaacatttgattttaattaagtcactgagaacacatatataaaaattttatttacaaatgcatttttatttgccaaatattagtaataagccattaggataagcatacgaataagggaaataatgggctgtttagatgcttaccgtggtcactgtacgtgtgcggcacaaatccatatgcgtatccattgcctccgcccacagcgccgccgccgccactgatgccattcccgccgccgccaatgccgccgccgccgccgctgatgccgcctccgttgttgtccccggttccggcattggaccagaagcgcgcgtagcacttgccgaggtacacctcgccggcagaggcgtacccgcagccggccttgagctgcgacgacgcggcggagacgcagtcggtgcaggccttggcgccgaggtcgcccacgcactgcgacatggcctgcacgtacccggccgcgccggcgcggtacgagccgtcgccggcgggcgccgcggcggccacgagcgcgccgagcgccgcgtcgcgcatggcgacgacgcccgtgtcgctgccgccctcgccgccgcacttcttgaacagcaccgtggtgtcctgcctcccgaggaacgagtcgttcccgtagcggacgaagcacgcgcgcagctgcaccccggcgccggccgcggagttgcagagcgacgcgagcttggtggcggccgacctgacgcagccgccgcagatcgcggcggggaggtcggagcggcactggtagacgccgacgaggccggtgccggaggcggccgacggcgaggtgtagttggcgtaggcggtgtagcccgcgctgttggtgagcgccgagagcgcggtgtcgacgtccgccgcgtactgcgtcccggcgtcgtagcgcgcctgcgagcacccggcgtacacgaacgccgtgtagtcgtcggcgccccgcgcgcgcgtggcgcaggcgcacagcacgagcagcgccgccgcgagacgcttcgacatggctgggcttttcttggctccggcgagatccgcggcggtggttggcgttggaagccgagacgaggcgaggcgacgccggtggaggaggcaagagggcagtggagtttgtggtcactgtggtttgcttagttcgaagtgatgatctgatggttttttaagggtttttataactggaccactgcagcagggcaacacaagtccgtgtcaaaggtgagttttttttttctccactgcaaaagtagggtgcatggctgtattcatgtcaagaaagcacttttgtagtatcacaagtatggtaaaaatgcaaaaacttttgccaaataatcaaagcgcatatatataattttttttccgaggaacatatatgtttttcatgtattgaataccgtcgagacttcattgtaaatattcaattactgtctaagatatactactactcacaaaatcagaaatgtatacccctaagctcatttaaaccgttcaaaggaggtcccatagtagtatttttgcttaattttgctgacgtggcgtcttagtcagaaaaaaaattaaaaaaattacgtggggcctatatgtcagttgcaatttttttcttctcttttctctcttctctctttgccggcggcgggcggcaatgggcgagcggcttcaccgtgacgagcgcatggccggaggcaggaggagcggcggtggacgggcgtggcggcaagcggcggctccgggcacagctgcagagcgttggcggcagcaggcggcgggcgagaacgaccgcagaggactagcgacagtgggcggcggtgcgcggccagagtcggcggagcggcggcgggcgagcgggggacgcggcgtcagcgcgtggccagagtaggcggagcggcgactgcggcaacggcaagcgatcggcgagcggcagctccaggcgcgaatggagcagaggggcgggggacgcggggggcacggcgggcgagtggcggcaaggcgccgcctttttccccctctccggccggcctcatctcctcccggtccgcccggcctcctctcccgtctccagcggtcgtgggaagaagggcggtcgcccgcaggctacgtgggcaggggcgtgccgacggtgacgagcaggcagcggccactgtcgcacaaagatgatgaggaagtacaaccgtcgccgtgaagccgttccggctgcgcgccgcttgcctccgccgctgacgctctgcagtcgtgcccgcccgctaacgccgccgctccgcttgcctccgtccacgtgccgctactgctccccctctaaaaccgaaacagaagaagataaaaaggaaaagagaagaagattgctgagtaggatggttgatcccacactttttctcacttacatgtgggtcccacgtatttatctttttattttttgctgactaggatgctacgtcagcaaaacctggaaaaaatactgctataggacctcctttgtacgatttaagtgagtttagggtacacatttctgattttgtggttaagggactaaaaaaattctcgctgttaagttaagggaccttcggtgaacttattcgaaaaatatatagcgtgtgtacagtacggttgcaaggatcgcccttggcgtatgggccggataatagctgccgggacgtggccgtctagaggaaaaagtacaccgaaggtccctcaacttgtcatcgagttacaaaatcgtccccaaaccgcaaaaccggatgcaacacatcccctaacttacaaaatcagtgcaaactagatccctcggcggttttgactccggttttgaccgacgtggcagctgactcagcgtgggacccacatgggtcccacgtgtcagcctctacttcccctcccatctccacctctcttcctctctctcctcccacgaaagcagctgggtacggttcggctggcgcggcggatggctggtgcggaaaaactgggcggcgccagcgggggaggagctgggcggcgccggcgacaggtgacgcctgacgcggggactcgggagaaggggcgacacgggagaacgggccacgcggcggcgatggactcggcgggtgccccgaccgcggagctgttcgccgccttcgcaggagaaccgcggagcaggcgagcgaggcgggcggcgacctcgctttcgttcgtgtgcggcgtcggcgtcgtcttcatcctctgcagcgagctcccggcgagttggtgaaaactgcaaaaccaggcaggggctagcaggcagtctcggtcgcgtgtgcgtcgggcggcgttatcgtcggcgaaggaggcggacgaggggctgagggccgggttgctacgggcggttcacggtcgtgggcggcggcatgtcggaggcgtcgggcgccgcgcgcggggtgtgtgggggagtgcggcgtgcggccgtcgtcgtcgccgcgggctggaagctaaccggcggagagtcgccgctgccggtggcatctcctccctcatcggcagccgcccgcgtccgccgtgcccatatactctttgccatccgtcttgtcacgccgttcctcccaccccgcatgcgcgcacgacgtgcccaccgtcagaggagagggacacgtttggtgggtggaagcggacagcgacagcgacgatgacaacacgggtccggcgagcggcgagcggcggtgcacctcgatccagacggcatggaggccacctataggctacagcgcacggtcagcggcggcagaggcctgccgaggcagcgcgacaagcgttgtgggggcgaaagtcggtggcagctgcacgccgtccttgctgccccacagcgcacgcttatcttctgtgtattcaactcttcatctccacaagacttcagtgatgaaaagacacacgatgcaccgccgcctactgctagcccgatgtccttggtgaccggtgctccttgtctctgtcttgatgcagcaacgtgcctcgtcgtctccctctcccatctcccatcaatagattcatccccaaatttgcgattggttgcatatggacgacgatggtggcagcccaggccgctcgaccgccacggcgccacgccgctgtcccgggccgctcaacgttgcgccaccacgtggaccgctcgacctccgcggcggtgggcgcgaaggtagaagcgggcgccaccgcggtggtgggtgcggaggcacggctgctgctctggaccgccgccggcatcggtctgttgttcggcgaagtgagagagagggacagaggaggaagggagagaatacggggaagagaggaggctgaggtggccacgctgacatgtggggcctcacgtgggtcccacgctgagtcagctgccacgtcggtcaaaaccggagtcaaaaccgccgagggatctagtttgcactgattttataagttagaggatgtgttgtatccggttttgtgattgggggacgattttgtaactcgatgacaagttaagggaccttcagcgtactttttccccgtctagagcatcaactactggggttgcctcttgcccacgccacgggcctgaggccgtcacgcagcctcggtgctggagcggttgatgggctttctgcccccaccggttcggaattttttttatttataattttttttattaaaagttttacaaaaataattttccattttgaaaattgacggaaatagtcgcctaccgccctctgggagggcgatt

SEQ ID NO: 73167 - DNA, 10122 bp, Oryza sativa
aacagttagataggctaccccaagtattatactggtgtgattatggtgaataagagcaataccggcttcggccaataggatgtagggttattatctgacaattcaggggcccgaacctgtataaaaatccttgtctctgtctcttttacctcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagactgtaccgagtcaaactgtattgctcattccctgccaatggcaatataataaagtttcggttgtcaagaaaaagatgctaaactggaatatgaaaaaataaactactgtatatatatacaacgttacttctttgctgtcattatgtaacagacagttgtattttggctgcagcaacggcattagttggtttgcagaaccaaatggaagttacccattagctaacctgccctaggtatgaacaataaacactacaaaaactctctaggattcttttgatttaacggcagagtgcaggacaccactcagaggccaaccacaaactcttacaaaagtccgaagtagaggataattaagtctatgaatagtttccaattctctgttcactgtatgctcaatattgtttttattgcctgatcaattcttctgaagcggagttccacaaagattgatatttccgtcaaacatcgatgttttgtgtgcgtttcagttatgctagccttcaatcagtaaaccaaaaaaaaaaaaggacttgattcaatgacttactcaccagctataaatttctggatttgttgattattcccatcaaatttactaacgcaaactttactattaagaagtatgcatctggatgagaaacaatgtaaatatatgtactaatacgaaggattaggattcattgtaagcctgatctacaaaagagatatttaggtgcatggcttaaaagttcctcaaaattatatgatggtataatttgaaaaggtttcagagcatgcaaatcttcaggaccttaaatttataattagaatttttttatgtttatttaattcataaactaggaaggtggcccgcgcacatgcgcgggcactttactaaattagtattggttaaatttgtattatgaatccttattatgtggaagtgactattttaaaaggtaatagtctgaattacacccttaaactataatgaaagtgcggatgcgaattgttccggttatatctaaactcgtctatcaccatcattcgctaacatatgagttaatatattttttgttttgttttttcacctatgcatgttcatgggtaatatacgatggaataatctataatgttaataattagcatatcattatatagatgggaatgatataattaaaaagatataatgtggttacatgcgacattttcgatgctatatatctatgtttttcctggcaaatattaagtacatatttttttcctctttttttgacaaatattttttctctcagtgtaggtgtgcgtatgcctatttttatgatgggtgtccgcatgtttatatatgcgctcgagattgcctttaacattaatagtaaaaaaaatgctttcaagaaaattggcgagatggcgtgtagcggtgctgtgcagcgtggcttcttcaacagccttgccaggagtggtcgctactcatatacacaatttgtggaaaatctcagagctgcaaagaaagaaagagaaaactacttgatggggctgatcgtatacacactttctttttttcctttataacatctgttgtgtacgtacatagtgagggattacttgaatagatataatataatgattgaaaataatatatccactggtttatgtgtaaataaacagttatattttgcttttcttaatatattttttcttatatgatcactaatttattagagcgtcatgcggcatcttggaagtgcaggaatgcttttagtcatagtcgtaatggattacttgaacatatctaatctaatggttaaaaataatttatccaccagtttaagtgtaaatcaatggctagatgttttactttttcttataacttttgttagatttaccctaatttattagagcgtcacgtggcatcctaggaatgtatgtaggtgtgtgggaacactattacccaataccaatatatttgtagtcaactattatttgttgtggcttggtggtatcaatacttacatatcatttgttgatggtttctcacttagtattgtccattatcagtacttgataacacactgcatattagatgtcatctaattattaggtgcattaagcacggatgcctcataagtaattaatatgacttgataattggtggatagtgatttgtatatgaaacttatacacataggaattagtagggatatatgattgatatatttggttctattcctaattgataaaatatattatatactatatattttatagtaaatttaaggttgagttctaaaatcttattggattggctagtccctttatggtgagatgtttcctggaacgatgcatgttttcaaatactttctatgcaaagttttttaaaaagatcaaataaatccatattcaagtatgtaatatttaatacttaattaatcttaagctgacgacattcttttttttcgcatgtcttagataagctcatctaatgaggtagaccgaatgaagcctaagagataaaaaatacatccacatggtgtcaaaaaatatatgatcgttaattttccaaaaatatatgaataaaggaacatataatatatgaaaatatattcatgataatttaataatgtcatttgggtatattatacagtagggagtgagtaaatttttagaacgctgctcataatttaaattctttttattttttgaaaatataagtccaatttaactatgttcttaagagatatacaataatataatctacaattttaatttattaatatttttaatggatgttttgatgagatgcgctatttagaataaaacttgaaatagcatatatttttacaactttaatttaacatggactttttagtttttcatctaacctaagaatataagaagaagaaaaaagaaaaagacttacacgggatacgcgtacgtatacaggtccatggggacaccgttgggtaacgtgggaatttttttttatagattgaattgggttttttttaacaaagatctaatggtttaaaatattgggtccaccagattaaatgaaaaatcgatggccagatgttttgcttttttcttagaatttctaggatttattaaaacgccacgtggcaatctaggagcgtttataggaacgccacatggcgatctaggagcgtttgtaggaagtttaatggacttttagtatataatagaagatagatagatagatagaagatagatagatagatagatagaagatagatagatagatgtcaattcaggtaaagaccaagatgcaaaaccttgttgtcggatggtatcagttttaattttgctatatatatatatttttaatttcttcctttctgtgttgctagaaaaatctcaatttctatatcctctatcaatatgatttgcaatgataaacctttagtttttccaattggccatctgtgcattgcaacatcactcatattatcgattatatgagtatattacaatcaccaaaaaaaaggaaatttaatatgcacattgtcttcccttttctcacacactcatattatctaattcatgaactgtgacatgctaaaatacaaattttccttattatgacctgaaatgaaatcaattatcaatattgataatggaaagtcaagctgagaaaaataaaggaaatgtgaagtaaagtgcaaaagttctttcctagcttgtagggaattaattaaacatgcgaagtaagaaactagaatactgtgagctgatcgctggattttcttttcatccgtaatcaagcttaatcagcagtgagatgttaaaatgtgtgcatattttggtgcttgatttattagctacaaaagttgtacacgtagagcacacttccattagtacaataagaaggggtaccttgcctaatgtccatgcaagcaatttatcgagcatctgatggtcacgagggcagtcgggatgggggagagaggagtgcgtgatgccgatgagaggtaggaagaggtgatcgcgtcagctttaagccttttaagccttttaaggccctgtttctttcttttagcttggaattattataatccagattattaagagtaagctgaaagaaacagacaacttattgaagtagcttattataatctggagcccagcttattataatctgataagctcatttaggtgagctttttctagattattgggtgaaaaattacccaccatgctaccccactccctctttagacttgcaaacccaataatctaagctctaataatctagaaaagaaacaactaaccgcttattctactactgattataacaatctagcttatagtaatctgactcaataatctaggttataataatcctaagctgaaagaaacagggccctaagtcagtgctcgtcgatttgggctttcatacctggatggaggaggacgaagatgggattctccactccaatcgccccggcagtgaatcagggaagatgacattggtggcgaaaggggcgtgggcttgttggtacgaagaggaggcggcaccacatggcgcaggttatgctgcccgtgtgtatagtgagaggaaggagacgtcttctcctcatcatccgtgtctcctttcctcaacaaggcagagtcggtgtgctcgatgagacagctgacacatttggcgactcccccaacaccatccatcacgccggtgaggacgaagcgatggcggtggggagggtttaggaagcggttgccgtggggaatggggaggaggcggcggtggatgggggtggtctactgggacttgggatgtgggaggacatgtttgcaaaacaagtttctggaaggaccgaaaagagctttcaccaattgtaggatccaaccgctcacaatgcttggaggaaaaattggacggcctatgttttcagcatgacgtggctattgtagtttgaatcatgtccttaaacccgcaatactaagatataacgtctcttaactcatagaaccgacttacgtgaatgatttgtcttgcttcttgtcccacgtaacattgacgtgccactgaaaactaaattaaacaaaagaagaaagaaatgaaaacaaaacatataggttccatatgtcagtagttcttaccttatctcgtctcctttctttctcctcccctacttcttatctcctctccctccccaaacgggtccctgcgtagtatgccggtgttgccagcattcaccaagagcttggccggaccgctgcccctcgccatgtgcgcaaagccggcgtgtgcggttcaccaatgtcatctgcccggggaagttgacatacgtccatggcatgccgaatggccactacagaccggtgagggagacgacggagttatagcgacgcggaggagatcggaggaggcgaggtgaggcgaggacaacgaccccggtgtaccgttggtcaccggcgatgatcgatcatcagtggcagcggcgagttgaggcgacggctgcgctccgggaaagagggagcagagattgcgcgtgaggggatggatggacaggcgatccgtacgggacggggtttgtaggggagagagtatgggggaggtgggagtaacgtgaggcgttggatttgattggggcgatcctgaccgatcaatgtggaatgaggatgtaacataccattggtgaattatagggtagatagaagaagactagtaatatacccgtgctaacgctacgatccttaaatatttttttaataaatgactaaaattttgtgttaataaaagtaatcagtttaatggtagctttaattcaaattatgccatatatttaaggcaaattataaagtaggtacttcactgcacctatattttcaataattatcaattaaacatataccgtgccagtgtataagcagccgaataacacgtgacttagcgtgaagactggtatctctactattataaaaattgaagatgtttttgacataatttttatccgagattgattcccatctgcttgcgtcatcgtggcgtcctacgatctccgcattttctctccgctgcggtatgctacattattgttacggaaacgcgtgtgttcacaacaattgtttccaaagcatgtacatccgtgagaattgattctttacttaatccgtttcgtttgtcgtgtccgaccatgcttcgttggaagctttgatgctaaccagaaacatgcgatagttgtgctcatcgtgaacttggatttgctgcttgagtgtatagatgagatatcagtattgtgctaatgaatacgtattaaagattttgcgctttgttacatgtatatgtaaatatatgtttgcattcgatcaccaaggggatcaaagtaggattaatctcataactaatactttaattaaaacataatattaataatgattagttatatcaaattataaaaattaatttaggaatatcttcgctatctacccatagaaaaatctttgtgttttcttttatcatccatcatcctgcggatcataaggattttttttttatcttggggtggattttgatatatgagaatctgaacaaattgtaaatgaggaaagactgattaaaaaattaatttgaaaggtaaaagttgaattcactttcaaatttctgaattgagtttgaggaattttcggaaaatgtcaaagtacagatctaatgtttattgaaattttagtttgtcccattgcaatacacgggcactttttctagtaagaagaaaaaactgaaaagacacgattgtcgttacatccttttcttttattaactaaaatcactgtgtacattggcttttgctgtactgattaaagagacttcaacccatttgagataaacaacagggcacccaaggtgaaaataacggaataaccgaatagccgatttacgaatctctcggtttcaagagagagaatcaggaaggatacctaatcacacatgtcaggagtttaaaggacagaaaattgttctcataaatgccaggaagcatcaacagaaactgcccagggaagagaagaatctacacataaaaatgtacttgctctgtaaaaaattctattatcctgttaatatcgtgtttgtctattatgcaccaaaattagccaaatgtatcacctatgttcccaatgtatcagtaatacaagaaaaaaatgattaataggactgaaaggcaaacctctgaatcgtgatccatataatctcttgtacacctctttaatcatggaactgaaaaaacacattattcgtttgaaataccaccaaaatacacacaatttctcaccaatagcaatttactttgggaggtgtttggttgtcacgctcagaaattcgctaacccgaattccaagcagaatgtatattgaatctctgtccaggaccagccagagtacacagatgataatttgatatagttccacaacttacaaaaatataaaataaactcagaaaatcagcggaaaaactaaagaccatctaaacttaatctttttagcaaagcgtagcttcctccaaatccacaggcaaaacctcgatgtccggcacaagcctaatcttcatagaactcaccattcaaaacattctctgcctcttgggaggaggggtgagaaataaagcaagactgagtaccaaccaccgtactcaacaagtcatactgaggcagagatattcaaaggagtggctcataggatatttgtagtaaaagcagcatttataaatcataagatgaaagcagtaaaacattatatatttaattgagcaatattaaacatcactgtacaacgctaaatccacgttgaaacaggcacaaccaaatcacctgaactatacccgttcattaagtcaaattattaataaagtgagactaatcaagacgagctggtcgaataattttactttgatcagaggtgtacaattttactcacaagacacagcctcaacatcgtgtctaccatgagtcgcgataccgaagtacccgaatagaggtcgtgacagaacccatcatataactctccctaatgaatacacccaccttaggtttcaccccctctcctatacaggcagcgggcagtcccctctcgtgcctaggtaaattcggaagcagcagagaccaaaaatccaagtctgtcctgcaccatcgccttacccttgccatgatatgttgactagttcgagttatactctaaactcagcctggaccacacgctggcttgtgattagtatgggtatatcttctagggattcccaagaaccggtccttaattgttatgggcacaacttgcaaaaccatgcacccacaacccactattattgcatattttagtttatttaaatatacaccaaggtggcatataatcattaaacaattaaggactaaattaacatgaatctcattctgagctaattgatctaagaatggctaaacattcctaaaccaatcatttagtcaaattataacccaagttatcaaaggtacagggtaatcaaaaggctgagtacggtttatccaatcccacatgatattcgaaaacaatgcaatttaatagaaaagtagggattttgcaaaataggctcaatatgatcaatgatatatgtgtgacttggcttactcttcaactgatggaacctcggcgaccacttcgaaataaacgggggcttcgaaactgcctaattctaatcgacaaacaaagcacataataaatataagctataaacctactgaaacaaataaagaaaccaattttattggattcttgacattttaacgaatttactgcaatttgaatggattaaaacggagcttggattatttagatatgaattttacaatatgagctacgtaattactattaacgggaaaacattagtcatttatcatagattaatgcccatagataaataggaacaaaggaattagatcattggtaagcaagcctcacgagttagtgactcaacgagccaactcatcgtgtcacgggaccatccaaacctaaagaacgactctgacgactgaacgaactaaagcttcgacaacacacttaccaagctagtaacaaaggctaaacagcaactaaaactctattttaacgagaccacagtcgctaaacgacatggcaaacaactaggccggtggcggcggctcggcacatggcagcggcagctacgagacgcggcaacggcggcgcaagacggcggcggcgcggcaacagaagacggtggcggcggcacaaccgacggcggcagcggcaactgggcgtcgacggcggcacagagcggctaggtgttgatgcgaaaaataccaaatttggtcgttaacactagggttaggggttaggaaactaaaacgaccactaaacaaagacaggacaggggcatctcaccggaaaatgacgacggcggcgaggaaaacgatggaggcgacggcggcaacctccgggatgacgacgatgacgactggattaaacctagaaccgagtagattagatgattgaaaaaatatgtatggttaaaatcataccaaaagaattgaagaggagctcaccggcgacgcgagggcgacgacagcggcgattgcaaccggcggcgacgacgataggagcggcggcggctagggcggtggcggcgcaaggtggtggttaaggttttggctaggactccaataaatttatgtgggaaaaaagaggggatatgatggcttatatagga

SEQ ID NO: 73168 - DNA, 15742 bp, Oryza sativa
ccccccccccccccccccgagggggtcaggccacgtgggtgaccgcggctacccaagcctctagtcacgatacccccggccccatgtcaccgacacaccgcgtatggtttaatgacttacaacatgggatggagggagtcgtggaatctaatatttaaaatttagctctggttctgtaacgtacctgaattctaggattaaggaatttccatcaaaactagttgaaagggaagttcttcaattttataaaccaaaaatttctattttaaacctaggtggagttgatccaactcttgcaagaataaaatttgagaacaaattaaagactttttcacctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggctaatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacattttcatgcatttaggaaagggaaacacatataagacataagtcctgcgaattatctaaaataattcatgcaagataaaatcatgggaaaattcatgtaggctctactcaacacatacaactcactgtaattttggtataatttaataactaaatttggtacctcaaataaattagtcaaactaataaaaactagattaactgtagttcttaatcggctaaaaccatactttgtctaaaagtgcatttcattgcataaaagtgtataagtaaaataatttattcaaatactaggtaatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaatctaggtatcttcatctaccttgagaaaaatccacactaaattattctacccacaaattaaataattgaaatactaaagtgggagagagaaataatccttaaaatcattcaaaccttttgttcacccacgtttctgcccaaccctctcaccctagcttagtttgccacgacctggacccacttggcagccactctggctcgtcctcaccctgtgcaaatcttccagccggaccaaagacagccgagagagagagattggcgccgactgtgtacgacgcgtggcctcgacgtggcagcgccgaaccgaggcttcacctccacccagctgcgtcgccattcttcacccaccatcccagtgccgatccaaccgagggaggaagctccagctctccctctccacctctctttcgtcgccggccgccaagaagagggacatcgccaaccgttgtcgagccctcttcatctctaactcatactcgttccattctcatctcaccatgacgaacaactttggttttgatcccattccatttcatcttctacagcagcgggaacgcggccatgtcatggtcgctctagagcgcgctctgtgcaccgccgcagcgacatcatcgccgttcccgcttatctggaccaagccgggccaagctgtcgcgccagcgtcttcgcctcgacctcctctccatttcccctcaagaatctcgaaggatggtgctacgagtgtggagatcgtccaccatcttctccacctccagtcaccgtcgccgttgccgaatccaccccctccggtgagtaccaacctaattccatgcatcagtagcatctatggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtctgcgtgttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactttagtgttatggaataaaaacttgcactcacagtacaaatttagcctctaaaatttatccaagttaaatcacacataaagcatgcacaaatttataaaatgcatacaaaattcatttcaactcatcttggagcaaactcagtttctacagatccaccaacttatgttctactataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctaatagagtgaattatagcaccctcttacagaccatggctctgaaccttaatttggtagaataggtactaaacacatagtaatggttaaacaatacatatgaaaaagtatatatatgcttggtagctccaaataaatccaaataaaacttgttgaaccagtgaaggcatagatccatccccttccaccaaaacttagtatccttaacttatataataatctccagattgatatgttaagtttctaacatagaacatcccctagcttataaaatgtgaagtaaagtaatttgaacactaaaattttataaactaagattagattagttaactaaaatactcattttatacaacactagcaagttagagcaagttctggacctaaatctcgaaagccatgtacacatagggaatatatgcctagaacacgttaaaacttgtaaaatacataaataattcatattaactctaaaaattatgaaaccaaatgtgttagtcttagaaaacaaatatcttcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaatcggtgaagaagtgatttaggtgctgacattttccagttgcaaggcaagtcccacctccctctctttgatcactttgaacctatcttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcatagccatgcttagaatggtcttccttgtcattatgggctcatttcaaacatgaaaattgatttttaattaatctggacagaactttaatacttgtgattttgataaataaaatggtggaaagcatagattttaggtttgggcctcaagtggtgtacatatggtgattagttgtgtaccgatagggggagagtgcgcccaaaccgacctaaggacttcactcaatgtcagttcatttcgtatacagtacaaccacatgtgctagtatgggatagtccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcgtgggcccgccacttaacggttctaggtcatatttccagtatgactaggatggaggaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctacagagttaaaactaatcgattagccgtgctcgcggtcatgagcggcgtgtggatatgtattgagtatagacttgtgtttattctcctaaatgctgaaatttaccttcaaattctgatgagatttgaaaatgatctccttgctgccatggatggcaatgaggtgaatatttatacatgattaatgcctactttgatgcccatatgctaagtactagcttgctgaaattttatttgaaagcaaatccgttttgaatgtgttttatgcaaataaaacttgctttatgctaaaaagaaccatactatgccttccttgattatataccttgcaagtagggtgttaggcttgtcttggtgcttgccagtacattatttctaataatgtactgactcttgctgttgaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaggaatatttgagatgttgtagaactttagccatttttgtcaagtctcctgaatgtgtaacacatctggtcgccgccttcgagtggtttgacgggcacgtctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacaggttctttcactgccatcctcccaaaatgacagtgctcaaatgccactcccccaaaatttcattctcaaatgccactcggcccacatgtcagcctcttttctcattcaaacaaaagtgatgtgggcccgggtgatgtgtaaggctgacatgtgggctaatcaggtgacatttggaattaaatttttaaagagtggcattttgagcactactattttaagaggatggcaaaaagtaaattctatgtatagctcctggtcatagcagtgtttacagggtgagacggactgaaattgatggggatcatgaaaaacatatctcaattactggctgaaaatgtccatttggactgatttcttctacatgatcgtggagtggagatgctagtccgcccatctgctgtagtacgtgctatataatatcggttgagctatttcctatattttgttttcataacagagacgagagctagatggattccaaattattgtgaagtgtatttaaggaaggcggcaaaacaaagctggctacaagaaacaacccatcacaaacacaataaaaagggacaaggttcctttttattgttagaaaaatttatttccctagatcaacatgggttagaaaaatttgttctttcccttgaaaatcatcttggtcgatgtgccgctgagcaagaatcacttcagtcggagagtcgataaaggttgttgggctgcttaaattgaagcaaagctggtttgtgcatgctgttgaggctatattcagttgcactaatggagatggggctgtttggttggctcctaaaggttgccatgccaaaccttaggcatgcaacaattttttagtatagtgtttggttggctgttataattgtgtgatgcctcacattactagtcattggacctacacgtcatagactcaaattcttgccaaacttagccacatttatggctaacaaattgctagcctcactttgtgtggcatgacatatttgtggcaaacaaccccttaagtattgacatgcaaaacgagaagtcatttgcccttacgtatataagacagcctagagactaaggataggaccaagcaatagctggcattcaattcttctatacatctgcagctccaagaaaagaattaaaaaaaaaccgcacctttgcactaagagccagcctatagtacaatttgtaagggcgctaagccttttgtctaagatgaaagtagggctctttttctcacacaaccaggaataagaatataatccgaaagtcgctagattaggaaagcttatgatcgaagtctttcacagccagcttaacattctctgaagtgtgatgttgtcttcaatatctctaagactaggattaattgagacttattattttaaacttaaaaaataaatttatctaatatttaaaccgctcctctatctcctctctttcccatctttgagcaggccactaagcggcacctgaagcgacgggtggcgggaataagggaggccaagcaaccaaacccaccccccccccctcaccccaccccgaatcccacaacgtgaaacctccgtgaagccaagaagaatttcagtgccctaatccatggtcgtcgacgtgctcgtcgtggcagcgtaggcgggtgctacaaagccagctgatcgatcgtgaacgtgctgtggaacacatagcctgtgatggcccacgccatgacatgaaagctgtcgaggccaaccaggctgtcgtcggccatcgcggacacgtactgcagcgcctggcccgagcaagagccaaccaggctgtctacgccatcaactacctgcacatcgaccaagagcatccacatcagccatggtgtgattagtccaccgcagatgttgtaagaaaaaaaaattaaatacagtaatatcaacaaaaagggtaaattcgtacaaacatgggaatgaaagacataattaccctaaactcatgaaaccatgtgacaccagatcaagaataaactcaaaggtgaatcaccacaaaaggtcggttaatctcaatgcgaacatatttggatgaatggaatagagatggcagatcagacagacaaggggagaaaaagagatggttcttgctgcttgggaggcagtggcggacgcaggatttcagtgatgggggtacgatgttaaaagaaaatatcgctcaacataaatgatggaggcctatgtaaaaaagaactaacatggacatagttaaaagtaaagtgattttagtgtatagtaaattactaaaattaaacaaaattaagttataattgatcagaatttttttggaaataggatatgatgtctttgtcacgaacatgtagaaaaagttgtttcttaagaatgtaaccaagcaattatttaagtatttttttatgttcccgatatttcttaatttatttgtatagaataatcaattgcaatgtttgtgggaaaaaatttaaatagcccttgggcaagtcgatagagttttgaaggttcaacaaactaatattttcatcgattttgattatttgaacgctccacaaacaaaaatattcataaaatatcctatgaattttttgttggccagtagtcatctcagctagccatcgacaagtatgtatatatagcctacagagtaggaaggattgagattaactgaactggaatgccaatctaagtgcaaatataacccttttaacccaattacacatatgtaatacaccataatatgtagtgttctttttgcaaaaattttgggggtacagctgtacccccatgtccctatactgcgtccctatactgtagtttgagatgagcttgccaactatcagtgaggagcggttgagtggtagaatgagggtagagcggacaaaaggactgcgcgaggctgtgagttggaggcgaggcaagctgatgtcttcgttatgtggccttgggacgcccacctcaactgtgctgctccaaaagcctgtgcgtcgaggccaatggcggcaagaggcccagtggtcgacaaaattagactagctgcgggactagaagggccatcgcccgtgccactcgggagggagcagtcgaggcggctactcgaggtcggtgacgcccctgcccagcttctctcttgttgcccagtgacagatggggaagagaggggagagaagaaggatggcggttcattgacatgtgagcccctataatgccttgggagctcaggtagatcaatattcgatgtcaacatgaaggacctgagtgcttagcatatgagcatggggaagttgaggaacgtgttatgtcttgtgtacggttcaaggacacaattcaaattcgatgtcaacatgaaggacctagtgtgaacttattctctgaaataaaagatctacgtggtatgtgggctgggctaaatgattcaaggttcttgaaaggaatccagccatttgcgttgttatcactactagaaaaaaaagtttttccaggtggtcaaaacacattttcgcaggcggcaaaaccttccgcctgtatccaaatgacggtaaaaatccccagtttttgcaggcagacctcatttttgcaggcagccgttccaatcttcccaggagcctcaagtgctacactaaccctgccttcaaaaataccctcggcgccaaaaaaaaattcccgccagccccacccctccctagggtttcaaatcacaaatcacaaattctcacaaatctcatccaagaaataaaatccaatcacagacattgtatacttgcaacacaaaagcattagattcaaattcacaacaagttaacatcaatgaacttgtaaactaaaaaaaacacgtcgtcgtcgtcagcgaactcctctattgcatggggtggccgccaccacctccctccctccttcggtcagatctgggaggggagggccagtgacgcggctggcactattcgtcatcatcatgcggtagggccgtcgttgtctggtagtcttcgtcgtcgtggccgacgccctctgcccaagccgtcgccgacccatccgccttgcgccgccgccgacacccatcccctccatcggatctgggtggggaagggtcgaggggaggggcagtgacgcggccgactgtagtcgtcgtcgttgctcgtaggtgccatagctggccccttccgcccgggcctccaccggccccctctgcccgcgctaacgccacccgcccgtgcctctgccggccccctctggccagatctgggagggagggagggaggggccgcgccgcctgccgctggtagctgccgctgcctccggccggtggctggggagaagaggggaggggaggtgaggggaggatagggggaaggggagggaccgagggacgtgggagaggagtggtgagggagaagatgatagaaaaaaattgcccctacgtaggtggtatttatattccgagtctattttcacaggcggactagtccgcctgtaaaaataaagggtatttttgcaggcggacctgtaaaaatgaagagtatttttgcaggcggaccgcttaaggcgtccgcttgcgaaaatgaatttttgcaggcggacaacgagctttaccccggtttacatttttgtaggcggctatgtggttccgagggccatgtccgcggtccgcctacgaaaataaatacccaacatcggtgaaaatgctttttctagtgtattaattagaatctgaagcactatgtacagtattaacatgtgaaatcctataaacgtacctcaacatcaggtcctatggacttcgggaacatcgaccatgcctactctacgtaaggctctcagtagtgagtgtaactctcaaaatgagagtcgtattgatgagaatatgagtgtggttgagtgcttcatgaagacgctatgttggtgatattattgtctagtgctaccgacgccgaatggaagattttcacacctaaagcaggtttcacatactcgacatggtgtgtgtgtttacgggattttgcttttcctgtgtgctcaagcagtctctaggacaccatggaagacatcatggaaacagacgccatcaaaaccactctgagaacacaatatacagcactgaggagatcattgatacattgtaggagtgagacatgaatgtgttttcatgaagtacaatgcatggaaaaagagtcacaacattatatcaaaattaatcaatcatattaattgaacaattaccaaacattcacaacaaaatactaatacaaatacacacccaatattacacaaccacatatccgacaataattaatggttatgacttctccttacaatggaaaacaacatacatgtaagtaaaaaacagagagaaacacatatgcatgcttgactctgttgtacaattaattagtcgagctagcaagaaaacgccatgcattaagcgagctggtgttttattctagctgaatttgccatgcatgcagaatcgtacatctgcttgcaaaaaaaaaaagaaaagaaagaaagtaaaaaaagaaagaaattaatagctccatgcagacccttgtttgcatggtcaattaattagttgccaagtgaccacatgagataatgatggacaaccttagcatggcttgatgcagatacagtttcgcacgaaggtgctgcacctgccgtcgacgaacccctccgtccgacacacgtttgcgcaattatcttccaccatgcaaaacccctcgaatcggaggctcttcgtctcgcacggcctgactgatgattgcgctggcgccaacgcctctgccaacaactcacacataatattagtccttacggtcgcaaaaataatcggtttagacttttcggatcgaagtataaaacataaatgtaagaagatggttttttttttgcataaacctaaaaaatatagtagttacacgtgtaataatataatgaatgttcatgttccctttgctaccaactcaagcatagtattactcgttatagttggtttagacttttcggatcaaataataagacagaaatgtaaaaactggtttttttttcataaacttaaaaaagatagcagtttaacaagtgtaatataatgaaagtgcatgttataacaaacttagctaagtcattttaatatataaaaaaaacctatcgtcaaacaataaataatatatgatgatcaaggagaacacacataccagtggcaacaacaagaagtaggaggacggcgattgctgggaagaatttacgcattgtctccattacaattattatgttagtactaaccacacacttctcagaaaattaatatatattttcaaattattcagtcttttgtttgggagggaagggatggcaccctgcttatatatgcaaggggcagcggcatgcacgggattaactagaaccacatatgccctcgttggctaggagtacaaacaggaaaatgtccctgccatatatagccactggctaatattgcaggcactctactggccacaaaatgcttgcgcgcgtccttccagtcgcaccaactggttccaatttgattcatcccacgtttcccacctactcaatgcctcatctatctattacgagttcattctcaatcctgcaatccttcagatccactatcacgtgggacccacctgtgatcgcccaaagaaacctcatcgtgggcagaccacttcgcgcacgaaaaaacaacgaaaaaaaagaacgccaaaaaaaaggcgcatctaacctccgcccctcagccatccccacgccgctacttccgcccgcccgcgcgcccttccctccccacgccgcaccggcgaccctgaccttgacgcggccaaggtctccctcggcgccatctcccaggtcactctcgcgttgcagccgctatttaagctgtcggttgcgtttgtgaaccgcaacgactcggacatcgccgagatggtcgccatgtggggcggcctccacgagttcggcgacgtggcgtcgctgccgcggcggcgcatggtcgtgtaccgcgagcacggccgcgccgccgaccacgcgggcttcctcgacgccgtcgaccctttcctgaatctcttttttttttactgaatcacccacatacgaatcaatttagagatttacctccattgttgcatccattaactgatgagttaggagatttactaaatctgatttctgcctgttcagtagataaggctccaagagagacatatgctggctattactcggtgcggtgaattatacaatgttagtatcaagtattagtttaattagcgagattaacaaaccacgctaccagctcaacattgttcctcaatcattgtctgttgtcactgccttatcgacttggcaatgggaaacaatatatcaaaagtattttgagttgtacatattttcttaatcgttatagattatgaattaccaggacttacatatatattctagacctaggtcatatttacacaatacacgtaaataaacagattcttgtacttataatatgctcaatttaatttatattgatcataacgtgtactacacgtgcacgattgctagtttactatcaatagaagcagctattctagaaattaaccgttcactctcagcattttttggatcttaccaaaccgagcggcgccaggatgggctcctcgacgtcgacggcaaccgccggccagccggccaccgcgacctcctcagcgtcaacaccgtacaccagcaacgggaggactgctgcgagcctgcagatcagcaggcgtcaggcggcgtcgcgacaagcatcagccaccagcagataagctagcagagcaggctaccgagatactgtctggtgagtcactgagtatctgaaattgaatgttagtcttgctgcctatattggctatctctcttcattgactgcaaattattaatctgtaacctattgaatgagtaattgagaatatccaagactttagcctcatgttttatagttctgaattattcgtagatttgcaatggataagaaaacaaaatttttaaattatttaccttccatttgtcaccgattttgatatatttatttattgtatgaccaaaataaaagttttagatcttgatgagttattcaactttgttgttgataatttttcagttgaaatcatttagtatttgaaaatattgtttgaagttgtcatattttcaaattcaaattcaaactgttcaaaaaatgttatatagaaaaatgaccaaaataaaagttatagatgttgatgagttatacaactttgttgttgatgacttttccatttgatatcatttactacgcgtaaaattgatttgactcataaattgaattactatactgcaagttaattattttgctatagttcaacatacaaatataaacatttcatatgtaaaatggaaaaatgctcatcggtgacgggctttagttaatgcccaatagagattaagtcatgtcaaccggggattaatatatagtccgtcattgatgagtcatctatgacgggcctcaagttggtgtacgtcacggatgatggtcatctgtgacgggccccaacttaaggcccgtttgagatatggaatgttatctcaattgggtctaaagttggtgcccgtcacggatgatggtcatctgtgacgggccctaacttcaggcccgtttgagatatggaatattatctcaatcggacctaaactacggcccgtcactgataggtgtcatctgtgacgggcttaagttttactgtaacgaaatctatctactaatagaaggtgtaatttgtttactgtaacgaaatctatctactaatagaaggtgtaatttgtttactgtaacgaaatctatctactaataaaaggggagggagagttatgcaagtaattttgttactacaaacgtaatccatcgaataatatgagtgaatgggagtagttataatttatttacaacagcttatctagacaagtgaagcgcagtaaatgtaatattttactacatcttaatctgtctatctagagaacgggggatgagcctgggaccgtggggaaaaaggggtaataattttactgtgtccacgggagcggggacaacgggaaaaaaaaacattgagtaattcttttaaggattaatttgtgcagggagccagaaaaacagggaaataagtggaacagatagcaaaggggaacggaaaaaaggagcgtgggagccaaacagaaaactaaattcaggggtaacggaaaaacggaaaattcggggggagggggtggcgcagtaggggctaactgcggcgtgcggattacaattccgagcgcagggagtggattagcgctaccataattttatggtatttttctagaatttaattcactaatagtagtctaacttgtaaagttatatatgatttacttaattatggatcacactcttgtttaattccacgggtacaagtcttaagtagaccggtcgctatcatgttggacgctatactagcctaatatttgaaatttcgtgaattctaaagaaaacttatattggtttctatcacattctcccacattacatactacctccgttttttaatagatgacgccgttgactttttctcatatgtttgaccattcgtcttattcaaaaaatttacgtaattataatttattttgttatgagttgttttatcactcatagtactttaagtgtgatttatatcttatacatttgcataaaatttttgaataagacgaatggtcacacatgtg

SEQ ID NO: 73169 - DNA, 22828 bp, Oryza sativa
  unsure (1)..(22828): unsure at all n locations
ccggaaaccacgcgggcgcgcgcgcgagcaacggcgcgcggggccggcttttcgagcggggagctcgctcgagaggagggggcgctcggtgcggctctcgcacgcgcgagcagcgagcgggggggggggaaacgcgccggggtggggagggagcgagagagagagagagagagagggagacgcccgggagagagagggccggggaagagatgggccgagcggaattcggcccatcgaacccggggaggcaaactagacttttgcagagggattcgatttggaaggaattggattcggaaaagaactcgatgatagatcggggattgagatcttgagatggcacggacactagacaacaatcaaagaaacaaatttcgcaattagggtttttcggagataattttcccgctaggcgccacgacggaacgggcgctacataccaacccccctaacaagaatctcgaccccgagattcagcacctaagggaacagctccggaaactcggcgcggagaagatcttctcgttcccaggttgcctcatcttcagaatgattgctccattggactttgtagaacttgatggtcttccttcgagtctgatgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggccgttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctaacggttctgtgctgtcttcaaacgttctcgtatcagcttaacttgttcttctgctgacttgagtatgtcaggaccgaataccagtgcttcgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcacacgcacgtagcatgtcttctaggatttggtttaccctttcggtctgaccatcggtctacggatggtaggctgtactaaaattcagatcagttccgagggcttcatgcaactgcttccagaaccttgaggtgaactgagtgcctcggtctgacacaattttcttgggacagccaaatctacatgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcataccagctggcctctgatgctctgccttgactctttggcaaatgtcacacaaggctacatattctgcgacatctcgcttcattccagcccaccaaaagtatgccttgatatcttggtacatcttcgtacttcctggatgaatggagtaagcggactcatgagcttcctttaggatgagatctcttaactccttcttggccggtacacagatgcgtggaccgcaccaaactgtgccttgatcgtctatggagaaattggtgtctttcttctcctgtattctttttattaactcttttatcccttcgtcatctttctgagcctcccggatttgcgattctagggtaggctgtactgtcaagctggcagggactcctgactgtaccacggtcagccttaacttctccaattctctgcacaaatgctcttggtcaggccgtatttgagctacattgcaataggccttgcgacttagcgcatcagcgaccacgttggctttaccaggatgatagtggattccaagatcgtaatccttgattagttccaaccatcttctctgcctcatatttaactcggtctgtgtgaagatatatttaagacttttgtgatcggtgtatacttcacatctgttcccgattaaataatgcctccagatcttaagagcatgaaccacggctgccaattcgagatcatgggtgggataattgacttcatgaggcctgagctgcctggatgcataggccacaacctttcgttcttgcattaggacacatcctaagccttgtcttgatgcgtcacagaagatctcgaaatcttttcggatatctggcaaggtgagaactggtgcagtggtcaaccttttcttcatttcttgaaagctgtcttcacaggctgcagaccattgaaatttcttttccttctttaacagttcggtcataggtctggctagcttagagaatccttcaatgaatcttcgataatatcccgctaagccaaggaagctgcggatttctgacacgttcttgggcgggttccaagcaagtacagcttcaaccttgctgggatctacttcgacaccgttggaggaaatcacgtgtccaagaaatgctactcggtccaaccagaattcgcatttcgagaatttagcgaatagttgatgatctctgagcttttccattatcagcctcaggtgttcagtatgttcttcctcgttcttggagtatatcaggatgtcatcgatgaacaccacgacaaactggtccaggtattccaagaagatttggttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctcagagccatcctttttcttaaccagaagcactagggctccccaaggagatgagctaggtcgcacataacctttactctccaactcttcgatttgtcttttgacttctgctaactcattagctgccattcggtagggtctttttgcaattggagctgtgcctggtgccagttctatggcgaactcaatctctcggtctggtggcatactcgttaattcttctggaaatacgtcgggatattcacagactatgggcaccgactccaaggaggtgacttgtaaacaggttaggatagaccgacttgcggtaggggtgttaggggtaaagcggacttgctttcctccaggtccttgcaaagtgatggacttttcggcacaatctatctgtcctttgtgcttagccaaccaatccatccctaggatgatgtccaagctttgcgagtctaggattatcggtttggctagaaagtcaacttcctcaattctaaggttaacttccgggcatatttgagttgcccttatattcctcccaggggaatgtactatcattggtacacgcaaattttgggttttccaaccatttcttttcacaaaagcttgtgatatgaaagaatgggaagctcctgaatcaaatagaactattgcgggtacggagttgacagagaacatacccatcacaacgtctggagcatcctgagcggtttcagcttgaatgtgattcacacgtcctcgaccaaagtggttggaagcacgagaaccttatccacttgcctgagagctaggacgagactgagctgccgctggagtaggagttctggcggtgctgccattagcatgccctgagttggtgttggtaggattctgagggcactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgagggcgaggtgtcacatcctgatttttgtttcaggattcataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagagcatttcagtaattacccacatattaaattaatcattaaatggtctaattataattttgttaagtactttgagtgtccaagtattttcaagatttttcttggaattatttgagcattggaagtatttttaacaattcaaagatcatttccgtgattaatttagttggaaaagtatttaaaatccccttctccttttcgggccgaaataggaaaagttcagcttcactcctccgcccattctcccttcctttcggctggccttatccctcctccaaagtccatttgtggtccctccttcaatcgggcctagcataggaaaccacacagaaaagtctaattcgcgtccccgcgttactgttcttcttcaagctccagccgcccgtgctgagctctgtgctgccgcttcctccgttgaatccgccgcatcccgtgcttcgtttgcaaaattagttgaggggaaatattcctcttatcctcctctatcctttcccccaagaatcggagcaaatggttgagtatcttatccgaatcgaactcgtttttgagtttatctccaaaaccgagtttttgatttcccggatcgatttctagcgggaggagtccgatctcttcaatccaaggctataaataggaccccctagtcctcctctttcgtttgccccctttcccgtcctctcccgtgcaccgtagctcgccgtcgacgccgcatagtccgccgccgccgccggccgggttgcagccgcgccgagccgccgcctccgccgtcgctgccgcttgccgccatcgcctttagatgcgccaagccgtggggaagctcggccacccgtcccctttcgtcgccggccaccggagctccatctccggcgaggtccgagccgccgccgccgttcatctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgtcatgttggttcggccgccattgatgacgtcatcatgacatcatcggtttttctttttcccgtttttctaatagattaaatcttcggaaaatcataactaaataaccgtagatccgtttcaggtggttcaagttgctaaatttttctaaaatcaagatctacatgttaaaaatattcacatgtactgtttatgcttgtttttgtactgttttgttgatttttgttctttcgctttagtttccgacgttccggaggagagcgttctcgttgagcaaggttcggaagtgtttgcggaagctcaaggcaagtcacacagatcccaaataaccctttgagcatgttgaacccgtttaaagctattattttatttcaactatgcattattttcgaatgtcatcgggtggtgaacctttcccaattaattaatggccgaagatgatcttattttcctatgggttataatttgattagcgtgaaccttatatattggattggttcagctaaatgctatatgtaagtttgcttagccatgcttagaaacattagctaactaaagggattaattataaactatgttacattattatttttatggttacattaaatggtagctcacgatggttaatcgtgtggtgttaattaattgataattaaaacctggttaaggtgggttgtgagcatatggttttgatggttgtgctcatgacaattaaggaccggttcgcgagctactgttgtgaaacatttatcatgccaaccacaagccagcgtgggcaacggctttatcttttgtatagcgtgattcattatagtgcgccagactgagaagtggcgagaagttcacgggggtcgctggggagtccatgccttatttataagggggtgattatgatccaggaaaggtgcgctgtaatgggttatgttgtgcaaggggtattgtcacaactcctttccgaggtaccgtggtggtattgaggcacatcgtgacatgatgtggggttgtgtcttgtgggtacagtggtacacctctgatcagagtttaatctattcgaatagccgtgcccgcggttatgggcgagttgagcaatgtttttcgtgattagtctcacacctctcacaataattatggatgttaatatctggtaataatttgcttagctcctggtttggagttagatctgtacagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgtacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgttagaccgttaattccgctgctgtttttcttttcttttgtaagtatgtaacgttattattatgatgggtttgtatattaaaattgtcagtttgtgtacctcggctgattcctggacgaggattttatgcacaaataagttcggaaattactagtgaatttccgggcgtgacacgaggggcgtagcctggctgtcggttagcctgagtgaccgactggtggtattgcatgggttgaccgtagcgagggcgaggtgcgcctcgggaagaatttccctgatggttagacttgcgacttgcgtttcttgtattcttcggtagcctcttttctggcatcctcaagcagaagtgccttgttgatcatatgttgaaaagtggggaagtcatgagcaagcaactggagtctcattccaactgcgattcccttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcatggaaagccatagcaaactcatcccaagcaatgttagtgggttcaggatgtgcattgcagtaattctcccaccaatctgcagcaggtcctcttagctggtgagaggcgtagagcgtcttctcaacaggagtacactggagtctcattccaactggagtctcattccaactggattgaactgacttggagtctcattccaagtggggaagtcatgagcaagcaactggagtctcattccaactgcgattcccttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcatggaaagccatagcaaactcatcccaagcaatgttagtgggttcaggatgtgcattgcagtaattctcccaccaatctgcagcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaagtctgtgagcttggatctattgttgcccacgtgagggtggccatttccatgcgcattatgctgaaaaccggctatggctgtggttattccttgcaagatttgtgtctgaactgccattatgtgttgcatgttgttttccacatgaggtggggaagggaggcgttcttctccagaattgtgactggcagtgtggtgagagcggtgagactgttccatctctgcattacggaaaactatgcgatgcgagcggttgctgcggcggggttgctcaacctctgcgttgcgggaaacagtacggtgcgaacggttgctgtggtgagactgctcattagctgattcatgatttgcttctgcttcaactctaccatcttcaaaaccaaagcgggctggtgcacgagctgcacggcgggggcggctagccatctaaactcccagaaaagggcggggtaagagtcagataagcacttaggagggcaaggagcaaagcaaatagcaacacagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacccacgcacgcactacctcgccacgactccaaaagagttggcggcggaacaaaagagcctatcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccaggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcagaggcggcctgagtcccaagagatagtgtcaactaaggtgacaccctcctcggccagacgggcctccaaagcggcgtagcggcgggcaagggagcggtaagcctcaaggagtatgtcgtgctgagtggcctgagcctccgaaagctcaaccatgcgagtcagcactggctgagactcgctgtacggacaagggtacctggcgtctgagtggccagaaggaaggcgtggaagctgccggaaggcggaacctccgagacggtggttgtagtcgtgggccaggcgacgaagtgcagtccaggagaggtcctggtacgcgatctggagagtgggcctggccacagtgaagtggtgggggcgaaggccagctccgtgtatacctccacgggggtaaaggtacacagagagctcacagtgagggggaacacggtccacggagtaccccgtgtactcaggacacgagaagccaaggaaacgggcgaggtcacgaagctgagcgacgtggtgaccctcactaaaaccgtgggaactgaagctggcgttcactgccatctacaattttgaaagagggagaaagatcagtaaccattttagaaacaaactattgaaaataaagaaaacaaaagagaccttagcttttcgcaagtagttttgaacttagtatccttagggtcgtcctaagcgtcgggtttcgccctagggccaagcctgtgctatgataccatctcttgtcacgccccgagctagccccgactggaactagcccgtgacactccaaattaacctgttaatcgataccagtcccaggaaacagtgctggtatcacaggaagacagaatatcacagcaacagaagtctctttattatagagtaggagtacagtcatgttgggctgcggacagatcccgagctcacaactgcattacaaaaggaaaacggaagccaggacttggaccaatcaacacaggcgcgacttgggaactaggccgaaaccctaaaactcatcgtagccggcttgctcctggaagaactcctcatcagcaggatccgcttcatcttcttcagcaactggggaggagttatttatatagagcaagggtgagtatgggagtactcagcaagccaggggaaataagtgtttaatgcaggcttcaaggaaaggctgttgttttagcaattgattttatttgaactcttttctaaaagcaactaagtgagtgcttctcaaacgacacggatgagacagtgcgtctcgtccggtcggagtatgtgcaatgtgtcagtctttagatcttgaaacaaggttggcacccgaccaacagctttttaaacggccacccgagccaacaacttttcaaacggccacccgggccaacaactttccaaacggccacccgggcctagctgatcccgtcagctgctgatttttcaaacatcgaacccattttcacaacagcaatttcacgagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcatacttgtcttatgttcggatgaaattccaaggaaacggtccttaggtgcaagagcgggtaatcgtacacccggtacgttccccggtccgcggttttgggaattcatttagttcacaagcaccgacccaggtgtcgggttttttccaagtcttttgtaaaactccagttttacccaagttgttactcagattttaagtttgaaggcgaccgtcgattctcgcacagagtgcacgattatcgaggcgcaactgggtggttacaaagggacatagtatagcaattaacaatggaaggatcaaatgcaacaagtctggtaggtccgccaatctgccttgcagatgggacaaaagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggcttcgaaactacacgcgaaacgggacaactcaacaaacggcgaaaataaagccctattaatgacctctaagcgtgccattagatagatctcgagatttggggaattttggaagttgaacggagtcaaacggatttacggttgggaagatattgaatttctaagattattggatttttggtctaaagttaaaaggattaaattaaatcctttttgagaaagaaaaggaagagggaggagaagtagacttctctcaggcggctagggcgcggcccaagggaaatggagcggaccggccgatcttaacgggccggccggcccaagacggcccaagcgcgcgcgcgcgcgggagggaggacagagagtccggtggaccgggctcaccacacgcggtcccgggtgggacctgcttgtcagcggctcggctcaccgtgcggaaggagcacgcgacgcacgcgcgcgggcggagaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggccgcgaatggacggcgggcggcggcggcgagcggcggagcgaaccacggcgatacgggcaacagcgagcacaccgggcggttgcacgtgacaaggggaggcgagccaacggctcggattcgccggaggttgctcgacggcggaggattgcggcggtggcaaccggtggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactatggggaggctactcaagctactaccgaaagctagggggaggagatggagcgaggaggaggaacggagagaggcactaccgtggtgaggaggggcgctgtgacgagaggccgacggcgcgggagtgatctctccggcctcgggcagaggaagaggaagaagagggcgcgcccggagcccccttccgcgtccacgaacgcaccggctctcccggcgcttggcgatggacggcggaggcgaggcagagcacgggagtggcggcaacggtgaggaggcgaatgggagaggaaaggaagggagggggaagacgggtttaaatgggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggagagaaagggggctcgcccctttgccgattcgggaaaaggaggagggagcggggcgactcggcagagggagaggggctctctgcctccgccccttggacgctagcgcgcggagtggcgggggccgagcgatgacgacggcgatgacggtgggatggtttggagcggctcgacgacacgggcgacaggcgcgggctggcgcggcagagggtgagggcggcggcgaccaggcggtcggccactcggcacgcgcgcgcgggaagcaacgggcggcgcggctgggcagcggggccgggcgacgcggatggcgcagacgacgcggctcgggcgggaaaccacgcgggcgcgcgcgcgagcaacggcgcgcggggccggctttgcgagcggggagctcgcgcgagaggagggggcgctcggtgcggctctcgcacgcgcgagcagcgagcgtgggggggggaaacgccccggggtggggagggagcgagagagagagagagagagagagagacagagagggagacgcccgggagagagagggccggggaagagatgggccgagcggaattcggcccatcgaacccgggggaggcaaactagacttttgcggagggattcgatttggaaggaattggattcggaaaagaactcgatgatagatcggggattgagatcttgagatggcacggacactagacaacaatcaaagaaacaaatttcgcaattagggtttttcggagataattttcccgctaggtgccacgacggaacgggcgctacagtaggctgcggcgccctccggtgaaggcggcagcagcgaccgcacgctcccctccaccagatcccggggggaggggaggcggtgacccggcggcggcggccgtgggtagccgtgtcggcagtggtggtggagactggcgcaggcgaggtggcggccaatggcagccgccggatccggcgacaacggtggcgctacttgtggaggaggctggcccgggcgaggcggcgaccggtcgacaagagacttgttgagttatttctttcttttctcctcctccatttccaacctgttgagttcttgagttgtttgatacttagttttggatggggatgatgtgatctgggatggtggtggtggagaagacggaaaaaatttggggtggtgatctaggatggggatgatgtgatagatgtgttcttggatttggggtgttgatggatgtgttcttaggtgattgggagctcctcggtgcatcggctcgaatcgagccgatgcgtctagctgtttctatttggctcgtggaaacatcttaggtaccggttgggaacccctcaacctgcacctatatttgttataggtgtccgtttacaaccggcactgatgagttccctgatctgtgccgccttcatggtgccggttgggaaaaccggcaccgaaggaggtttcccaaccgacgctatttaggtattctgtagtagtgttttctccttccctaattctgttttcctggtagataagtgcttgtcttgccaaatgtaaaattatatattgcatataggaactatataatgcccgctatgactgctaagtacaattggaagatgtttttttggccatgataattgtgaagacatatttacacaattgcactggtgatacacttgagggattgtgttatttgctatatttgagaaaaaataattgatgaaaattaccaacaatgcagtattttgtcagttagagaccttaaagaccatcttgaaatgtaaattttcaaaatcttattgtagatacatatttacgtgacctttttactaagtgatttgcaatcttttctaagaaaatcaatttaggcaagatgtggttttggaggttaattttggcctttctagtttatattttgataaacatttcattggcacatctttataactaggcaaaatttgctaatggacatttaaaaaagtgtaattggctgggaaatatcgtaaaaacatgacacggctgatggtcattacaaaaattatataattggctatagggcaccagtcacattattttagatgtgagaatttttcaaaataacgagattgtccctggcgccatcttccctcacccgaaatcacagaagttttgtagctattggcaaggtagctggcgcagaagcggacctggttggggagggacaggaggtggaggagcacgagctagcgactgctcgaagctccaccgtaggcggctccttgtcacaagctcccgtcgtggccgttgcctgcttgcctccacgtccggtccctgctcgcgcgctgccgtgtggagcagccgcctgcacgtgcgctgcactgcgacaccgcctccttctcccaatctcgcatgctgccgcccgagtcgctacatactccgctccgccgtacaccacctccgcctgctgctgctcgatgggcgctcctctctgcctcgcgcagcgcaggcgtcggttgcttgctgctcgccatgctggcctgcctcgccccaccgcgcctccgaggtcgccgtgccattcccggcgaagtcaatgggaaggggaaaagaaataaagagaaggagaaaaagaagcaaagagaagggacaatccggacatttagaaaaatatctcaccttttttatccggaaataataaaataatacaattggtgtcctatggccaattatacgttttttagagtccatcagtcgtgttacgtttttgcggtgtctcccagccaattacatattttttgcgtgtcctgtggcaaagtttgcattataactatttttattatgtggcatattagatactcactccgtctcataatataatcatttttttatttcaacacaatttttgatatgatactttacctaacaatatctataaacttaatatgctttaaataaaaatatatgcatatcatgatagtttgtttcatgataaatatagtaacataattgatcttttctattttttttgttatcagtagtaacattaataaaaagatatgcgctattttataaatgcttatattttgatacagagtgagtattaatgttgcttggtttctagaactatgatacccataggaccccgggtcattgacgtgtataggcctcatcacagcccataggacccagggtcattgacgtgtataggcctcatcacagatgagtggtcagtgataataaaatcttatctctgatggtgaacacctatcacaaatgagtcgtcttataatgaatattcggacatgtaagctatctcaaatgaaaatagtgtatttcggaaaatattagaacaaacgtgtaaaagttcaactttttaaccgttgttcaaataggcgatcaggaaccgtggatgcatagagctcgctgagtattgcaaaatagactataagtttgtggtataatcagagtcccgaggtatttccggtgatcgaattaatgtgggccgttcgattttctttaacctctctctatataaacaacagaaaaaaaagaaaaaaaggaacaggagagatcgataccttgaagccctagccactgctactcttgcgcccctgccgccgctgctgccgttactatcactgtcgccgccgcttctgcgtcaccaccaccgccccgactgttgccggttgctgcagccatcatcctccttcgttatcggtggtttcttactattctgctcctttccggtgagttcttgctgctgtcaatctgatctgttgccgctgtgtgatttgctcgctactgctgctatcaacgttcctagctgctgctgctgctactgggtggtctgttgctgctgctgctacaacgatcagcgaggaaatggttcagagggcagagaaagcaggaggggaaaagaaggaaaaagggaagagaggcaaagttggggatttttctgggattccataaattcacctcaaatatgatttttatcctctgcaagggtaacttctcttagtccatggaagttcaatttttatcctctgcaagggtaacttctcttagcctgttgtgtgtttttttagttgttgtttatgggtcgaaagtaatattttccaatctggtattaaacaatcgggattcaagttagttgtcctaaataaagtttgtagtcatcgtcaagatctttttaacgccactggtttctctcgattccgataaacggtttaggagaaacaacagaaacagaggcttaattagttttttatggaggcttaatctgggacaacaatttgttttccttaatctgggattcacagaggcttaatctgattttgctcccaacatgaaaattgtagaaaattttgtttggatgtcctgagttctattacttgcaaaattttgttatgcggttggtgagttacgcataaaacaataatgaaactgctatagattgtttaatattaatcgataaaatatatattttaggtgtttattttagtaaatgtcctttgtaactatagttagtcaaatatagatgtttagttgtagctttactccacatgtgtgtagagatctggtgtggagagtgttgcctcgagttaccgtcaaggttaaaggcaagtgcacgacaaactaattatgtgattcatggattgtttgctctatctatttattttcattattttctatgtgatatgtgactcttatgttcatgcgattgttcatgccatttagatttcaagtttatctaatgtttacaacgttattcttgttttcaatatttcagattctgattctggttaaataatttaagttccatgcttgctgttggcggctgttaaatgtcgattctataccgccaacatatgcataaagttcagataataaaacaaccaacatagtgataggtgcttaatctcacatatttcacaagtgttggtgtatatttgtatgcagatgataaaccctgacgttgggaggaaatctagactaaagtgaggagaattatgtatccatacaaggaggggttgtgaacttcataaaaacatcagcgaatcaatccaaaactccgagaaatggatagaggagagcctagggagtccgcagtccgaaggccaggccaggagagcccatcataggttcgcccgaaccccctggatcggccgaacccccctggtcgctgttgatcctggggtttggcgtggacgctccagatgctctcccaatgatggttgcggggcagttcggacatttccccttctcacaaccgtcataactgccctataaaaggacatcactccctcacttcacacacacagttccaagcttgagctgaattataagagactctattgtactatattgtatactagaataggaagagagtagagtagaaggagttggaagaattctggagttgttggtaatcttctcctatttcttttattctgtttattactctgaattcaatataatattcttcttgagtaatttagatttatcttgtgagaattaactcttggttagttcctaagtagcatacaggattattgttcactataatcaactaaaatatagtggttgctttgttgagttataaacactaaagtagatagtaattgcttagacgtggtgttttggtgattattatccagtaattgctgtgtagcccacagtacgtttgaggtgggtgtagaggtggtgacagccctcgagatcactgaagtcctccctgtccgggtacgtagtagggagacactgtttctcactagtaaatcctctctatcctggcctatcatttgcttggtgtccttggataaactggaggaagatctgatcacacacgttcccttggattcgatacccttggaatactccgtattggaagtgctacctcggtatatccgtgcgcttgcagattttatctgtgaccgtaagaaataccaacacttgccatggatgtgcaatatgatttcaatttggttctttgtttcctaattattcatgttccatgcgagtcatggatatgctgtctgttttttcattcatgttcctgtatgtaagcgctgatcacgcttactctgctttgccgggaaatgctaggatgtatttacaattgtctgggacggaaaactactatgtcaattcatgtttgcccaggatgggaactactattttctttaacttggtgtttgaaaatgtttttcttttcaaagaaagaaagttatctatttaggctttattgccaatgatgtgtatatgtgttttcttgttccatattgtagttgctgagtatttctgtactcactcttgtgtttatttggttttagatacacattgagatcaacatgtatgggcaggaagtaggacccttatttacacatctatctgcacactatcaaactatatcaaactatattgcttaggaggaccacttcaagaaatatgaccttctgtgacgaattcctcgtgatgttggagcaattcgtcactagcacattccattttatgacgattagtatgagatggggtggcttagtgacgaaaaaaaggtgttcatcgttaataccaactagaaatcgtaataaagtatttcaatgggacatcgtgacgaatattaatttatcataaggggcacaaagcaaacgtcataaatttatataatgcatttatagaaaaatatattaaaacttaaagcaatttcatcaagtgaattaatgaggaaactaaaattttcctttataaatcatggccggaaatatttttgtaatattctacgtggtctaaataattcttgtgaattttcggtgctcaagaactaattttaataccacaaagtttatttaacctattaaaataaatggaaaataaattaaaattcctctctctgtctttgggctttttcgacccaagtattactctatcccttcctcagcccgcagcttgtctttgggcctatgctgattcatgatgagatggttgtagtgttttggttggtgcgactttgacatgtgacttgttcaggttagtgaatttgaatgattatttggacatgtgactttgttttggacggtgattgagttgtgactcgattagtacnnnnnnnnnnnnnnnnnnnnnattttgctattcaggacctgatgtaactggacatgtgatgtaatttttggtcagtgaagctgtcatgtaattgaacttgtttagataatgagcctatgatgtattttaatttggtcagcgattgtggttgtatttggacatgtggctgggttggcccacgtgttaattcatactgctgtagatgtcagatgtgtggatgttaattgggttttatattggattttaacttggaatctgtttgatatatgggcctcttgagtatgcatggcccagatgcaatttcattgtaatgcttgagcttactgggccatttgaatatatagagcccactcaatatttaattcaatatagatggatatagtataattgggctgaatttattaaaatctaattagacttccaataggcctagcccataaatagatttctcactacatgggccttaacaaggcctagcccaaaaataggttgctcactacatgggccttaaaaggcacatgatattttatgacattttttagctagataatgacgaatatgtgcgtcacaaagttataacgacagaaggatcatcactagattaatgacgaaaaattaaggtttcgtgatagaacgcccttagagatgcatgataggtgacgaatgaattttcgccacacgagcgtcacagattacgaaacgtgacgaaaaattcaacgattgtgacgtaaatggagcgtcatctattataagatctcttgtagtgccataatgacacttgaattatatcctagtttggtcttgtaataatcttttagctgtctattagtttctttcgatggattatatggatggatagcactgtgggaattatattatcattagtttaatcctataactgtatattgtagatgtccatatttataggggatactctgccaaaatttctaataattttgagagttaatggttttgagtatatttaggtgtggcattctaagtacatgtttacctggcgtgttacaatctgtgacgtgtggcaattacgacctgtgatagatacgggatcacatcaccacttatgtgtgacggttcataccactacactcatcatagatggcatgcaatttatgaagggacatggttgtgaccctgttgacgtgaaattcgtcatctacacgaaggccaaggagatttgcttagctctagtataggtactatcaatcaggctttggttgggccagttagtttgatcttgcaactaacaaggacgacagaaagaattgaaccaacgaaccaatcggcctgatatagtgtggaggatgtagatctgatggttaaagcatacatcgtctattaatccgacgcaagtagattcacgtgtatatcggctagttagccgatacatctgatagctaaagctcataataatgatagctcatcagctagaactccaataaaacattacataaaaacatatcgcttactagaattaaacttattagtagcaatctaatgaatgggaccttaccgagacattataagattgaagataataagaaaaacttacttagctgatagatctacgcaaacatgtttgatataataaatctatctaaaattgcaatatgattagattagaaagataccatcctagttagaatatcagacttaaatgataaagtcctaacttaagctgatacgattctaaatagtgatgcagttaaagataaattcaatatatctgataggcaacacttgcatcaacctaaatagaatatcagacctaactaagaaagttctagctatgccgatacaagcgaagttgatagaacttactttcttgccggagatcaaaaccgatgcagtctaattcgaaactaggaactcgctagaataaaagggggtgatgcacagaaagtaattgtattaatctatgaaagatagtttacaaagactgcaggtgtacataaatataccctcaggttggtacaagtcttgatcaaacacgagataagactccaaacaagaaaatgagaatatataactaatcctacctatttaagatttatactaaaaatatgaaactgcctctgccgtggtcttcgcgatttctctttaaattcagcttgatctggataaaacatctatctactaattggcttctttccttaaccgaattcaccaaagaatcgtaccaaattttagcattaacagaccttcatatttgtaataggttacaattacaacccgttacagataacctcacatctatgacaagtcgtgctgacccgtcagagatgatttgtggttggatctgtagtacatatatagtgatagatcaacaaatggtagatgatcgatagggctgcgataatttggaaaagaaacaaaaggggtgatcaaactagctatgttaaggagtagaagatcctaatgaatgtactaacatcttttaggccactcatgaataacaaaacaaaaaatatactacctccgttttttaatagatgacgccgttgactttttatcacatgtttgaccattcgtcttattcaaaaattttatgcaaatgtataagatataaatcacacttaaagtactatgagtgataaaacaactcataacaaaataaattataattacgtaaattttttgaataagacg

SEQ ID NO: 73170 - DNA, 2387 bp, Oryza sativa
  unsure (1)..(2387): unsure at all n locations
agaggaatnnattgattagacttctcggtcccattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctaatataacaagtccagagaagtcctcatttgcccaatcagtggccattacatcaccttcctcatcggatgatgcgtcgtcgtccgcttcctcattatcagaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttatattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttactgaatataatgaaatttcagagagagagggctgggctttataggggggaggcaaaaatcgccctcccccagggcggcaagggggccgcctgcaaaattccaggccccccgccgcccatttgcaggcggccccccgcacagtacaaaatcgccctagcggaaggcggcaagggggccgcctgcaaatttcgttgacggccgtcgcccgagagcgaacggccgtctgccacgtcactttcgccgccctctgggatggcgatttttaaaaatagccctcccagagggcggtaggcgaccacttctgtcaatttaaaatgaaaaattacttttgtaaaacttttaataaaaaaaattaaaaataaaaaaaattccgcattcgcgcgaccagtagctatccgtatgactgacactttttttttttttaaattacactgtacaacacatacactcagaacgcacgcgcactcacccctatgaacacacgcacgcaaaccctacccctataaacatcttcgaagactgagccagcaaatcctggagagattgacgaagtcaccataggcgcctcgctgtcgacggatacgtggcctaccactgaaagcacaacgccgaaaaatcctggaaaattcgctcccatggggagtcgaacctaggacctcaggtgctactgaggcttttgtatgactgatattttttttctcgggatataaattgtttcaattttgcacagttg

SEQ ID NO: 73171 - DNA, 701 bp, Oryza sativa
gctcatgaactcagattctcattctgtcatgcatctacatggagattgctgtactgatatttgtgagaagataggttgatcttgcatgcaaactgccaacacactgcaggtagggttaagttactgccagcttcagttgtgaaattataatatcatcacttcaaaagttcagagaaatggactgcaatttccctgatttttagcacatctgcgtggacattggagaccactgactgaatggattggtccagctgtcctatttttgcgctgtcctcatttggaggagaatctatcatgctgtttcatcggaactcatcgaataggaatggagttgaatatgttgtgcatgattcattgtcctgacacctaatagataaaaagtgctctctgtgttgaaattaattggatagatggatgatgaaggtagctagctagccacattgctgcagcataatatatatcgcagtccactttaggatgagcaactagctagctttcttctctgattgatgatggcgaggtgtcaccctcctaggctcctatccgaaactgcttgaaaccatcagtaactggtttgctctgaagaaaaagcgattaagaaatatcagggatacaaatatccaagcactagatgctaaggttggaattcatggatatttgtaggtttcacccttttcagaaaaagagctgatgaactactg

SEQ ID NO: 73172 - DNA, 25988 bp, Oryza sativa
cgccctccgctagggcgattttgctctgtgcggggggccgcctgcaaatgggcggcgagggggcatggaattttgcaggcggcccccttgccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgttcaatagaaggttatttttgggaactaatgccaatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaacaaagggaggagcaggccatgggcatggcggatgagggggagagagtcggtataattgttgatgaaatggagagggaagattcggataatgagcaagcggaggacgacacatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgctttcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggatctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccactggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcctacacaacgctgagtgcccaagttttttatattccagatccatctaagttaagggtgaaaaagggtcgacgccaaactagacgcatcagaaatgatatggatgagtcagaagcaggtgggaggaatttacgctgcagcaagtgtgatctgcgcggccatacttacaagaaatgcccgaagaatgcagaagttccaagcggcgctgatgctagtccatctggacaggcaagtgatggtaggcgaccaactggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtactgagtacctccgactattgttgtactagtactattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactgaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagatgttattatcatacatgattatttgcgaccggatgagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacgggccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggacgaccagtggtggacagcgcaccctacggggttggtcgcagcgcgcagtggccagaggacggtcccacgatggggacttactggtgtcgacgtggggttagtgcaacttcgctgcgttataagtttatcagtcatcttctttttttttccttcacataacatgtctaattccgatcatgtttattgcagcgtcgttacgctcacatccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcctgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcccttccgcgagctccgcaggggcgttcgccacctcttcgggcgcgttcgccagctcttcctctcacggagcgtcgatccctcacccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtattgtgctcgaacaacttatgctcacaacaacacactttcggcgcttcacggtagtgccatatccagtagcgcgcacagtccacaacagcacacatgaaaatggaagcctattaattggtaatacgtaatctacaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtgcaaaatcgccctagcggagggcggcaagggggccgcctgcaaaattccatgccccctcgccgcccatttgcaggcggccccccgcacagtgcaaaatcgccctagcggagggcggcaagggggccgcctgcaaaattccctgccccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcgcgcgacgcgaggtgctctccttcttgctcctgccggtctgcctgagtgagattctttggggagctttctgtggatccaccactttctcaggtgtgctgatttttcatccatgttcagttcgttgtcatttttaattttaccaaatctggataaggcaatatactaaacacatttcaatcattactatcttactaaattttagcagttatgtggtatacgttttcttttatttttcctgattatgacattccagagttataatcttgtaatttttctcctgttttatcaatagaacttcgcatcgtcttgtgcgagtcgtcaaaaaaaattagagttatataagcttatttgtttaaaactttatcagaatttggtgaaaacatcaaagcaaacaaagacaacactatcgaaatttggtaatgccaaaataccaaaatgtgttagggttgatttgggcaacaaactgaacaagccattcgtatcttttgtggggaaacttcacgaaattttattcgatgctttaggatttaagcaagtcgatcaaactttatagattttggtcaataaccagccaaagtacaaatacacatctaagggtataaaagttgtaccagtagattcgtagattcatatttcacggtcctttcacaaagtttatggttttccatatgtacttcttccgtttcatattaccattttaacttttttcctagccatcttatagaggaaaatagcaacatatgtaacaccaaattagtttcattaaatctaacactaaatatattttgataatatgtttattttatgctaaaaactctactatttttttttataaacttggtcaaacttaaacaagtttgattaaaaaaaagtaaaatgacttataatacgaaacgaaacggatgaagtatcctacaaataaattttatgagtagactttcaaaaaataaaaaatatgcaccgtaaaattccaaagaggcgctcctttttagcaaattcaaaaaaaaattccagaagagttcgtttctttttttttcatggatatatgtttttattgcagaaaatgatatgctctattttaaatgaccttttgagatatgccactcaattttgtagaagtaaagaaaatagcatatcaatttcttgttgctctaatatgccatcctatcattttcaatattatcctttcctgttctctgaaagaaaaaacgaaaaagaaaaaggccaactctaccctttgtcccagttgaaatggaaaaagtacactgaaggttgctcaacttgtcatcgagttacaaatcgtcccccaaccataaaatcatatatataatatctctaaacttacaaaacccattcactttaggtccttgagtgattgtggccccagtttgtttgacgtggtggttgggtcagtgtgggtcccacatatcaggatgccacatcatcaccctctctctttctcatcctctctctcacttttctcctctctgcacggtgctgacaggtagggaggaggttgccggggcaaggtgagcgaggagatccggcagcctgcgacgcggcggtggcggttgcgattcgcgagcaggccgcgcgtgccgggtcggatacctccaatctcaccgagttcatattcgaggaagaagattatgctagatatcgactacaaagactagattatatcatcccaaatattatactcgtgtgatgataatatataaaggcaacattggcttcacccaacatgagtagggctattacctgtcaattaaggaaccgaacttgtatgattttttttctctcgtctcttttacctcaatctcacgtatatcttggcattgacgatcctcatactctacaaatatcgtagtcgcggtatagcccatcgacaatagtatgatgtatggcatgttctagactgtgccaccgtttggagctacagcgccatccaacttaattatggtcgcagtcaggatggagctacgtgtaaaaggaggtgcttaagaacttgatcaagaaaatattttaagcaatagtttatcaatttttatcatagatgcacccactaaatataaactcagatacctgatttaaaacagagtaaaccaagtggatgacaccactctccaattcaatctagcttcgtctaggatcctagtgtacttagccaaaaattattgatttaattcttttattaacgaaaaacattattgtacgtttttttgtttttcactgtaactttattcaacggaatactattactgtacggagtattatccatgacgagtataggtacagacgcaacaaaatcaccattcgagaagcttctcctctcctctactgctcctccatttctcgaacctcgctcgtcagtctctcgatttctcgaaccttcttatctgacgttgacgcccctcagaaaaatccactcccattttaaatccccaccaccatatatccctcgaattcatcgtcttcctcagctcaccaaaatccccagtcccgcgcaaccttcagctctcggtctgcgttagctcctgaagaatcgaagcaatggcggacctcttcttcggtggccccttccggcgaatcctctacgggcggcccttcccgccggattgggcgtcggcgtcggcgacggcggcgatggactgggtcgagacgccgacctcccacgtgctcaggatcaacgtcccgggactgggcaaggacgacgtcaaggtgcaggtggaggacggcaacgtgctcaccgtgaggggcgcggcgccgcacgcggcggcggagaaggagagggagagggagaaggatgtggtgtggcacgtggcggagcgcgggcggccggagttcgcgagggaggtggcgctgccggcggaggtgagggtggagcagatcagggccagcgtcgacaacggcgtgctcaccgtcgtcgtgcccaaggagcccgcgccggcccggcccaggaccaggcccatcgccgtctccagcaagctctgatcctgatcaagcccgaccctttgtgcattgtgcgcaagtgtttctgtgtttgtgaactgtagtcgattatagcaaccatcagtcgaatgttgtgaagggcgaatgtgtattggaagtccaaatcttaatgttgaaaattttgaaaaattttagaggtttgaattactagtatatctatgtaataatctaattaataaaggtgggtcttctgcaagcttactagcgcacttggcatggttaaagtttcacatcttaactcttgaaaagacaaatccaaaacagaacaagaatgcaccacattatccaataaataatagccattagatcaactagcaaacaaaacaggtagaataaatcttagccatttgataaaagaggatgttcaagaactttccggtgtatcctttatggcttcatatatgtgctgttgggatacgcgtaggctacaatagcataaatcaaaattttctatcgcgtaaaccaggaaccatgcaagtattagatcataaatcgttaccactcgacgcgctgcgcagcggaagaaggcgctaagaagtcgaaggaattctcgcgaagtagcgcgcgtcgatgtagaggaagtagtcgatcgcaccgactcgaccttctcctcctcgtgcgttctcctcaaccgtattcccacgccgatcaacaccgcaaaccagcggcgcctctaccggtatccacacgtacagggacggaacaccacgcgcagatgtgctagcacccgcgcgcggctagggttttgctcggggaggggagtgacggctagggtttctcacgtgaagcaatacctccgccggtcacacccctcacgaatatataggatccatcactcgggcctccaaggcccgtaggactcctattcagatccctatccgaattaagcttattttggatctccatccaatccccttattccggcccattaagcgtgcgaccctgtaggttcatgtacactcagctgtaacctgaaaactccttttcgatccacgcatcaacagcggcccctagcagaacgcattgacccaccgggcatacataaagatcatatcggctgaacctctagtgtatatttgtataaacccctttgcctcacgatatcaattaagctcaaggctagatatgtgccatcctctaatagctcaatcattcattcgaatatgttgatagattatataacttgtgattgactcctcaatcacctttggcatggctatgcacttccataatctacaacattgaggggcccaaagatatctctccataggaggggcaaatcccatcttaattattcatatctcactacatgtttcatagcatacccgaaaactacttttataactacccaattacggagtagcgtttagcagtccctaagtaagctactacacatgttggaaaccatgataatctcaggtctaaggattcaacaccaacactaaatgagatcactgatgacacaacacatatggctcttacagtatctcatgttgggtctatccaacaacatgttcactaacatgtgtccacattattaatttggtatctctataccatgatccatgagacatgatcgtcaattaatacatatgctgatcatctaaacatatttgttccacatatgatatttgatcagtgatcctttagaaatagcaacacacaacataaagagtctcatgaaagaatcacatattcattaaccaataattagttatctatttcaaggaacaaagtcggataaatatgtaaacatagtatgtgatacaatcatctctatgattgcctctagggcatatcactagcaggagagatatagagtaagaagacacacataagaaataaaaaaaacaggcgccgtcagatatcctctttagacaatttgaaccgatggatcattgaattggagaaatctctttaagatcctttaggaaactttattttacgagaaggtccttccacgtccctgctgtaaaagaaatccctcgattcccctcgactcctcttgtaaatttgaatttatctatagcatcgggaatcgtttccataacccgcgggtaggggtggcaattttccccatggggccggggacccgcccctatggggacgggggcgggtgctaatttcaacccgcggggagtcggggccggggtcccagccatgggcgggggcgggggaggacagccacccacgaggccccggggtatgtgtattagactattcacagtaacatattataccaaaacgcccagctagcccaccttatataaggcaaaaccctaaattccccatcaattctaccctatgttcaattcctcacctacctaggaactcagccaccactagggatgaaaacggtcggaaacggtcggaaaaaccctctaccatttccatttttattttattttctcgaaaatggaattggaacgttatactcgaaaacggtaacgatatcggtaaagtcggtatatcggaaacggaaccgtcggaacgggaatctatcgatatcggtcggaagtcgaaaattcatgtcggaagcagagaactgtggtatcaatccacatttaactatgtatgaagatgaccttataatttcacccttgcatcatcacgctgccacacaacaccgttatatgatgattaataagttgacaataagatcgacaaacaatataaataaagttcaacaatacttcaacatcaatgtggctaaagcatacaatgtagcttacatgataggattacatcataactaatattgtccgacttttttttaggatatagatttgaagtcttcgagaacaccaagctcacaagctggcatggcttcagctgatcagctccttgtcaaacatcatttatcatttcatcatcaattgacatagctacatcgtcatcctacagactacaatggcacattgcataagaacttttatgttgacactgtataactaccattgtaattaagtttcatcctaaactagactttttggtagtttccaggtcaaggggggtcaccgagtggagtcaaattggtggggctcgccggtgggtcccactgtctttccttttccctctttttttcttttcttttctctctcttatccttcccttctctcggttccttctcctgctctctctcgatttcttctctattttctctctcgttctcttctctgccttcggctccttcacgcgcgcccgagaggagagaggtgccggagatggcggcctggcgcagggcggtggtgggggaaggagagaggagaaaggtgcggcgccaatggggaagaggaggcctcggtgcggcagcgctcggcacggcgtcgctcggcgcttggcgtggtggcgcttcgctcggcggcacggaggccggcggtggaggatgggggagggaaaggggctggctgcgatggaggctgtcggggcgaaggaggctgcggccggcgtcggcgacatcgattgctctagtctcttaatgcctaatgggctgctcctgctcctgctagccaggcccagccggcttccttcttcagaattttgtcggaaattaccgataaaaaacggttaccgaccaaacggtcggaaaaaaccccatatcatttctactaccatttccgaaagagattaccgtttccatttccgataccgacaattaccgataccgactgaaacggtaggtgcaaaccggaaacggaagccggaattctcggaaatttccgtaccgttttcacccctagccaccactccactagcggtcggtgcgtgttcctccggtcatgcagcgagcaggcacgtgtggcagcgtcggcgaccggccatgtgcaggcggctgaatcaatggccggggacgacgcatccgcatcggcggccgtccatgcgcagtcggttgcatcgacggccggggacggcgcatctgcgagggcggccaagggcagggcattcgtgtcggcggtgaggtccaacgtggcggcggtagcagcgcctaatcctccgcctaatctcgccggccaccttgccgctgtccgccgtcaggtctgcccagccgggtaccacctcgccgtcatcaagctgtcccacctcgtcggagctcgctgttcctcgctcgtcagtggacctagccgggtggtgcggggtcccgcccacccgccggggcccctgcgggggcgaggacgggggatgttttccacccgaccacctctgcggggccggggccgggcgaagaagtcggggagcgggggcgggggcgttctagcccaacccgtccccgacccgccctgttgccaaccctacccgcgggactgcgatttagggactcatgttttcgcttatgcttatacttatcagccaaaatttgaattttttactttaaatttggagttgattttgaggttttttcgtcgaagtttatttattagcatttgattttagatcgctaagaacacgtatataaaatttgtattcacaaattatttttgtttgtaaatatgccatttctctcgaattttcaagtatgtaccattcagacgagtcaaaggcacctcccgcacaacgaagcaaattggctagccactctgatttgtatagaaaagaaaactaaggttgtgtttagatccagcggtgaaaagttttggcgtgtcacatcggatatacgaacacacatttgaaatattaaacgtagactaataacaaaacaaattacagattccgtctgtaaactgcaagacgaatttattaagcctaattaatccgtcattagcaaatgtttactgtagcaccacattgtcaaatcatggagcaattaggtttaaaagatacgtctcgcaatttacacgcaaactgtgtaatttttcgtttatatttaatattccatgtatgtattatgtaaggatgcggcttccctgttcatattgtgaaattaatccattgttcactactatatatgcataagctctatttatgctattattcaccgctaacaaagtagtattatgtattattcataagctctttttaatgtctaattttatggatgtcatgtatgggctacttcctccgtttcacaatgtaagtcattttagcatttcttatattcatattgatattaatgaatctagacatatatatctatatagaatcattaacattaatatgaatgtggaaaatgctataatgacttatattgtgaaacggagggagtaacttataggcgtgtcaaagggcgcgctattttctactcctgattatattcataagtagtactctctttatcccagtttaatcagcctatgaacaaataacaccaagaccaaggacaacaaaatatttatcattctcaaattaattatcatcgattgaggtgcttcatcgctttgtgtgtcgtgaattactcatgttttaaatattacatgccattgcaccaatcgagattaatctggttggttacatgaatacattcaatgatgcacattactctttgcacaaataaacaaagagacacatgttagacgatgatcattttgaaaatacctcaaaatccttatgggtgatcaaaatgagatggaagcactgaataaacacaacctgattgtctgaataatggctgaatcctgcaccgattatattcatgtgttggtcagttgatttaatcaaaagttcagttagggagtcagtttaatttgccaagtaagatttgcccccatgtaactcgcggaaaagtagccgagagcaaaaatgaacgatgcctgatcggctgatcgtctttgttgctgctttggtgctatatgatagggtaatatctgtatagtttaccggatactcaatagccgttggatgccctttttccaaatccgatctcatatttgctataaaaaactatttggattcgactacgataaccatataagtacccaagtattcagatttttatcctaaattaattaatacaatcgggtgaacggcgagaaaatagttgtatttgcgagatacattctattcacaagcaacttcactgacctatctatgtttgcacatagctgtaaatctcatttaaacgtgagtcctgtgccactaaacttgtcagcgacgatgtcatccacacggcgcgccatctccggcgtcatgtggttcacccagtcaccgaccacgcccttccggaaaagggtctcacgtggaatctttcgctgcgcatcaacgtaacccgttctgttcgcctcgaatcccctcatacggtcgaggctgcagagctccacgatggcttcaaccgtgccggcttcctcctccgcctcggagaacggcagcccgacgaaccgcgccatcttccggacgttcccggcagggtcacgcagcaactcctcgtaccgcaggaagagcacgttgtccggcacctcggtgctcgcgtgccagtagccgaggatgtgatcccagaacggcccgtatatcttggcaccaccgtcgtcgtcgcggtaggactcgagggtttcggcgaatgacacgtcgggcatcagctgccgggtgtagtgccacatggacacgatcatgtccttgggttcccgacagatgtagataattttgtagcctcctctgttgccagaggagttagctgtggtagtggctggcgtggcgctcggtagtatagcgagtggcatatgcgtgttgatgaggcgcggagaggggagtgcgtcgagtttggcctcttcaccacaggggcgaagaggccctcgaggaaagggaggcactggtgcgggttgaggcggtggagcgggtggctggaggcggaggcgggggcggaggtgggagggtggtgcacgtggcgtgccatggtggcgaacgtgagggcgatgagccacgtggtgccgcacttggggaggctggccacgatgacgtcgtcggggcggggaacgaagcgccgccgcagggccacggccgccgggacgtggatctccgccagccagaagccccggtagaggcgtagcttgagcggcaggttgacctccatcttgctcgggagagacgagaccatgtcggcgaggtggtcgtcgccgtcgtcaatcccttccggcgccggccgctcggaggccggcagctcgccgtcgacgtcctcgaacgggacgggaccaaccggggaaaaagatattcctgcggtcgccatggcagaattggcagatgaaaatggatcagctggtggcgcgcacatatatatatactccgtgtgtcaatatgtgcagtggcgtgcaagcagctgcgtgtgtatctgccattcagcgtcatgagaaagatgagcgtgcacacgcgttacttgtgatgatgtgacggcgtccccgcgtccttcgctgcttcgattgagtgatgaactgatgatagagcgatgaagcgatccatatcctcaacagtatacgctgaggatcgagtacatgctgattaggataaacggctgtcaagatttatagtagaataagtcacatagtatatactatgttgtatttgtattgggacggagggagtagcaaactggagagatgcatgggctaggaaagttgttcggaatatcatcgttcagctattgttaagtacaacgatcacatcatatccaaaattaacaatcatatcaacaatacaacagtacagcgctggtcttccaggttaactatgaatttcacataacacacatgtacacacactaaaaaaaaatgattcaacacctttgcaacaattttttatgggacattttttaaagaaaaaactctttaggaaccgcatattcaacatctttctctatgaaaaatgaaactattcaacatctttttatggaatgttattttgtaaagtttatttggagagcagtttattattttttttgtctttaccttcctaatagcatatctcatgtttttttagattggcttatgggtagacgagaaaaataagaaacttattcttataagagcttcttctatacgttgggctctatggttgagtaggaatgacatgattttttgacaaaccaccatctatttcatatatgtaggtaattttcaggacaactcattagctcaggtcttgggcacaactataaaagtgtgatgaagagggcgagtgcttaaaagttacatgccgtaatcttaagacaacggttatgcaactgtttaccaattttggatggatattcataaacagaattcaataattgtgtaagggtgtgtttagttcacgccaaaattggaagtttgattaattagaacgatgtaatagaaaagttggaagtttgtgtgtgtagaaaagtttggatgtgatggaaaagttgaaaattcaaagaaaaagttgggaactaaaccaggcctaatccttaccttgggttggtagtctttagtttgctttttttaacggttggtatcttctttttttttttgtgaacctttttattttttttgtgatacgttgtaataattggctctagctcgttgagtaaaggccgggatattatttccattatttaaaaaaaaagaacagcatattcatggtcggaagttttacaagtctacactaaacaaattccacaaagctagctccaactccaatataagcaaatagggcccaattgatcaatcacaaacaaaacacggcatttgcttctcatcatgcaattgccagcccgcgttaagaattctttttacctgtataatttatgagtgttgcaagcaaattaaatcaatagtagtgaattcagtaattaattgacactcgccctcattttagtggccgggaaataggccgggatcccggccttttatttgggttccaaacgaggccacgaggccttcaaatgtcaccaggccacaatctgttcacgacctatccttttcgccgggctggagaataccgaaggccgagtttagttccaaactttttcttcaaacttctaactttttcatcacattaaaattttgggataattgcaaacatgccactactttcaactcctaactcgaaatagccattataaaaacgcaaactgcaaatttgccatcaaagttggttttctaagcttccgtttgtcactgttgtcccaactgatgcaattaaaaggataaaaataattcatagaaatacattgcaacttgaaagactgttttgcccttagctaagtttataccctcccagccctaggacccgacttgaccgcaagctagaatgatcccctccttctacctctatgaatcatagatctcaaatcctctcatccatggcaaggaaagagctaatggattttgatggcggcgggcggcgacgggcaggcagtgggtgttttggcggtcagaactgcaggctacctcggcttgagcggcggccgcagtagcagcaaatgaaggcggcggcagcaaagctgcatcttgggcagcagcaacattatcaggggatgcagcagcagcaagcaaatgttggccacaacagcagcagccgacaactgcatctaagcatcttagctcttaggcaacaacaacaacattagcaggcagtattttcgtgggtagtaggccagtaacagcccacggttgcatctcctaaggcttttatcctccttttttttttcttatacgataagtatgccaaaataatgtttatcttgcaatttggtggataggggtatccttgtcctaaatttgataaaaaccaaccttctaacggtgatagttcaggctgtcggtctaatggcaggcaggttgggttccagctgtttctggtggtaaatatgcaattatactttttgtagtggtagattcacagtactggttgaaaccagtggtaaatatacaattggccctaaaattttcctacacacacaaacttgcaacttttccgacacaccgttccaatttcaaccaaacttctaattttgacgtgaactaaacacacccgaattcatgcacgactgactatacgaggattcagcaaggctgccgataaaattggcctgaaaaggccgaatttacatacgggactatacggggattcagcaagtttgctgataaaatggaaagagctaatacggcgcagtggcaggagattacggaattggatttctgaaattttgagtttgtcagtttctgaaatcattggattgagaatctgaaatttttcaatcggtctatcagattcttaatccaacaaacaattatctcgttacatggacagtgacaacaataagactataatttgttttttaaaaggtgtagcggaatcccatgaaatttcttgtttggattttaaattgaactgaaatccttgtcggaatctgaagttcagtaatactatgcccaaggcaactagagtctagaactaggcaagaaatagcaagattcatgtcataagacagtaatcaaacatgttctgcaacatcaaatactaactactatcacaaacctaaatgaatcttatgacatgaatataacggaaactcagattcatacaaacctgtccatgtcttatgctagccaaaaaagaatcgagacacaagaaaaatttaacaataaacacaatggcttagcacgagcaaactgcttcattcccaagacttaagaaaactagcattcttgtttaaaaagaaaaagaaagagaacgtcaaagaacgaaaactaccatgctctgttcttcatgtcaagcatagaaatcatggagattagaacaaagataacaatccaatttgtctgttagaagctcaaaacaaagtgaaaacaagagaatggattaatcggtgatttgggacttgtcacggttaattgaagtgagtcaatgacaccgccacaatcaagatagaacaacatgccaaaaacagagatgcgccattctcagtgcagattaagcattcagtctttcaaagctctaacgattctagatcacgaacatttcaaaccagtgaacaatagatttcggattcaatccggcatgatcagattaggaaacacatcgatcgatcagagtttttggacagggcgagctcaaaccttacgtcatcaggggcggcgcgttgtcgtcggagaagagctcggtagaagatcgacgcggcggaactcagcgcgaaggaggcaggtgaacgtggcgtcgggcgcagcgttcgaccgcgtggcggcggcgtggaggcggagcgatggggaggcgagcggggtggcgacccgcggcggcgcgtccgcgggcggcagcagggccgtcgtggtcggcgaaggtgacgagcgcgtgcttgtcccagaggcccctccagcgccgggagatgaggctggtccgggcggcggctgcggcggtggagaggcggaggaggatgaggaggaggacgtcgtcggggagcgagctgaggcggtcctcccctccaccgccgatcaccgcgtcgtcgtcgtcgccaccggaggtggaggagagcttcacgcgcttggtgggggagacctcgccgtcgctgacctgcgcgcgcgcggtcccggagacgagcacgtcgccgtcgacgtcgacgtggtccatggccgagggcggaggcgagcgcggtggcgtcgccgcgtctccgagagagaagaatggagacacggcagacgagcgagatcggaggccgttatataaaaaggggaccaccaattctgacatacaccgtgcgatctagttctaacggtgtagattcgagaaggaaaataagagaaaaagattcgcgatccagctcagctgtgatcgagattggatttttacagagagcaccctgtgatgtgtgatcatttgcaaaccagtaaatttcacaaaactgctgataatttaaccaaattatcataaaactataaatttaaggtgatatattgatataacgataaatttatcatgaaactactgctttaagattgagcatcgcaaaactaaagatttaataataaaattattataaaactatagattttgaggtttaaatctttagcacaaatattatgattgagttataaacatccaagtatgtaagtaaattgacgctaaacttatagttttatgataagtttgatactaaaatataattcaccttaaattcgtagttttatgataaatttggtattagagttgtattttgtgatatattatctttaatttgtagggcatgttcagattgtagcaaacaataaacattatcaaattttagcaatgccaaaattttgacaatttgataatattgccaagtttttgcatgatttcttatatatttactaaagtttagaaaaaaaactaaatggattcacatatttaataattttatttaaaaatgatatggtttgaaatggcatcgatatgaacaacccagtagttttacaataattcaatatataataagttttgtgcaatttactcttgcaaattgcatcttgggaaacggctttcgggtcctcgccgccggctgccgctgccgtcggcggcggccgccaccaccggtccgtgtacttgcgcatgcggtgcgcatacttcgccatgaccacgccgccgctaccttcctccaaagcgcccgcgaaccccacccgcctgccaccatcgcgttccatatgcctacgccacgcacctcgccaaccttagcgcgcctctcccgcatgctcctcgacggttgccacgatcgcccccaagatggcctactcggtctcggacgactccctgcatcgaccctgcgcggctgcgcttatgggcatgggggagccacagctgcgctcatgctgttcgacgaaatgccagaccgcgcctccgccgtgcgtcacgttagaggcgatgcctatttgctcggaaaagatgggaccgaccaagtccgaccactggaagacgaactcagtttgttcgatggagtggcctggaggagtccatctgctggcatggaatgccatcatgaggatgcagtcgcatgcttaggagtccatctgcagatctgcctgtatggaactcagtttgctcgatgcagtcacagccatcatgagaatgcattgcgttcaagcacaatggggtggccgtcgtgttgactgcaagtgtgcctggctgcctaccaccttggaggatgcaatcgcaggcttaggtcctctgcctgacctacatcaccttccctgggttgttcaatgcgtacatctgccattctgtgttatttggtgagtgcaccaaattgttcctgtgttgagctactagtcccttcattactgcacatgccgacgtgctggctacaatgctgtgctatgactaattttagttgtttctgaaccttctgcttttttttgtcatctttttcagtctcctgcatttttctcaagaagattattcggagtattggggccactatgccatgttaccgataattgttttgttcatttttgtcagttacggattagtgagcatcacagctgatttgcaaatttgtggcatcaacatctgaaaagattcttgtaggtaccaaacttcttagtttgaatcattttcttcacagagcttactcctttatttagcatcaaatcctacgtttgagtctcttcttgtagtcagttctcagtgcctctttggttctgaacttgcagtgctttgcattgttgtgagtttgtgaacctggtggttttgttttcagattcttcttctctttgctatagctccttgtatctaagccagattcacgaaatgttgggacagcttctgaattttcattgtgacctttgttctaggtagttcaaaactcaccacggtgtaacacatgcccttctcacaatggtctgtaagaatggtagttacctttgcaacgtgatatcaacaaccactggtcaccctgtgttctacttagcaagtccatgtggaagactggtaagtaaatgataaccaaaacattcactaattcctcaattccatagtatagttcttctccagcctgaacttacctcgtcctcagaagtagttgccgaacgtcttctcctccagttctccatgctgcattcttctgttagactgttatcttctcctccagttttgtgtgccgcacgctgctagcttttaccatctatgccgctgtaaattgcattcctgatattgccaggtagagtgccttggtactagtttactgcaattttgtttgagctatcaatacatcagaaggtaaactgtagcagcagctctccacctttttatttattttctctagaaaactggttctaagtggtttgaaatttatgtttcaggtgctaatgaagcttttgttggttgacttatccttttcttcccagttggcatcatactttgtcataatatgtgcgatatagcttcatgattgcttttcaatttgctcattccttgattagatcttttcactgcactttttaaataatactgattctgtctccattggttgaactgtaggtgttatagtagctgtgttttattgcttcctgaagcaactggcagaattttctgatacagaccatcaaacagttcgggatcaagatgcaaggaacaatgaaacagaaccaattctaccaagaaaaagggtggttttcagctatggagcgacggaagagcagcctgagtcgagcatgtgctcttcagaagatatgtgcagtgagaatgtctgcaagatctgctatgatgctccacggagttgcttcttcataccctgtggccatggttttgcatgttttacatgtgcaaggaggtataattctcatctaaatccttcagttacaggagtcagtttactgctgtatggctttgatttgattgctttttctttttacgaatctgattaacttgtagaatgagaaacactcaagggtcttccggctagctccacaaggtggtgggctagacgacatgggtttgaagcctcaccccttctaattatttgatattaggtcatttcctgatatttgcgtcttattaacatgtagaataaaagggacctgatccctgtaaagtcacaactcacaaattgataaattgtcaagttttggattccgattataagcctcggtctgaactgttatgatttatctctctgtaaagctaggagccaaagatttgttgtcccataattatttgatgaagctcactgaataacaccacattgcctactgttactgcaggatcgcggaagacaaaaatcaggcatgcccaatttgccgaaggctgatccacagagtaaggaggctggtggagcccttaggttcgtcttgtggtgagtagatgatcttgagtcagcagagagaagagttgcaatgctgcactgatgaattgttgccttgccgcccatatgctgcctgtctaggcctgaaggatgctttggactaagcatggaatgtcgatcacctacctgacggattgaccggatgaggaagctagtattgaagatggactcaattaatttacgccggctattgaatctttttgtttcctttttcttgtgtatgtttaggtaaagactttcagtagttcgtactgctttctttctctgatccactgtacgtttcacacacttggagactgatgcatgataatagtagttcgtatcgcattcatgccgtgcactctagccatacgtttggctggaccaaagctcgtggttgcaggcttgcggccagaattattattcttccaaggtctcactctccgtggcggccaagtttccctcccatgtgttgaccatcatgggaaccaac

SEQ ID NO: 73173 - DNA, 5398 bp, Oryza sativa
cgtcatacattaaaatatggaggtagtactacactaattagcaatgaagcatctcaatactacagaaaagggctaaagtgtcaggtcataatccttcatcaatgccagaaatcaaaccggcacagatcatcagtgtcgggttaagaaccgacaatgatgaggactcataagtgccggttcaaggctacaaaacaacgtgtacagtgattttgtaaacacgtgatattttttacagaaatatataaaaaaatataactcaagcctaacaaccattcattcaaatttgatttgaaactagaaagactctagcttagataccagccaagcaatccacacagcaatttttaagaaatcatactacaccgtgaaataattaacattacacaaaagaattgaaaatatgtgcgcaatgggatcaattgactatccgtaatcttgccttgtgagtggcgacacgcaagagctgcgcggaacaatgcaaccagaagtaaaggttggaatattccctgaaaagtgcatctagccctctaagtgggttttggtggattattgacaaaccagttaagggaccaataatattgtgaagaagtatgtgcatgtgttagtcccaaatgaatggagatccccaaatctaatggaacgtggagcaggaacttgaagagttattttaaatttcttttatgttttgtctctcgagttctaggatcttcgtattatcaagaggggttctcaacagatgcctggtgtctacaagtgctcatagacattctctagaagagagacacatgtttcacacacacatacgggttgggccacctttttgtatctgcccagaagttctcctgggaggtgctaggaaaacctctggccgctatttttctccgttgcgcctaagtgttggccggaagttctccgggagccaacccaggattctcaagccctgtgttaagtttgaattgtgagtaacggctagctgatgtcacacgagtacctatatattccggcctcccccacctttgttggctggaaaatccactttcattttcttgtcccctagcctctcccatgatgttcttgctttccgcaattagttcttaaactctactccttgatttgagagttgacgaggaagataggagatgtggtgagtgttaggagattgtgagcgcttgaagatcttctcgggtttgatgctttgggcttgtttctcttggagggcaacctcctagacggataggtttcgcccgcgtgcatccaagtcattgtggattgaccggggaaagtttgtgaaggttttcctcgcctccgcaaggagaagaggtaatttgagtgaaaattccgagcggagctttcggaggttgtcttggtagagcaatccatattcgtggtgttctctaggtgtccaagttgggaatctttttggtcatttgaaacctagagaagcaactagggatgttggattgaaaattggagatttcttcttagggttttgcctggtgagacaaggtgttaattgagacctagatctttggagctcctcaatggagagtaggattcttataatctgaacttggggaaaaaaatctcgtgtctcccctcttgtgcaatttatttctcttttgatttactgctttgaattgttcattactatcctttgtacctctgcaagtcttgggtttccttgagaatcaagactcgagtcccgagaagcgagaaccccggatgtttctagaaagaaccccggaagttccagggagcccttattgtcttcgggtgagagctgctagaaagtttcggtccctataatttaaccgtttcaattgaagaaaatttcatgaaagcctattaacccacctataggctacaccttaggctttcattcctgtccttagcagtttcatgccatgcacagatcttgttgcgcagtgagtcaaaaaccatccttgaccagtacacttttgatatctgaccaaggtcactagcaatgtattcattcatgccaataatatagaagctagtggtggccatcaaaagcttgttcactacgatcatgatgaagaaacatacaagctcagggccattaggcctctctttgatcttggaaatcaacccgtcgaccgttactttgggattactaccaccaatgttgagcttatccaatagattcctgacatgtgggccccacatgtagatggggaagaagatggaaaacgtgatggcaatggcatggttctaattttgtaaaatttgagtggcacgactatgaatagacgaatggaaatgaataggcacatttgcaatggcacggatcaaattaacccttagacaaaacatgtgactattttatacaattgcatcagtgattatagcaaaacatgggagtgggacgttgattatttaccttagtgagctagtggcgaccgtggtgttgtagctctttgcgacaaatcttggcctacaacttctctcggcatatccataacattctccgacatcttcaactaaaaaaggcagtgaaaatatatcaccgtggtgatttttttagtaactaatcaaaatgtatgataagatgaatagcgatgaatttgataaaggagaaaaagccaaacatgtccttcctatgcattacacacatacatgtgttggtgttggtcctgttggagtgacctgagtagcaccccaaggttctgagttcaaatcttcgtatgagcgaatttcagattggcttatttaagggctaagtttcctgtttgaaaggctaagttcctaattttaaaaaggttgcatatatccagttgaatgtagaggccggaaaaatactcttctctaaaagaaatgcattacacacatacatgaatgattctagctaaattgaggatgatgtttagttggtggcgacaatggcgctcgccgtgctgcagctcctcgggggcaaatccatggtatcaccaacaccaatgtgtgcatctagggatgtagttcaatgaaagttaggaaattacttatcaatttaattcaataagtaataattactccctccatactcgtaaaggaagtcgtttaggacagcgacacggactccaaaacacaactttgacttcttttttctataaaaatatttattgaaaagttatatatgtacacttttatgaaaatatttttcaagacaaatctattcatataatttttatattttcaaactcaacaacttgagagttattcatgatttatacttccaaggtttgacttaaacattgtcctaaacgactcccttcgtgagtatggaaggagtaataagtaatcatggcatggagcagcattgaatcagagtaagctctgttttctgtgtagcatgcattcatttgatttgaaccttaacattcagaaattactaaatctcacaatgaagcatattgagtttttagagaatgtctactgccattacatgaatacggttcacaagctaaggaagctaaatgtcgatgcataaaactaaaactaagaagtcctaagcaacagagaccatggagaaattaagtactggaatttcgtcccttcatctccagcaatttcataagcaaagtacatgatagatacacgaatgggaagatcagtagatcctaaatgaatagcagcagaatagaatcaagagtaaagtgcacgggcggtccttaaacttgtaggggtatgtcatttaggtctctaaactctcaaaatgcatatccaagttccagaacttgtcatagtgtgtcatataggtcccaaatcgccacaacccttcaggatcctacgtagcgttgatgtggcatgccacacgtacatgatatggcattattttgacggacaaatggaacccatttaattttttcttttgtctttttcttcttctttttttcccctttcttctcctttctctgtgacccatgcagaaaaaaggaaaaaaaagaagaatgagaagaaaacaaaaaagaaaaagaaaagaagaagaaaaaagagaaaagaacacgtcacgtccatgtggcattgccacatcagcgccatgtaggatcctagagatgatgtgtcaatttaggatctagatgatacactttgacaagttctgggatctggatatacattttgagagtttacgaacatatatgacacaaccctacaagtttaaggtttgccaatacacttttctctagaatcaaaatgaatgaccatgctttggcactagctaaacatttgtactatatttaggctgtgtttgctccagcgtgttcccaaccgcacggataacggaacggtccattagcacataattaattaagtattatctatttttttaaaaaaatggatcaacgtgatttttttaagcaactttcgtatagaaacatttttaaaaaacacaccgtttaacagtttaaaaaacgtgcgcgcggaaaacgaggagattgagttgggaaatctgggctaagaacacagccttaaggctaccacaaactctatcaaggcttgtagtgacaaccagtggttccaacaaaacatgggattgattattttaccttcgcaagctggtggagaccaggacgttgcagttcttctcggcaaatccgtgcatcaccaacactaacacatgcacatgaagctatacaattgttcttatccctcatctgactgtcgtcgccgttgccgttaccttgaccgctacgccaccagtgtatacatgacaattgcccatttgactgtaggatacctccatgagaagaaaaagaagattgggggacaaaaggagaagatgatggagaggaacatgtgagatggagccaagagacagaggaggacgattgagccgtgcttcctcgctcctctagctagctggcagcttgctcaaccaaccactggccgccataggagaggggacatggagaaaatgaaaggattagggttttccagagtggggtttgtacttttatactcaatggaggtaaccatgagcttgtgtttggaccttggactaagatgaaaatttgaattggaccaaaattttttttgttaagggcttttatcttaggttacaccgaaataggcaacttaaagtcgaatatacatatagggttgtcagaaaagctcgaagcatttgagcttgccaagctcgactcgagcttcacacgagccgagcccgagcctgttgtgagattcacaagccttaacgagctgagctcgaatagctcgtcgagctcagcactcatgcatggtagtgttagtcagtaccgtagacccttttgttacttagcttgaactttttttatttgtctaaatgctatgctacccaagacatgtcacaacgaaggcacatgtatgctcaaagtgcctacatgtagtacctaccatgtagcctatattcctgccttgt

SEQ ID NO: 73174 - DNA, 3190 bp, Oryza sativa
ccgtgcggtccgcccgcccgcacgcacaaaatatcgattttcccaaacgaggagctgcacgcagcccgagcgaccgcatgggataatagatccaaccacccggaaaaatgagtattgtagtagtgagttttttcatactttctccgtttcacattatgaaatattttatattttaatagatttatacatagatccatatatgtatttcatatatgtggacatgccgaatttaaaccatccatgtgaccaccacgtgattttgaatagtgagatccatacacacaaaaatagccactcaaatctcaatgtgtccatgatcagaactttacaccatttaatacaaaatccgcaaatctcgaataatgagcaaacgaaatattgatgggactcagcgtgccagtcaacttcagcctgatacatgtgcccgtcaaaccacacgaaggcggcaaccaactgtgttatacatctcgggaaacttactcaaattgctaagctcaataacatctcaattgctcaaaatccatactcgtgttagactacttcccaggataaggactagtctcatgctgtcatcgaaagcaatgataaataggaaataagacatatacaagaactaaaattcaaattacatatactttagacatacataggccaaccgggttcgcggaagcttacatgcccaacccacgagtaagccaactaagggtaaacccctagggtgtgtttggataatgggaaatggagggtgggattgagattgggaaatgaatgaagggttaggattaaatggaagagagagaatgaatggttaggatttaaagatgccttttgatgtgtgggaaatgatttccccatcccattagccaaacgctgccctaatggaatcaaatacaaaacaacaacgattcccgaccactcaaaataaactaagtcacctgcaaaacaaatttaaatatacatggcaagagttcacaaacaagttaatatactggcaaggccacaattaaacctaaataaatacaagctctaagcaaagaatggttgtttgtggtctcatattttcagcataaaagcaagttttagttcacaaacagtttgcacggaggttttataaagcatttgaaggacatgtacataatgtaaaacattgtgatcaacttaaataattttgtcaacataattatcatctccatgcttgcaccatccttccatgatagcaagtcatcataatcaacatcatatttatcataagtcatggatcccaatcctatatccattttcaaacatatttgaaaacatagaactatacttatggcacacatactatgtcgctcataaccatgagcacaactaatcgattaattttagactctaaaaaatttgtacagcattaaccacatgatgtgaatcgctctaatttgtcttgtacccatcagtaccaccacactctatatgttcaatgtggtttagaggtcacaaagtagtctttacattacttaattcctagccttgcaccagcacagcaagtgtggatccaccctaggaatgacctagagtcgttaggtggcgtgcccacgccttaaacctaacatcgcggctacgaacacgtccgttcccccaggaggcactataccattgaattggacaaacttagatgcccaaactaccccaataaaatacaagtaaataggtagttcccgcttagactaattcattctttcctggcctaccaaaatacaaggccatcccataactagcaaacgtggatgcacattaaacaatagtttaatagtaggtgactattgacgaataatccgtgtttggccgatggtgccagatatgtgttagcgcgaactaagtcgatgaatacaatgacttgggagatcttcttagctccagtacaggtcctaaaatgagatgcgagagtgccagtcagtttgatccttcaactaaccagatgtatgaattgaagatcaaagagtcgatcgtcagatactagtccttattggacacaacttaaacttctttaaagataaaaggaaaaaacataagtcccgattgaacactaaacacactttcctaacaactgactcttattaacgttcgagagagatgaaggcaacgacgaggtcgagagatgcgagatataagggagggataacgaggcaagcgagacatgaacgggcgctcaggagttgattttttttactccgcgctgtttttttttttttttgcacgtggttgctccaaatttgtgtcaggtaaataaagaaaccaacatctgtagctttttttatttgtgtcagttttttaagaaaactggtgtttatttatactatattgtaaaaaaataaaaaattgaagatttttgtgctgaaattttggtgccggtgtttgagttggttataagttgcccgtatcttattcgatgtgagtttaaaataactattatacaccttctagtccaaacaaaccggcccataccatcccgccttctcatcccgcatgcctccactcagcgtcatttacccctctcccgattaatatcttttttttccttccctttttttttctttttctctatttctttaatccgggacatcctgatccttccaatctcctttttctccttttcctgcttttttctcttccaaatttctctcctcataaatattttttaaaaaattataattatttaaggtgtgtatgtggcaacattgttactttacaaatgcttcaattttcagtaattttttcactaattgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatctagttgtctcatgcccctagagggagctccctgccctccttatataggttggggggcagggttataagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtac

SEQ ID NO: 73175 - DNA, 9293 bp, Oryza sativa
aatcaaaggcgatgacgaaatccaccaatcatgaagatgaagaaaatacttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcatttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagtttcttgtcgttgaatagttattgcttgattgaagatatgtgttgaagatgtccaagtagaaatcatgaatgttggagagccacttgttgtagtaaaataatacggcatcgcatgccgagatgtcgagattcacaaagacgtcatggttggtgaagtagcaaaacttgtgaagtagcagcaatagagtttgctggtaccgaagataataaagatgaagtcgctccaccatgatgacaaagttgcgttgccgtgatgaagtgaacacgagtcggcggcaacggaagcaaaccggtagtgaagacgcgcagttgtgaagataaaagcaccagtcggcggcggcataaccagtcggcgacggaagacgatgatttccatcagtagtggtagctgtataaacaagacgtagaggcgagggcactagtcagcagtagacgagacgaccggcgatgaagaagataaagccaatcaacactggcggaatcatgcagccatggaaatgaataaactagtcggcagcagatgttgtaacaccctagcctaagacataataggattgataggatactcatgccaacaagttgcaacttcttttccggaagcccatctccaaagaactctaaagttaagcgtgcttggcttagagaaatttagggatgggtgaccgaccgggaagtcttcccgggtgcgcatgagtgaggacaaagtgcgcagaaaagactggtgttggtttgtgagggcagtctatgtcctatttaagctgctagatgtaagcgggcccggcctcgtgcaggcgggacgttacagtatggtatcagaaccgactctcacggtttcacgggcgcgtgtgtcgcagttgcgctggcatggtgcgcatggctagtgtggacccggtgtggtcacacagcatggcacatgcgctggcactggacatgggtgtgtcgcagttgcgcacgcatggtgtgcatggctggtgtggacccggtatggtcacacagcatgacacatgcgctggcactggacacacggacgtggccaagagagggagttcctggattggggttgatcgacgaggacgtcgatctctttagggggtgaggatgtaacaccctagcctaagacataataggattgataggatactcatgccaacaagttgcaactttttttccggaagcccatctccaaagaactctaaagttaagcgtgcttggcttagagaaatttagggatgggtgaccgaccgggaagtcttcccgggtgcgcatgagagggagttcctggattggggttgatcgacgaggacgtcgatctctttagggggtgaggatgtaacaccctagcctaagacataataggattgataggatactcatgccaacaagttgcaacttcttttccggaagcccatctccaaagaactctaaagttaagcgtgcttggcttagagaaatttagggatgggtgaccgaccgggaagtcttcccaggtgcgcatgagtgaggacaaagtgcgcagaaaagactggtgttggtttgtgagggcagtctatgtcctatttaagctgctagatgtaagcgggcccggcctcgtgcaggcgggacgttacagatgtagacagcttgcgttgaagatgataacgcctattagcggtgacggcgacgtggctagccgtgaagaagatagcatcagttggcgtcataacaggccaaccgtgcaggcggtgacaccagtcggcggcggatgcggcggccggtcggtgaagacgtagacgcccaacaatggcggcataataagccagccgtgcaggcggaaacaccagtcggcggcggacgaggcggccggtcggtgaagatgtagacgcccaacaacggcggcataataggccaaccgtgcaggcggaaacaccagtcggcggcggacgaggcggccggtcggtgaagacgtagacgcccaacaacggtggtgtgaccaaacaaccgtataggcgaagacaccagtcggcggcgaacgaggcggccggtcggtgaagacgtagacgcccaacaacggtggtgtgaccaaacaaccgtataggcgaagacaccagtcggcggcgatgacggcaagccggtggtgatgttctgactgatccattcctggagcgtaagagataagcttaaagccatgaatcccttttgtgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcctccgactcactactcaatggaagaccaattggtgtagtgaggcagaggaaaaggaaaaatatcatataaagaataaaataaatgatgacttagctttataatattccccttggtgatggcagaggtggccaatgtgggaacaaagtcgtccattaataacaatgaagacaccagtcggcggcgacgaaggctgtcgacggtgaaagcgaagatgcccactaatggcggcataataggccagccctgtaggcggagataccaatcggcggcggcgaagacaagccggtcggtgaagacgtggacgcccatgaacggtggtgtgaccaaccaaccgtataggcgaggacaccagtcagcggcgacggaggcacgccgagggtgaggtcgtagacgcccaacaaacggcggcataataggccagccatgtaggcggaaacatcagtcggcggcgatggaggcggccggtcggtgaaagtgaagacgcccatcagcagcggcgaacggtgaggcgcagccgggtccgcatggcggagccccccgggctcgagtgtgcatgccttggacgtagccgggccaagctcctgtggtactcggactcggtggtgtggaggcagccgatcgtgaacttgttgaaggggtcgacagtgtcagcggatgtagccagccacacaggcgtagaggcccggcagcaatgagcggccaactcgtggacaaatcaagtcgacattctgcagcacggcgacagcctgaccaccacggcgtctcggtagcacatgtaatcaatcaaagaattaatctgatcaacggcagcaaggaattaattaaagataaatgttcaaatatcaatgcgaggtgattaatgggtggcttgaggaggatgcgtgttgctgcatggtcctgttgcatagtcatgtccatgctggtgacgtgccatcgtctcatttgtcggccatgttgccatccaaagccttgttgatgacgacgttttgtgcgccatggtagcgatcgatgatggcgcgggcacagtcccctgcgcaggtctggcagtagatgtagaagccatggaaaatcgggcaatcctcgtcgacgttgaagcggcagagggaacagatccacaactccgggaggacggcggggagggaggcgacgtagtcgtcggagcggaggaggcggaggtcgcagtcgcgggcggcgttggtgtccatcagcacgacgcaggacggcaggaagacatcggcgtggctgcagccgtctcctatgcatccgattagatcggttttgacatgcttcgtgtttgtagatccatcttgcaacaccatggcatcctcgttgggtagattggaccagtaggcttggtggtggacgaggacgaccatcaaatccgtcgaaccgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatctagttgtctcatgcccctagagggagctccctgccctccttatataggttggggggcagggttataagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtacccataatctccacactaattgaataattaaaattttaatcgatgttccatgtggtatagtaaaatacatgcgtcaacttacggaagagacacctgattgatttgtgaggctatggaaaggtgtacaggaaggattcttcgtgtgatgacgcatgaagcgagcggaactacgtcaatgctatatatgatttttttaactttagtttttcattgttttgtttgtcttgtttttgtttgtcatttaaattaacaaagtttttatcaatgtgaaaattatcttcacctgttacaatgcacatatattttttagtatattgtatgtgcctatttctatgcatcaagtcaggtgttttactcgcgcctattcctcttctatttactagatgaaaccctgcacaatgatgctggagtttttttatgatattagaagaaataatagctacacttgtataattttcaactctaatcaactattaagaaaagctataaataattaagatagtgaggtttataacaatttaaataaaggtggtttgatattgttgtggaaatacataacatactttcagtacgtagcattctcagattaatctttgcatatagataactgatggaagtacctagtaaattgaaattgcttttgcttaaaaataatcgggtgggtctactgcgtatacatgcatttagattgaacccacatgtaaccaattcatttccatgttgaaccaataacctccaaaatggcattggctcggttcagttacatgcatgtgattactgaaaaatctagaagaattaagagagatttaggaggagtggcattaaccatggtacatggactctgatcataaacgcactgctcaacatctcactcggggaccttctcatccaacgattcatatgcaatctcatccaccgatcgaacggctaagaattagcgatgacgtggaacactaaggtttcagctttggatcttaacttcataggaaaaagagattccacgtggtaaaaccaatggtgtaatcagtctctcctgttagattgcacacacgttctttgaactaatcagattggacgaccccgacactagttcataaataatttttttgacgtcctagattctagacgggacgtaagtggccccatttggaaaaactaggcgaacagcgccgggcggtcgcccgcataggaaaatacattatcccgtgcgggtgtcttaatctaaccgcacgggataaacttaagagaaccgcccggagaaatcgattttcgtatgtagacctcttaagcggaccgcaggggaaaatacctctcattttttccctcacccactagaaatttttcgcatcctctcttccttttggctctcacccactttaaatttttgcactattccagcacgaatcgtagtgcaatccaacaaacagaaaagcgtcaaataccaaacaaaaaatcacccgacaaagatatagcaaaatcgaatttatttaccctttaagtgacgggcccttctactaaaaaacttggcccaaaatatttggcaggcctggttccagtcaattccccatgggtgggccgggaatttgaacttgaatggctcatcaccattcaccaatgccctcaatccgacagcatacacaccacaactgagagcaagcaaacggcagcagtccacagtacagccaagccgccgtaatcagcaggagctagattggccatccaaaaagagtaacaggagaccacaaacccaggaaaaatgtcccaagcggaaattaacatgtagaagatgttagaatttcaccctaaatgagcacttttaagaatgcagtaatacctaaacaacaacgagacgcaccccacgtaggtattagggatgagaagagagacaaagcttgtagcttccaccaaagtaacgcctgctgcctgtccctatacttacatatacatacattgctgaagtcacaaccaatggtttgacatccgtctcacatgtgcttgaatagatccagaatataattagcacgactattaccgattgctcgaacagcaggacagggttaaacctaaagctaataatagataccacataatagtcagcctggcataaatgtattgcacaaaacaccaccaggtcgaaaggtgtacataccattcgaaatttggtatataacttttggtatggcatgaactctctgcttcaaagttgggagtttctccaatataatcaatggatgatagatggcatcagttactaagttttaaggtagagagaactattatgtcttctggtgcaccgatggttgatcttgcaatttgtttgagttatctggctcgactttcagggagcctggttcgtctatggccatcgcacttgcatcggtaggctgcagttgtcaaagagcaaaacatgaaaaggcagccgttgttaccacagagatccatgacagttcacttacgtgcaagtctaccttttgcaagattacaagtttgcacaaataaaagagcacttacaacagtttgtttcgaggaaccaactccatcagccgcaggttctgtgcccttggtgttctctgcagcgaccctattaccatcctgcaacatacaaataacaaggcaaactattaccaacagagaatgattaagttgaagattaagttttcactgatgaagatgaagatgaggattaagttgacgtacgtaaaacgagaaaaccattagcacatgattaattaaattttaattattacaaacttgacaaatggatatatttgatattttaaagcaacttatatatagaaagttttcacaggaacacaccgtttagtagtttgaaaagcgtcctaacagaaaccaaggtaaaatctgaatcttaatcagaaaagaacaaggacatctgaagagaaaattccttatttgacatctgaaattaacaagtttccttattcgacatctaaattagatgcttcccttatattaccgagcaatttttcacatccctcataagccactacggacgccaccgttaaaaattgccattagcagagtttgtcagtagtgtaagcaaatggtaaaatgcccctgagcccacttgtcagcatcatctcttatctattatttttcctcatctctacaaatctcgctcctcccaccagccttggataccgtattgagctgccaccgcacttaacatccgtcatgctacactccacctcctgctcgccatgccatggtggattgtgactcaactctggtgccccttcctccagatgaggtcaaccatggtaagggcgatgaagttgtgcagagcatgttgcagcagggttgtgtgccggcacttgtgctgcccgaccctgggtgtagctcctcctggtaggcctgaaatgacaaacttcactgatttggggctcatggaagaacaggatatgaatctccgaatctttggatacatgccctctttgcggtctccaatgtgtgagctgagctaaccacttcctcacagcttgtccatatcttgcaggtccaactacatttcgaaattacaccactcttttttttttctctggtgtttgaaaaacttaagctgtgtggtaatattttttttcctattttgtcatgcattttttttctatattggcattgccaccgagacagcattgctctgtggaggcagtaggcagttgttgcctagatgcaatgatcctgttcggtgcttgtgtagcacccggaagagcacacattgggcctgctaggtaggccaacatgcagcgctttttactgtacagcacagcccgagcagaacagcggcagcaccgcagtggatggtcatcaagcagaactgtaagcgtgtcccgctgcagccactgtagctgctgcggtgttctaccaaacaagaccattgacgagatggataatttttttatttgattccatacgagggaataacactttttggtgccaataaaggattcactat

SEQ ID NO: 73176 - DNA, 5945 bp, Oryza sativa
cccgtcccattggacgacggcgccagccactctggcgccccaaaaaggaccatttctgggataagtttttctaagggtctatttgtgaaataagtttttcaaaaggaccaaaatgtgaaaaatccgcggaaaaacataggaataggaaaaacgtaggaattggagtggcatattttcctaatcctacaggaatggaaaacacaggaaatatgaagagagtccctttgatagcaccataggaaacaaacaaaataaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctccaaaattcctatgacaatcctctaattcaaaggggcccttatatctcattacgcctaccgtcggctgcaaaccgaggaattttgctttgataccccttacctatctatacaccaacactacttttatattaattatggtatagagagggttgcattggctattctttggttttgattttgtgcctattcataaattaaaatcattcaaaatcatcttccatatcgggatatgtatttttgtccataaaaattttattgctggattctatgaaatcaaacaccacatgtatatctctgtctatgttgtgtataacaataataaatttgttatgaaagccaacaaaataagcgtatatatctattcgccatggtactattgtaggtctatctgcatatctcttctagaattaaataagcatatctcctgtcttatcttctagtgtgtgatttggtttgaatttattctataattttcaatacagttctattgctacatatcgcagttaaatgatgattaggatgacaaccaaccatgtcataaataagagctagtagtgctaaaaccaaacgaccaataatacatagcttttgtcacgaacgagcattgtcctaccaattttacttcttgattctaaataaactagctcacataacaaaacttgaaattatatacaccaaactgaagaggtgccaagaacaatgtatatgtgtatctgctctttttttttatcaagagcaagttttatattgtttgtttgtatatatcccctccttattgttgtctcactcctaacttttactatagtctttttgttaatggagctagcattgctgtatatatgttgattgccgcttttttcctcctcttttagcgcatgtgtacttcgccggaagggtgaggcttgcatgcgaggaacatcccgtctaatagtagccaggagattgtgagggcaagtaattaattaatggagatgctctgcagtaactaccttcctagatcaccaccaagggttgaactatggatgctgcacagcacgatgggcagattttgatcgatcggagaaattggtatatgtacgttcttatcaagatgttacttagcgcatatgggtcttgtcgaaacatgatttcggcaataataaaaggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaaccctccaaataacatgatccgagtgatataccaactgctttgtaaaatatgatgcgtacaacctaaagttgacaacatctttgaaagttcacatagcaaaacaactataaagaagcttgaatgctgtgaataaagaaatctccaaagtattgggcatacgccatgcgcacactgcttcaacagatgtgcttaagtccctaaaagacacatggtttcaccacacctggaaatatatggcatatgtggtataacatccgagtaagtaaactcataaaggatttaccaaccgcctgaaaaatgaccataatatataatcagcctaagtcataatattggtcaataaaaatgcacacttacgtggcaaaaagcaatgatattgtatccaatcaattgcttgataaatccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctaggtaatatagaccaagtgtagctcatatgaatagcttctgatctgatagattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagagcccagcgataaagttgtgtagccatggcagcgaaataatcagtcggtgacagacgaggcaaatcaaaggcgatgacaaaatccaccaatcatggagatgaagaaaatagtcggcgacgacaaatgcaactgacatgatgaagatgacgatgtcggtgatccagtcaatagcagcgtcacaaccaatgataatgacgaagacgctcatcagcatttgcatagtaggtcaaccgtcaaggtgaaataataagtcggcgaaaacataatcatccattagcaacagcggagatgtcagggccgatgaagcggaggtgctggtgatgatgtcagtgacaataatccatcaaattagtgttataactgttgtagatgcttcacttggaggagagttgatgttgttgcccaactcgtctaaaccgaaatatttaaagtttgttgaagtagaatgtctgctccgaatcaaagatgaagataatgactcctggagttgactcgttggttgatgaattgatttcttcagcctgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtgaaataacatggcatcgtatgccgagatgtcgaggctaacaaagacgtcgtggttggtgaagtagcaaaacttgcgaagtagcagcaatagagtttgccagtgctgaagataataaagatgaagtcgctctatcatgatgacaaagttgcattgccgtgatgaagtgaacacgagtcggcggcaacagaagcaaactggtagtgaagacgcgcagttgtgaagataaaagcaccagtcagcgacagcataaccagtcggcgacggaaaacgatgatgtttatcagtagtggtagctgtctaaaccagacgtagaggtgagggcactagtcagcagtagacgtagacagcttgcgttgaagatgatgatgcctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataacaggccagccgtgcaggcggaaacaccagtcgacggcggtcgaggcggccggtcggtgaagacgtagacgcccaacaacggcggcataaaggccagcagtgcaggcggaaacaccagtcagcggcggacaaggcggccggtcagtgaagacgtagacgcccaacaacggcggcataataggccagccgtgcaggcggaaacaccagtcggcagcggcgaaggcaagccggtcagtgaagacgtagacgcccaacaacggcggcataaaggccagccgtgcaggcggaaacaccagtcggcagcggcggaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcgcagcggcggtcgaggcggccggtcggtgaagacgtagacgcccaacaacggcggcataaaggccagccgtgcaggcggaaacaccagtcggcagcggcggtcgaggcggccggtcggtgaagacgtagacgcccaacaacggcggcataaaggccagcccgtgccggcgaaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccacccgtgcaggcggaagcaccaaacggcggcggacgatgcggccggtcggtgaagacgtaaacccccaacaacggcagcataaaggccagccgtgcaggcggaaacaccattccgcagcggcgaaagcaagccggtcggtgaagacctatacgcccaacaacggcggcataaatgccagccgtgcatgcggaaacaccattctgcaagcgcggtcgatgccgccggtcggtgaatacgtatacccccaacaacgg

SEQ ID NO: 73177 - DNA, 978 bp, Oryza sativa
cccccccccccccccacaaattttttatttttcttttatttgtttgatatttttttttcacgcttagggacaggcaagaaccaaccatagaaaaattgaactcaaatggacataatatgtgacctgtagaatttttcctctcatctcctctcttcgaactagtgcagaggagacagatgtgcaaattttttatttttattttatttttttgatatttttttcacacttagggacacacaagaaccaaccatataaaaaataaactcaaacggacgaaatatgtggcctgtagaattttccaaagctctaccaaaaaacttctctcctcgaaaacacaatcttgcaagcggaatttggaggttttagtatcgccaaacccggcgttgccagggagaatcggatgtaacattttctgtagattatttgcctgattccgagtccgtatgagaaagttacgcctattttaataaatgacacccgaatgacttttcggtagagctttggaaaattctacaagtcacatattttgtccatttgagtttattttttctattgttggtttctgtattctcctaagtgtgaaaaaaatatcaaaaaaaaataaaaataaaaaaattgcatctctctgtactgtttaacttatggctatcatttcatgtggttatattttgaattagagattaagtaacttcatatagtggtagagtgcattatgtttaacatgctgatcaaagggttttactaaagaagttatggtctaattttgatgaaggtgcaaagtaggctaagtggtatgctattttcggatatctagctaagtggtatattccgttcgagtttaaattttttttgtttttctctagtggttggttgtatcgtgatcctaagtgcgaaaaaacatccgaaaaaataaaacaaaaataaaaaggttgcaactctatataaagaaatagaaatggaggcgaggggtggggggga

SEQ ID NO: 73178 - DNA, 20710 bp, Oryza sativa
cctttggataaatcattatatgtcaactgaattcagggcaaaatatgtagtacaaactgtattatgtaatagaaacttagaaactatcgttacataaaaaatagatgtctaaaatggtgttcacgtcatcaaaaataaaacttttacttccagatttaatcatgagaaaaagttttactcttgttaacatggacaaatatcaaacatcaatttttggatccaacgatagttttcaggtttacaccagatgtgtggtttgcactgtatgttttctagaatttcagttagatgcccattacaccatcgcctgtgataagttctcagagtatagcattgctacaagcatgtattcggtaatcccttttaagcatacatgatatatttgagtagctacactgttcttttgattatacccttatatgagaaacaagagggacactgcctacatacagtataatttcaggaaaaaaacagttaatagattaagaaaaactattacctaaccttgaggtcttaacagattattcgcgttgatcagaagaggttgcaaaacagcaatataaacaacataatacatgatagcatgatggggaaaaccataatgatacagaatctgtaatatatatatataccataacgtgatgaactaaacatgaagacatatcaaggtatatatatatgaaacattattaattattcatggtaaacaacaacaagatggataacaccgactataatctataattctatactatacttctataagacaatagtggtcataatatcaatataacttgtgagtgctataacagcttttatcatgtactggtggagtggtgttgtagtaatagtcattagttgcgcgcttttgctgcaataaggttctttaattttcttgccatcacgattaagaaaacttacaaactttttaggttttcattgcagtttaaaatgagatagacaacacaatttattgacaagtacatattttctaatcatatgaaaatgatatatctttaacaaagatactgtcatcgatttgtacaaaaatctagcaatgacatttttcttttcgctttttgagacaaaaagacttgtttgaaacaaatagaagctaatatttttttttcaacaaggacatatgcgatttttttctattttgaattatccgttgtaatgcacagatatttatctacctagtctatactaatacaaaagatggtagtggcggtgagtctgccaccaccaccatcaccacccaactaccatacgggacccatgaactgtgagttgcttgtctcttagcctcacatgccatagttcccgtcgaaagaaaaaatatgacaatagaatattatgaaaaattttatcttacgtaatgacaacaaaattagcataatgatagtatagtagacaattaagaaaaaaaaacgttgcaacacacagccatcatgctattgtctagagaatatacaacaatggttcttttgtcataaaaaaacaactaggtaaacatgctggtttcatgcctacatgacatgaacaaaccagcatcagtataggaaaacaggtaaattaaactgagtacagatacatatagcatatcacaattcacaacatgatatgctcaaagagccatgaggccaaggatcgaaatgtagatcaaaataactaaacgattcttctgatgataatctcatcacaacacaccgaggagttcttccagcatcgtcgtccatgaattaatcccttcgatgcagcacaccataattattcaggatcaggatcattctggttgcttactgtgtgtcctcgccgtcgccggccggatcctgccagaacgaggagctgaggatgtcgtcgccgtcgccgagatccgcgaagaactccatgacgaactgatcagggctgtccggcggggtgtagacaccgaggagcttcggcttcttgtgcggcagcacgggctcgtcgtcggagatggccgacagcaggaagtcatcaggagccaccacgacgccgccgggagggatgatcatcggctggaagatggcttgattggccggtgcaggtgccagcgccggtgccggcgccggagctgcagcgggtgtagtcgcctgcagcatcggagaatcctcggcgaccaccctcgccggcgtgcgcccgcggccgcggcggccgccgcgaccgccaccgcgtccacgtccacgcccgcgcccgcgctctccacggccgccttgaacttgtagctcgggctcaggaaccagcgccgacgagggaggaggaggaggaggagcctcgcttgccggggctgatggcgccgccgccgccgccgcgcgacggcgtcggcttctgccgcgtccacgggcaccaccaccgcgtccacgtgggccacgagcccttggaacgagggagcgcaccaggtgggcgatcccgaagaagacgagcatggaacgcatcaccggcgtggtcgccggccgcagcggcgcgcgggggaagttggtcgtcgccttgtccccgtggatcaccgtcgccgcggtgtcgtacgcccaggcggcctcctcggcggtgccgaacgtgcccagccacaccctctccttcacccccatcgtgttgcggatgcggatctccgccgcgtacttcccccacggcctcttcctcgccccccggtacttcctctccgccgccaccagaagctccgccgtcaaaccttcctccccctccacaaccggcgccccgacgaaaccctctccctctccctcgacggccggcgccacccagccctccccgtttgcggccgcaaaaccctccgcctccacggccagcgccgccaacccgtcggtgttgatctccccctccaccgccgcagccgccgccaccgccccgttccccgcggtcgcctgcgccgccgcgcgctggcagtactccctgagaagctcgaccagccacgtcgtcgtcttctgcttcaccggcctccccatccctacgacctaactccggcgatcgacgccgcgcgcgcgccctagccctaaatccctaatccctctagatctgcctccctcccctgatcgatcccctctcgctcgctctcgcctcacgcttctcaggagagagtcactcacttgaatgcgaggccagccacagccacagccagcgccctaatagctttcactttttgtcgcgcgcgggtttcaaggctttcctcctgatctcacttggcggcgtcacggcttgcgtgtgctggcgttttgctagctagctagccgtttgctgggctagctggcgcagcagcagcggcggacagcggagcgtccgtacgtcgccggtggctggatgcgccgcccgcgcggtggccgtggctgggctagctttagctgcgttgcatgcgttgccagtctctctctctctctctctctctctctgtaggaaacgcagaggaattaagtgggcatcctctgccgtttggagattgtactggaggttgtgcagttgtttcgatctgggtcgctcatctggaaagggacgggaagggagtagtatgtcacatggtttatgttgccactcggtttgtttctactagggtaggtaggttggagtggagtctacaagagtaatgattcgtctgacatctacgtttgtggactctagtacactgtattaattttgatacaccaagatttctattaaaattaatgctgctaaagaaaataaatctattccttgaatagagatgcacatatttatcaattatttgcacaagaagaggcatatctttatcatcttgtggctactttggcaactttaaatttcgaaaggagcaaataatgggcatttcaatttttcaccaagataaatgacactgctctagattatacgggtcatagtagggtgagcctggctaatcgaagtatgtgaggtggcaacactactctaaggtgaggtggcaacattgctctagggtgtagacgatgggtaaggcagggaggtacttggtactattaatcagatcaacggcagcaaatatgatactagttgtgtctctagccaatagtgttcaaaaaaattgttaagacatgtaggttgtcggtgatatgggaccgggagtatcgtgactagaggcttgaggcagacacaaccgcccacgtggcctggcaccttcggggacgtcgggcccgagggtgaggtgaccgccctcctcctgatttccccgagggggggtcgggtgactccagcctcgcccccgagggccgaggcgccccgacccctcgcgttttctactccacgtgtatgggttaggtgagcacagcagggctcacctaaccgcatttatcgcgcctctgctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcacgtcgtcagcacacagccaccttcccacgacgtgcccgcctcaggcagaagtggaggtaggtatgtgccgtcccatcaggaggattttcggaggacgaccgtgcaaatctccgtccatttatgaaaagaagaaaagtccagtttggaaagggaagggtgcatgtggtatccccttgaagtataaaaggaggaccttgcccatagaggggtggattctttcgagattcagagcctagaacgagggagaggtcggctcacactttgtagctccttcatacacagatccaccaaaacacaggagtagggtattacgcttctcagcggcccgaacctgtatacatcgcttgtgtttcatattctcttgaaaggtcgcgatctttccgtcatctacagagagagcttgagatctcaccctgagcccccggccgaaccggcaaaggggggcctgtgcggtctcccggtgaggggccacgagctccgtcataggtagtccattggatggtcaatatatactagtataggaataagccgataatcaagttctgacagagaatggcctctaatatgtgacatcacgtctagtaatattttatatacagtgtcatttagaattctagggcttacgtcaaactagctagttatgccaataaacgcactttacatcaaataattttccatgtaagaaacgtttttggccaacgaatactcgggtagatactagggcttacgtcgaactagttttggcgccaataattaatagtactgtgatataagtcatctgatgaatacattccacgtaagcaacgctttttttctaataagtcctagggtttgcgttgaactaattttgacgtgaaatccaaatttcctcaacttacttaaaacaatgaatctatatgatttttttttgtttctcgcattatacgatttctaataaacaaagcatcgattacaagattttcttttacaccagtggctaaaaaataagttcttaattaacctacctgctagattgtcattaagataatttattatctgacacttggttaccactgctcaatagcaaagaggttttaccttttggagcataacatgtcccctgtgactctagctaggcaatagaggtagaaacaatacaatcatggtgaaacgtgtaagtagtccattggtggtcaatatatactagtgtaggaacaaaccaacaatcaggttctgacacgaagactaatatgatacgtcacatctagtagggaaataacaccttaatttgtgccaatgaattttagggcttacgtcaaactagtttcgccaataagcgaaccaaattttgacacgaaggttctctagtgtgtacatctagtaactttccacttatacaatgttttttgccaaatagtgcggcggatagtagggtttacgtcaaactaggtttggcgccaataataatattgtgacattaagtcatctcctgcgaatactgattatatgtttcatgcatgcaaacaacactttttttgcccataaattctatggctttcgctgaactaattttggcgcgaaatcctaatttccacaactttgaacaattaacctagctatatgatttccaacaaccaaagcatcgggcacaagattttcttttacacaccgttggctaaacaaaaacaaaaaaaattaacccagttgcacatgtgaaacccagttaaacatccacatgcaagggcaccagacatgccagcaatgtgtgtacaatgcgagctccagatcgggtttctccgatgctgcaacagcaactgcaaactactgattctgtagagtataggccgagaccaacggtttgcatcctgaccgtgataatctcttttaattaagcaccaaattaaaacattcatatctagctatgcaccctcacttgcatcatcagttgcggctacctagcttgatatatatagtcgttaattaatcgtggtaggctggcacagcagccagagcagagcgagtgaacggggggaatcgcgtgtgtgccgcacggtgggcatgcagctgcgctacatacaatcaaagtcgttcatctggaaaggaacggaggagaccagcatgtgtatacaataatccgtaatttctttggcggccaaaaaccgctaaggttagcctgtaaactgccaaagcaatatatcttcacggccaactgtaaagtaagaaccgctaattatagagcaacagggaaatccctattttttaactgctaaccgtgagggagagttttattggtggtccatctcaacatactatacgtatagtgtatgttgtggtggcttacgaccgcatgatacttggatacacacatggtttatgctagccgcgtgtatgtctagtacttcaatttgttttcagggatactgggtagaaagggaaagtatataaaagtaaatgattttgatatctctaagttggaccctagtacaatatctattatattattaaaggaatagaaaaaggaatagaaaaaggagcttccacgttcgctttcacggcctagaaattctcacattaatcggagaaaaagaaaaaacagagtctatatagaaatacaatttagaaatagctgaaattcgaaattaaaaaataaggaatattagaagaggagactagagtccatatagaaatacaattaggaataactaaaattcggaattaaaaatagagaactgctagaccacggcatcctgctaaatgggatagattatgatgggttaataacgagttgttgcccccaccaaccgcgtccatgtgtccccacgcgtctgcatcgctttcccccacgcgtctgcatcgttcacccatacccttcacgtgtctgctactcccccacgtgtccatgcactggcatcaggtcccctgtctaataccaatctggcaccaatatctgatacgatacttgatacctgaggtaccagatctggttggtacctaaggtacaagatctagtactatgatatcagattcgatacttggggtaccaaacctggtacgcactgtcaggtaccaaatctggtaccagtgtttgatcagatacttgatacctgaggtatcagatctggttgatacgtgaggtaccagatctagtaccataggtatcagattagatgcttggggtaccgtttgatccgagacttcatacttgaggtatcatatctggttgatacctaaggtaccagatatagtaccataggtatcagatcagatgcttggggtaccgtttgatccgatacttgatacctgaggtatcatatctggttgatacctaaggtactagatctagtaccataggtatcagatcagatgcttggggtaccaaacctggtacccatggtactagggttggtggtacctggtctgatacccatgacgtatcaagaccagtagttgtatattaggcctggtacttaaaaaaaagtaccaaagcgtggtacctagcgcagcggtatcatctggtaccaaacaagttatcttcttcttcctctcgctaacacgttgtatcccaattagccgttgatccctaggcatgaaatgaaagcaacaaccaaaaaagaaagattgtgaatagatgcaggcaacaaactagtagaaaatccgtactctcatcttcctcctcctcgtggacatctagccccatgcagcctctgctgctgctgcactcctgtcggcttctcgaggatggtgctgatggccagctcaaatagggtgttacgatcgacgtggcaggggaacggctccgggtggctagtggctcgtgggtgcatagagggcgacacggagggatcagtgtgcgcgtagtgggtggtggatgacgttgtgtagacgatgagtcaagatgaggcgtggggcgttaggtgatcattagtctatcccgttaggacggtattccgttttatagattttctgttaaaaataaggaatattagaagtagagtatagagtccatatagaaatacaattaggaaatacctaaatttcgcaattaaaaataaggaatattagaagtagagtatatagtccatatagaaatacaattaggaaataactgaaattcggaattaaaaataaggaatattagaggtacaatatagagtccatatagaaatacaattaggaaataactgaaattcacaattaaaaataaggaatattagaagtagagtatagagtccatatagaaatacaattaggaaataatagaaatttggaattaaaaataaggaatattagaagtagagtatagagtccatatagaaatataattaagaaaaaaaatagaaattcggaattaaaaaaataaggaatattagaagtagagtatagagtttatataggaatttaaaattaacctaaactttggaataaacataataaaattaaagtagagtttagagtccgtataaaaatacaatttacaaatggaagaataacctagagtctatatagaaatgcattttacagataatgaaaattcagaattaaaaaaaagaaatattgaaagacgagtctagagtccatatggaaatataatttacaaataactaaaatttaatattaaaaataattaataactaacacgtatatataatacagtataaatattacacatgagtagtttcgtaaagttagtacaaaatttaaaattatattatcattttaatatttttaaataatacattgagaaagcatatatgctattacttaagagaaaatataatgatgctagtcgcgtaatctgtgcgggcctccatgctagttaattttgatataccaagatttctattaggaatgttgctgaggaaaataaagtcagctctgtttggacaactaggagatagaatagaaaacacattcctaagatacagatgcacatctctgtcatcttggggctctacatggcaattagtatctctttcatcatcaagcaatcatagggataaatgggtttttaatttttcaccgagacaatgccattgcttcatacaagacaatatatagccgcgagcagtacgtcgccggccacgtgtgccgcgcggtggccggactagctgcatgcgttaccagtcaggagattgtactggaggaggtgcagttgtttcgatctgatcgttcatctagaaagggatggcgaaggtgtagtgtgtcttgcggtggcttaagactgaggatggtttggattcacatggtttatgttttgcatctcttgttcaattctcgatttgtttctactggggtaggtgaggggaataaacaagactttgtgagacatctaaattggactctactgtatttattaattttgatctaccaagatttttttctaggaatgctggtgaggaaaataaatacaccttttatctgaataaaagagagagataatagaaggacattcctaagatagatatgatcatcttcatcaatcgatcaattgcaaactagatgcacatccgtgtgcctaatttggcgactttctttctcatcttggccgccggcgatggctgcggcgacgcatgtgatggccatgcgatgttggagaagacaccattggggaagaaggttgtcatgacaacatcatgggctatcaacaccgacttttctggttatggcacaactgttgcggtggtgagcttagtcgtcaccggtgccggtgccggtgcagctacggcagaggcagcgggtatgtatgacaccgggaaaatcaaagaatttggctctagtgacggtgccggtgcagatactaaataaaaagggccaccatttttatgcaactttgagctctcatgttattattgtagaacaaaagaactcacacacaacaatagataacacattaattcatgtcaacataattaatgtgtgaaacacacaacatgattggggagttctaaacaagaccaaagtatgggtaacacattttaaattcgtggtaaacaattaacacggaaaagtgtctaattgaccagaataggtttcaatagtttttgttcaatcataagaaactagataaacatgtttgctaaattacataatagcacaggtaaattaaaccagcgtcattacaagatgaatacaaacaacttagtaaattgactgatacatagcacgtcaactgaagctggtgctttctctgaatcatcgtcttcattcgtaattggatgatggttcgttgaggtcaaagtcaaacactatcggcctctcattcccagcagcaccttgggtcaacgaggatgcgacatcggtggcagcctgagccgacgaggagggaacgtcgatggcagcctgagctgatgaggaggggacgttgatgaaagcctgaaccgacgaggaagggacgtcgacagcggcttgagctgacaacgatgcgacgtcaacggctgcctgagccgacgaggatgcatcgtcagcagctagagacgacgaggtgtcaacgtcgaggagcattgacatcgagctcagcagcacgggctcgccctgctcaccgtcgggcacatcagcgaagaagatgtttggatcaaagtccagagcctcgtggacggcgtagtttgtcggcacaccgccaggagggatcaccacctggaagaaggaatcgctagccgccggcggtggcggcggcggtggcggcagcgcatgcgatggccctgcagtgtaggagaagataccgttggggaagagagttgccatgacaacttcatgggctgtcagaatccgcttttccggtaaaggcgtagctgctgcggttgcaagttcaggcgtcatcggagccggtggccgtgcaactacggcagaggcggtgagtgttgatgacaccgaggaaatcacagcatttggttccagtgactgtgaaggtcatgatactagataaaaagggcaccagtatctttatccagcagcaggactttcactactttcccaagtaaagctagtgttaagagactggattgtagaagtgttgactgacttgactggaaatataatatggaaagactgatggactgactttatacaactttaagctctcaggtgattattcttgatgatcaaaaaactcacacacaacaataaataacacattagttcatctcaacataattaatgtgtgaaacacacaacatgattggggtgttctaaacaagaaaaaagtatgggtaaaacacattataagttcatagtaaacaattaacatagaaaagtgtctaattgaccagaataggtttaatattttttgttcgatcataagaaactagataaacatgtttgctaaattacatgataacacaggtaaattaaaccaacgtcattacaagatggatacaaatgacttagtaaattgatggatacatagaagatcaaacgaagctggtgctttctctgaatcatcgtcttcattcgtaagtggatgctggttcgttgaggtcgaagtcaaacactatcggcctctcattcccagcagcaccttgggtcgacgaggatgcgacatcggcggcagcctgagccgacgaggagggaacatcgatggcagcctgagccgatgaggaggagacgtcgacgacagcctgaaccgacgaggaagggacgtcgacatcagcctgagctgacgatggtgcaacgtcaacggctgcctaagccgacgagggtgcatcatcggcagctagagacgatgaggtgtcaacgtcgaggagcgtcgacgtcgagctcagtagcacgggcacgtcctgctcaccgtcgggcacatcggcaaagaagatgttcggatcaaagtccggagcctcgtggacggcatagtttgtcggcacaccgccaggagggatcaccacctggaagaaggaatcgctagccgccggcggtggcggtggcgcatgcgatggcgatgtaggagaagacaccgttggggaagagagttgccatgacaacttcatgggctgtcagaaccggcttttccggtaaagtcgtagctgctgcggttgcgagctcaagttttgctggaaccggtggcggtgcagctgcgccagaggcagcgagtgtagaaggcaccggcgaaatcacaacatttggttgcattaacggtgcagttgctagtgctgatgcagatgcaggcaccaatgccggttctgtagcaggtgtgggtgccgacggcgatggagtacccacggtcaccgcagtcggaatgcgtccgcgtccgcgcccgcgcccattccaaactccacggccacgactagcaaaggttgcctcagcaacacgcccgcgtccgcgttccggtccaccgcttttggagagggttgaggctgtttggagcttcctcttcttgggtacaggtgcagcagctgcggctgcaactgcaggcggcggcatcgggaccaggatggcttcaggcaccgccgtcggcggtgccaccgccggtgcagcagcagaggcgcctggcgcgagtgtggatgaccccggcgaaatagtggcattcggctccattgttggtgctgatgcaggcaccggcactggagctgcagaaggtggcagtggagcacctgcggtcaccaccgccgaagtaagtccgcatccacgcccacgcccacggtttccacccgcaacggcggcatcggcaacacgtccgcgaccacgtgcacgtccacggccgcgctctccaccgcttgcgaagagggttgaggctgtctggagcttccttttcctatcgggtgcaggtgcagcaactgcggttgccgctgcaggcagtggcggcggtggcggcgggatcgcttcagctgccaccggcgccggtgcaaatgcggctgcagcagaagcgctggctgcgagtgtggacgacaccgtcgagatcggtgcaggtgcaggtgctgatacaagtgccttcgccggagtggcagcaggtatgggcgccggcggcggtggagcacccacgatcaccaccgtcggagcgcatttggtttcggacccacgcccatggccacgaccggcagcgttggcgatggcaacacatccgcgtccccgtccaagtccgtgctctctgctgcttgcagagagagttgcgggtgtagcaggcggtggtgcgagcgcttcaagagccgccagcgatggagccggtgccggtacagcataagcgggcgcgagtgcggatgacggcggagaaatgacagcattcggctccaccggcggcgcaggtgcatgcacagcaggtgtgggcaccggcagcggtggagcaaccacggtcaccgccgtcggagcgcatttgcctccgcgcccacgcccaccaccgccaccgcgcccatgtccggtaccgacaccgcggagaagtccacgcccaccaccaacaccgacactggcgccgcgcccgcttccccttccaccaacaaatgcaccttcatcagatgtggcaccggagcaacatcagatgatgccggtgcgcctgcaccgaaaccggagatgcatcagatgacgtcagcgctggcactggagccgcatcaaatgacggcggcacgggcacctgcaccataaccggagatgcataagatgacggcggcgctagcatcggagctgcatcagataacggaggcgcggccacctgcaccatcaccggagacacatcagacgaaggcggcggcacaggcagcaataggagaggagtaggagccggagcctcgtggacggtgtagtttgtctgtagactaccgagagggatcaccgccaggacgaaggtatggctagacggcggcggaggcggtggcggagcatgtgatggccctgcaatgtaggaaaaggcatcgttatggaagagggttgccatgacaacaacgtgagttgtcggcaccggcttttctagcaatggcgcagctgctgcagttgcgagttcatgcatcgttggagccggtgactgtgcagctgtggcagaggcggtgagtgtggatgacaccggggaaatcacagcatttggttccagtaacagtgaaggttaagatactatatataaaggtcaccaatttttatacaactttaagctctcaaagtgattattcttgatgatcaaaagaattcacatacaacaataaataacacatcagttcatctcacaataatgaatgtgtgaaacacacaacatgattggggagttctaaacaagaccaaagtatgggtaaaacacattttaaattcatggtaaacagttaacacggaaaagtgtctagttgaccaaaataggttcagttggcttacgatagtttttggtcgatcataagaaactagataaacatgtttgctaaattacatgataacacaagtaaattgaactaacgtcattacaaaatgttaacaaatgactaattaaattgatggatacatagcatatcaacaagatcatgcaataaagcaaaatggtcatgagggtcaagtaaaccaagagatctagttaaggatggtccttctcgttgtctccatctcattagtagataatccagttgatcgcgatagactcatcaatccgaagctagtgctttctatgaatcatcgtcttcattcataattgattgtcggttcattgaggtcaaagtaaaacactattggcctctcattcccagtagcaccttgggtcgacgaggatgagtcgtcatcggtagcttgagccgatgaggaggggacgtcgacgacagcctgagccaacaaggatgcgatgtggacggcagcctgaaccgacgagagtaagggacggtgactgcagcctgagtcgacgatgatgcgacgtcaatggtagcctgagcagacgaggatgcatcatcgggagccagagacggcgaggtggctagtaattggaaggagattgacttgcgagatgattcacctccatggattgttcaatggtgacgtcgggcgggtgtcaacaccgaggagcgtcgacatcgagctcagcaacatgcgctagctcatcctgctcaccatcaagcatgtcggcgaagaagatgttcgatcaggtcgaagtcaggagcctcgtggacggcgtaatttgtctgcagactgccgggagggatcaccgcctggaggaagatattgctggacgtcggcggtggagacgacgacgcttgtgatggccctgcgatgtaggagaaaacatcattggggaagtgggttgccatgacaacatcgtgaattgtcaacaccggcttttctagcaatggcgcagctgctgcggttgcgagttcaggtgtcatcggagccggtggtcgtgcagctacggcagaggtggtgagtgttgatgataccggggaaatcacaacatttggttccagtgactgtgaaggtgatgatactagataaaaagggaaccattttgtacaactttgagctctcaggtgattattcttgatgataaacaaactcacacacaacaataaatcatttggtcgttaacaataacacattagttcatctcaacataattaatgtgtgaaacacacaacatgattggggtattctaaacaagacaaaagtatgggtaaaacacattataaattcatgctaaacaattaacacaaaaaagtgtctaattgaccagaataggtttcaatagtttttgttcgatcataagaaactagataaacatgtttgctaaattacatgataacacaggtaaattaaaccaacgtcattacaagatggatacaatcgacttagtaaattatcggatacattgcagatcacccgaagctggtgctttctttgaatcatcgtcttcattcgaaattggatgctggttcgttgaggtcgaagtcgaacattatcggcctctcattcccagcagcaccttgggtcgacgaggatgcaacatcagtggcagcctgagccaatgaggcgggaacgtcaatggcagcctgagccgatgaggaggggatgtcgacgacagccagaaccgacgaggaagggacatcgatggcagcctgagctgacgatgatgcgacgtcaacggctgcctgagccgacgaggctgcatcgtcggcaaccagagtcaatgagttgtcaatgtcaaggagcgtcgatgtcaagctcagcaacacgagctcgtcctgctccccgtcgggcacatcggcgaagaagacgtttgggtcaaagtccggagcctcatgtatggcgtagtttgtcggcacaccgccgggagggatcacctcctggaagaaggaaccgctagccaccggcggtggcggcgcatgtgatgacccggcagtgtaggagaagacaccgttggggaagagtgttgccatgacaacgtcatgggctgtcagcaccggcttttccggtaaaggcgccgctgctgcggttgtgagctcaggtatcgccggcaccggtggccatgcagctacgccagaggcagcaagtgtgggcggcaccggtgaaatcacaacatttgactgtattaacggtgcagttgctgatgctggtgcaggtgtgggcgccgacggcgatggagtacccacggtcacctcagtcggaatgcgtccgcgtccgcgcccgcgcacactccaaactccacggccacgaccgacaaaggttgcctcggcaacacgcccgcgtcctcgtcctggtccaccacttccggagagggttgaggctgtccggaccttcctcttcttgggtacaggtgcagcagctgcggctgcggctgcaggcggcggcatcgggatcaagatcgcttcaagcgccgccgccggcggtgccaccgccggtgcagctgcagctgcagcagaggcgcctggcgcgagtgtggatgacacgaccggcgcaataatgtcattcggctccagtgatggtgctgatgcaggcgccggtgctggagctgcagaaggcggcggtggagcacccacggtcaccaccgctggagttagtccgcatccgcgcccacgcccacggctgccaccggcaatggcggcatcggcaacacgtccgcggccgcgtgcacgtccacgtccgcgctctccaccgcttgaggagaggcttgaggcagtcaggagcttccttttcctttcagctgcaggtgcagcagctgtgcttgccgcagcaggcaatggcggcggcgggatcacttcagctgccgccggcgctggcgccggtgcaaatgcagctgcagcagaggcgctggctgcgagtaccggcgagatcacagaactcggtgcaggtgcaggtgctgatacgaacgccttcgccggagctgcagcaggtgtgcgcgcctgcggcggtggagcacccacggtcaccgccgtcggagcgcgtttggctccgctcccacgcccacggccgcggccggcgaccgcagcgttcgcgatggcaacacatccgcgctctccgccgcttgcggagagggatgcaggtgcagcaggtggcggcggcgcgagcgcttcaagagccgccggtgctggagccggcgccggcgcagcataagcgggcgcgattgacgctggagaaacgagagcatccggctccaccgacagcgcaggtgcatgtgcagctgctgatgcaggcgccagcgtcggggctgctgcacctgcagcaggtgtgggcaccggcggcggtggagcaaccacggtcaccgccgtcgtcggagcgcgtttgcctccgcgcccacgcccgccaccgccaccgcgcccaagtccacggccgccaccaacaccggcaccggcgccgcgtccccgtccaccaacaaatgcagcttcatcagatccagatgacgtcggagctggcacctgcaccggcaccggcaccagagcaacatcagatgacggcggcgcgggcacctgcaccggcaccggagatgcatcagataacgtcggcgctggcaccggagctgcatcagatgacggcggcacgggcacctgcacaatcaccggagatgcatcagataacagcgtcgctggcacaggagctgcatcagatgacgacggaggcgctgccacctgcaccgtcaccggagacacatcagacgaaggcggcggcgcaggcagcaacaggagaggagcaggagcaggagcctcgctcgcctccgcctctgccgccgccgccccacgttcctccaccacacgctcgcggcgagctcgagctcggtcgaagaacgctagcatggaccgcatctccgccgaaagcggcgacggcgtctgcgcgggatcgccgaagttggtcgccgccgcctccccgcgcagcacccgcgccgccgcgtcgtacgcccacgccccctgctccgccgtgtcgaacgtccccagccacagccgcccggcccccgtcgggttgtggatctcggcgacatacctcgtcccaaacctcaccctcaccccacgatacttcgtctccgggtcaatctcctcccactcctccgccgccgcctgacgacgccagcgccgccgctccacggcggggacgacgcgaacctcgccctccaccaacggcgaaaccaaaacctccgccgacgccgacgacgacaccacctgatccccctccatgacgggcacaatcacgagctccaacccggaaccggccctcaacctctccctctccccgggcgacagcagaaatccgccgccgccgcccgcggcggcggcgcggcggtactcgttcccccgtacctgcacggcgaggcgcgccgactgctgggagtactccaccagcaagcctttcatcgcctccgctactctctcctccggatccattcctgcgacctactcgatcgagactcgtgagagattgtgtggagagagaggaagaagagatcgatggcgatggagatcgatggatggcgaaatgggggtggcggcgtgtgggatttaaggaggaggagagggggggggggggagcgtgtccgggcgtcgtcgcggcgtcttcaagccgagagctaggtcacgctggggttgcctttgctgccgtcgtcgcgtcgtcttcaagccgttgtgacgcacgcgggcgtatgcggacagctagcgtgggctgtgcttgcatggctgcatgcgtcaaccagtggactcgatcctctggtttagggaaggaacttgaggggatgcggttggttcgatctggaccgttgatcgtgaaagggacgatgagcggtggttagcggtgatgttttgggttgccgttttggcttttttttttctttttctttttcttttttgtgcggggaatatgtgcttagccggaagcgtgagggtttgcggggaatatctcctatcttaatcttcctatctagccagcagaaggttgtcagggcaggtaattaatgtggtggggttgttaatgtgttgctaaacatggacgtgctgcagtaattagctgcctagatcagcaaggtttgaaggtttagctttgatggatcagggcagtaccgttgatcggattgagaacatagttttcttgtttccttttctttatgacttatcgatatgcttcctccttataaaggataatcaatttctagctatgaacatggacaagcatttgtccaagttcatatatagctgggaattgatttttttcaaatggagggtgtaggctgatgacttgtatgtttctttttttttctttgtccgaattgcaatagtgttgagaaaatttggggaatgtgaactaggtgatgtataagttgattaattcatgatcaaataacgtcatagtcgtgttataatgttgtgtgtgttccattatttacaaatataatcgatgtcgatttatgcgtgtggcactattaaattatgtccgtatacgacatcgattcctcatgcgcttactaggtttaaacacaatattctatgccatcatcctcttctctttcgtcctacatttatccccctttataaatttatttctaacctataagaatcatcctaaaaaaagttcatttagggcccctttgaaacgcaggataggaaaaacatctagatttttcacattttggtccttttgaaaaacttatttcgcaaatagacccttgaaaaaacttatcccagaaatggtcctttttggggcgcc

SEQ ID NO: 73179 - DNA, 25166 bp, Oryza sativa
cagtcggcagcggcgaaggcaagccgatcggtgaagacgtagacgcccaacaacagcggcataaagaccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtagacacccaacaacggcggcataaaaggccagccgtgcaggcggaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatagcggaagtggccaatgtgggaacaaagtcgtccatcaataacaatgaagacaccagtcggcggcgacgaaggcggtcgacggtgaaagcgaagatgcccactaatggcggcataataggtcagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaatagcggcggcataataggccagccgtgtaggcggaggcaccaatcggcggcgacggaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcggaggcaccaatcggcggcgatggaggcgggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatttgagattaaaaatcaacatgataaataatgataaaaatcagattgagtttccccctgactgatttggatcaagtcagagaagaggagcttgaagaagtgatcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacaggtctctctatgttcttatccttaaaaaaaatcaatgatagtttctagatatgaacgtggataaccatacttgtctgatttatagttaggaattgacttttttttaagaatgtgtaggttgatacttgataacttgtatctttcctctctcttttttactttgtgataaacactagttttgtgtgcgaattgcaattaatagtgttgagaaatgtggacaatgtgaactgggtcatggataaatttgattcaagatcacaggattaatgtcatcatagtgttagaatgtggtgtgtggtccagtacttaaaaatgggcgtaatttcccgctatcggcttggcttatgggtgtggcactattaaattatgtcgttatacggcggcaattaattccctatataagcgcctatatagtaggctctaaacgcatcatcctacaccctcacctcttcctcttgctgcctcaccggcattctcctctcctgcaagatccctcgttcctctcctttcatcctcctcactttttgtacattgttcattcaaatcaataccatatgaatcatcttttgttgttaaaagggtgctaccggtgggtggtttattttatcccagtgtgcactcatcgggtgctcaaattaaatttaacatgtgacaagatgcaaagaggacatgcaagcttagctccccatcatccatcaacaaatgcaagtgcatggtatggatctcaacataactgaggaaaacacaatttattcgattttgacttgcttgttttcatatagagggatttataaaaatttactacctccattctaaaataggttcactcttattctctagcatttatccccaaataagtaatttatatcgcctacgtaccctcgaccataaatctaggagttctatcattacctcttatctatctaccaaccaacagtattctattaatgagggtcaccttgttttttttttctcttcatactaattttgaatcataatgattagaaattaatttattttggatcaggggtggtagtattgactattgtttggtttcaatttcgttcctactcatgaaataaactttcaagatcatcttctatgtttttttacgggacttgttcctatatctttttgtccataaaaattacatcttcaattttatgaaatcaaactccatatgtacaataacacgatctatctattctgcgtataaccacaaatttgttcaacaactatcaaaataataatatagcaaaatgatagttgcaatggtactattgtaggtttatctctgcatatctcttacattaaataagtacatatcttatcttatcttatcttctaaggtgtgatttggtttgaatttattctacagttaattttcaatatacatctattgctatgtatcgcagttaaatgatactaggatgacaaccaaccatgtcataaataagagtaactgaagttgctaatgtctactggctagaataaacgaatatatatatctttttgaatttaaccttaatagcagtagacacctaaaaacaaacgataaattaatacaaactttttgtcacatacatgcattgtcctaccaattttactttgattctaaaaacttcgcgcaacatgaccaacttaattacaccaaactgtagaggtgcgggccaagaacaatgtatatgcagtattctttttctcaagaattaacaaagctttatattgttttgttttgtacccctctttattgtctcactcctagcttttactagtccctttttttttgtggagttagcatatttctttcttgcttaaattaagtacaaacgaccaaaccactttgatgttttgtggtgtgggggttttctcggcaagacccagcgtagcatgcttgaatgaagtcatatggtgtttggtacagtagatggtgatatggtgtatttttctgtttaagtgtattaaaaattatgtgtataatattttgttttaaatttgatagtagtatgtaatgtgcatgttaattgagttgaattctatgcaaaccttctgttttttttattctgtgtttcatttgtttatagatctttaatagtttgggctggcaagttgcatccagcagaaacttctgttccttcggtgtttcctgccatcacctcttccatcttcattgccaccccatgttatatatgtttgcaccttggccccccttccttagcgtcaatgtccctgctttgttttcgatccttgagtattgcctgacaaaggttaccaaccttcactctcttatttctcgtgcgcacgctttccaaactactaaacaatatattttgattaaaaaatttataaaaaaagttactgtagaaaattacactaatctatttttaagttttttaactaatacttaattaatcatgtgttaatccatcctttcattttacatgcggaaggtgctctgttaaagaagtgttgccaatgtacttatcagctccatttcctagtactcacttagtcatggaggcagctgtactatgaaagggatgaagtgaaagtggatgaaagcttgccctagtgacgggggaggggggagctagcgggtgcgggtgttgatggggaagacggaaaagggatggctggaaagcaaaagatttgaagcaccatgctgtcttagagcaactccaacaatctatctatctggtttggatcggtaaaaaaaaacaaaacgagtcaaaaccggggtccagcacactcggtatctcgctccgctcgcgatcccgttcggcatccgtcacccctcgtcctgcatatttgcaatgaccatcccgctcgcaatcgcctctctcccgcgcacgcgctcgtttcccgcccgcgcgctcccgcccaatcggtcccgccgcctcgccctcccgccgtgctacgccgtcgcacctgtcccgccgtcccgcgccctcgccgtcccgcgccgtcgtcggtcccgccgtctagcgcccccgcccttccgccgtcgcgccgctccggccccggccttcgtctcgccatgtggaggccgctgcgtcctgcttcaacggcggctagggacttggatcaggatgctcatcgcccggaatgggacttggatcagtcgggtattggatcgatgcgccatcgggtggttcctccaataggcgtcgatggttggaaggcacaaggtctgttcatcggtgagcaagtcaccgatgaggaggtctgcacaggtgagactcactatctacgtctgtcaaaccctttgctgttagttggatgactagatcacaggaagtttagctcgttatgtattctacctgaggattttgggattgcattcatgttggttgtaggtttctggaaataaaattgatgtctttcttcgcacctgaccagagtagctacttgttagtacagtacatttgaatgaaagattcatccagatcaaattgcttcttctttgcaagtaaataaacaggacctaccctgagtctcgttttgctataaatcttccatcctgcattcacatcacaataatttccacaaaataagatagtttacaattgcaagagagtaggtaaattaaaaggataatactctgttatttacattgctgcaaatgtccacattgcatataattttattcagctcgatagtagttacattactacaattgtctggtttgcatatcatgttattcagccagagttcccatgcaaatcttgagcttcccatgccctgaaatgctgaatggaaccagtggtgtagttgctttccctattgccggcttacagtcctacatgatgtttattctccatttattttcctgtgacagatggtacgcaatcagtttatttcactgacctcctagtaaatgatgttgatgaatctcaatttgccgcacctactagtgatccaatctccaatggagctccaacagctgccaagatttctcagggtaggaccaaaaatttcactactcaggaggacatccttcttgtgtcagcttggctgaatgtgggcatggatcctattcaaggagtagatcaatcacaaggcacatattgggcaagaatacatgaatatttccatgccaacaaagagtttgagtcaacgcgttctgaatcctctttattgaatcgttggtccgcaatacaacatgatgtgaatattttctgtggatgtatgtccagaatagaggctaggaaccagagtggttccagagttgatgacaaggtaaacacattatttttgtggtatgattatttgtcgcagtttttagttctcatgtttattttggtttcaaatgtgcagatcgcaaatgcatgtgaattgtttaaggaggaagacaagaagcataggaagtttaacttgatgcattgctggaatatcctgaaggacaagcccaagtggatggacaatcggaagaaagttggatgtgccaaaaaaccaagcaataagaaacagaagacagtggcaaattcaagtcctacatcagttgaacctgctgatcttgatgtctattgttctgatgctcaaccatctgtaagaccggatggaaagaaggcggcaaaacagaagctacgacagggtagaaccatagaagcagtggactatctgatggaaaagaagaaagaagctgatgttgtgagagagttgaagaaagaagagatgtgcaagaaagcctttgctctgcaggaagagaggtgcaagagagcctttgctctgcaggaagaacggaacaaattggagagagaaaagtttgagttccagaagaaagaagctgagaaggctgagaaggtggaagaggagagaattctaggtttggatttgagcacaatgaactaaaatcagcagaaatattatgaatggcgtcagaacgagattctcgctcgacgttgcaatatctagaagttcagctcgtagcgtagttcagtttctgaatgttcagcgtccagtgtctgtgtgttcagttctgttctaaatgtttagacttcagagtctgtgttcagttctgttctaaatgttcagacttcagagtctagagtctgtgtcgaagttcagtgtctatgtgtgtggcagtatgtgtgatatagtatggtcctaatttcagacggacaacattatgtgtgcggcagtttatgtttgaacttcagtttcagggtcatgctattatccctgcttcattatcctgcaccctttcatttccttggtctgccatcgataaatacaggttataaaaaataacattgtacaagccaatatgtccaaagctgccaaaaaaatttcatagaattgcacagcctttatgcatatgatacgtcctctttttctaaatgtccaaactgggacttacaaaatgcaaagcatatttcaaataaaaagttttcagatgttttatgttctgcgtctagagaatgataagaatcaatagggataaacctcttttggacaacaatctcataaatgggacgcattaatctatatgatataaatctccatggttttgccacaagtgctcgatgaggtctacctgaagctgagtgtgggtttccttgttcttcattttttttttgtaattctgaatgaaagcttatagttcaggtgtgtcacgccctgaactagccccgaacggaaccagcccgtgacgctccaaattaacctgttaaccgataccagtcccaggaaatagagctggtatcataggaagacagaatatcacagcaacagaggtctctttattatagagtaggagtacagtcatgttgggctgcggacagaccccgagctcacaactgcattacaaaagaggaaagcggaagccaagacttggacctaacatcacaggcgcgacttgggaaccagatcgaaaccctataactcatcatagccgacttgttcctggaagaactcctcgtcagcgggatccatctcatcttcttcagccactggggaggattatttatatagagcaagggtgagtacaggagtactcagcaagtcatggcaattatgtgtttaatgaaggcttcaaaggaaaggctgttgtttttacaattgattttttagttaaactcctttttaaaacaactaagtgagtgcttctcaaacgacacggatgagacagtgcatctcgtccgatcggagtatgtgcaatgtatcagtctttgattgattcaagattggcacccggccacaactttcaaacggccagccgggcctagctgatcccgtcagctacagatgttccaaacatcgaacccaaattcccaacataattcaccaagcagtagtcgaacaaaactacgctaaggaatcaccttacatccgcccatgaccgtgggcacggctgttcgaacagtttaataacctctgcagagggggcacactttacccacacgacattactaacccggatcacccagcccgtggagaacagccacgtctggtgaccttaaggctttcatggcaatgcatttcgagagctggtacaggtttaccatatgccgacgagaggggtcgcagaccaacaacaggttaggtcccagaccatactgtgccaggaagcccaggggtcctccccgacaccaccctggcgaatccacttgtcttactctttaaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcgcacagatcccaaacaaccctttgagcatgttgatcccgtttaaagctattgtttctattcaactattgcaattattttcgaatgtcattgggtggaattaacctattgtttgttatagcccttttgttcttgattactttattccttgataccttgggttattataacttgactagttgggctttatatattggttcagctagatattagatatgattgcttagccatgcttagaaacattagcacactattgagataatttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcgaagataagcccacgggagttgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcttggtttggaatggtacattcctggtttggagatagaactgtgcagccgggatggttgttcagaatggttgggcctatacaacagggtatgttgtatagcgttggattaatattgtttaattactacttaactattttattaaattctaaaatgtttattaaatgatgtttatgcaaatgaaaccctactatgccatcctttgttatcctgtgcacttgcatatttgctgcgtggcttgctgagtatgtcatatactcaccttgtaatcattcatcagcggaggagttctacagtgatgctgatggtgtggaggattaggtgtagccctggtcgagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagtagtcgaagcggaacactgtggaagagccaacaacacgcttccgtgcagtgcggatgaagcgtgggccacggtggaaggaagcaactggagtgtgtccgggggtgtaggagggactaactgggtgtgggtagggagagtacactggtgagtacggcgcacgcgagctaggggagcgcgggccactgggagtgcgagcagagccgcgggagctgtgggaagacaggtggctggcgtggcagaggcggctggagtcccaagaggtagtgtcaactgaggtgacaccctcctcggccaggcgggcctcaagtgcagcgtagcggcgtgcaagggagcggtaagcctcaaggagtaggtcgtgctaagtggcctgagcctcagaaagctcaaccatgcgagtcagcacgggctgagactcgcggtacagacaagggtacctggtgtcagtgcggcctgaaggaagccgtggaagctgccgaaagacggagcccccgaggcggtggctgtagtcgtgggccaaacgatgaatcgccgtccaggagaggtcctggtacgcgatctggagagtgggcctggccacattgaagtggtgtgggcgaaggccagccccgtgtatacctccacgagggtaaaggtacaccgaaagctcacaacgaggggggacacggtccacagagtaccccgtgtactcgggacacgagaagccaaggaagcgggtgaggtcacgaagctgagcgacgtggtgaccatcaccaaagccgtgggaactgaagctggcgttcactgccatctacaattttgaaacagggagaaaagatcagtaaccattttagaaataaactactgaaagaaaggaaacaaaagaagccttagctttttgcaagtatttttgaacttagcatccttagagtcgtcctaaacgttgggtttcgctatagggccaagcctgtgctctgataccatcttttgtcacaccccgaactagccccgaacggaaccagcccgtgacgctccaaattaacctgttaaccgataccagtcccaggaaatagagctggtatcacaggaagacagaatatcacagtaacagaggtctctttattatagagtaggagtacagtcatgttgggctgcggacagaccccgagctcacaactgcatcacaaaagaggaaagcggaagccaagacttggacctaacatcacaggcgcgacttgggaaccagatcgaaaccctaaaactcatcatagccgacttgctcctggaagaactcctcgtcagcggggtccatctcatcttctttagccactggggggaggattatttatatagagcataggtgagtacaggtgtactcagcaagtcatggaaattatgtgtttaatgaaggcttcaaaggaaaggctgttgtttttacaattgatttttagttaaactcctttttaaaacaactaagtgagtgcttctcaaatgatacggatgagacagtgcatctcgtccggtcggagtatgtgcaatgtatcagtctttgattgattcaagattggcacccggccacaactttcaaacggccagccgggcctagctgatcccatcggctacaaatgttccaaacatcgaacccgaattcccaacagcaatttcaccaagcagtagtcgaacaaaactacgctaaggaatcaccttacatccgcccatgaccgtggccacggctgttcgaacagtttaataacctctgtagagggggcacactttacccacacgacattactaacccggatcacctagcccgtggagaacagccacgtctggtgaccttaaggctttcatgacaaggcattttgagagccgacacaggtttaccatatgccgacgagaggggtcgcagaccaacaacaggttaggtcccagaccatactgtgccaggaagcccagggctcctccccgacaccaccctggtgaatccacttgtctcccggcatcaaggctcccctgattagctaattactcagccaggggtgtcccattccatccatgtggtcgtacttgttatatgttcggatgaaattctaaaggaataggtccttaagtgcaagagcgggaaaccgtgctcccgacacgtcccccggtctgtgatttttggaaattcatttagttcgcaagcaccgacccaggcgtcgggtttttccaagtcttttgtaaaacccaagttttacccattgttggatattttaaatttgaggggaggactccaatgtgcgtgcccgaaggcccatcgaagtacaacagtcgacaaaggaggtttaagtgttcaataattcaaggagggtaattgcagcaattaggattggggccggtaggctatctcgcaagccgcggccaaatttcttgtgttaatcctatccatgcattatttgcggaaaagaaatacttatatttaaattttaggtgcaagatgatcaaaggtgacttgccttgctcgagatcttgagcttgatcctcgaaatccgcgcactccgagtcttcgggctccgaagctacacgcgaacgagacgactcaacaaacggcaaaattaaagccctattattgacctctaagcgtgccattgggtagatctcgagatttgaggatttttggaagttgaacagagtcagatggatgtacggttgagaagatattgaatttctaagattattggatttttggtctaaaggaaaaaggatttaattaaaccctttgaaaaagaaaagaaagagggaggaggaacagacttccctcgggcggctagggtgcggcccgagagaaggggcgcggctcggccgagctaatgggccggccggcccgagaaggcgacccaaaggcacgcgcggggagagggggaggggaaccggtgggctgggtccacctcgcgtggtcccgagtaggacccgcttgtcggcggctcggctcaccgtgagcgaggtgcatgcggcgcggcgctagggttggggtgggtgcggtgcacgcgtgtggcttgcggtggacacggcgcgcaagtggcccacgcgtagcctatcggctctccgtgggccgcgcgcacgcgagcggggatggaggaagcggctgaacggggtcggcttgacccggtccggccgagctagcgccgacgtggcgccttcgtggctgccacgcgggccggcgggaggaagacgaaggcgccgaccgcgaatggacggcgggcggcggcggtttctccgggacgccgtgcgatgacgagggtgacggggtgtacaccggaatgacaaggggaaaagagagggagcgagccaacggctcggattcgccggagggagctcgacggcggcggattgctgcggcggcaaccggcggcgagaaagggggaaatcggcgacagcgtgacgggagatcgattcgggcgagctagagcatctacgcgactccgggaatccgtttctagcgtcggattggacggaacatcgccgacgaaggccggcgacgggcggctactaccgagcgcggcggtgacggcggcgagcctactgcgagcggcggcagcagtcggagcggcacaggctagctacggggaggctacacaagctactgctcgagtctaaggggaggaggaagagcgaggagggagaacggggggggtgttctaccgagacgagacggggtgctgtgacgagaggccgacggcatgggagtgatctctccggcctcgggccggggaagaggaagaagatgagcgcccggagtccccttccgatcctagcgcgcaccggctcctccagtgcacgcgacggcgaagggcgacggcgaacagggcacggggcgaggcgacaatggcggaaggcgaaagcgagggagatgggtttgggggaggggatcgggtttatagggcggctatgtcggttcagaaaccgaccttgggcggtcaagccagcgagctagcgccccggctagcggccaaaacggcgacagggaggatgacgccggcggtggaagagaaaagggaaaaaggaagaaagaaagggggcttgccccttgcttctttgggaaaagaaggagggagagagggcgacgaggcaggaggaggaggagctctgcctccatcccttggaagctagcgcgcggagtggcggggccgggtcgatgacgacggcgatgatggtggggcggtttggaagggcgcggctacagggcggcagatgcgggctcaggcgcggaaggcgctgacaacggcggcggcgacttgccggtcggccacctcggcgcgcgcgcacgggaagcaatgggtggtgcggcgatttgagcagcgtcggcgggaagcggcaacgagagcagagagggagggagaagtgaaagagagagagcgagctctctctctctctcgctcagcgcccaagcggcgcacgttcctcacacgtgcgggcaaggatggaggggagaggagagttgggctgaggaggaaatgggccggggagaagagatcggcccacgaactcgagggaggcaaaatagacttttcgagaggatttgatttgggatggatttgagattagggtttggatttcgacgatggattggagaattgagatctggaatggcacggacactagacaacaaacaaggagacaattttcgcatttaggatttttaagagatagttttcccactaggcgccacgacggaacggacgctacaaggtgcatcatcatgggacactgacaccctttctcccatgtcgtcgtagttgcaaacatattggcctttattgttgaagttgtattcgtagtcatctcgctcatcttcaacaatcatgttatgcataatgatgcaagccatcattatatcatggagcgtgtcttcatcccacatacgagccgccccacgaacaattgcaaagcaagattgtagaaccccaaatgccctttcaacatcctttcgacaagcttctcgtgcctttgcaaagtattttttcttattaccttgtggctctggaatggtcttcacaaaagttgcccacgatggatatatcccatctgcaagataataacccatcgaatattcatgaccattgatgtcaaaattaacttgtggaccttctccctcagcgagccttgcaaatatatctgatcgttgaagcacattaatgtcattgtgtgaacctggcatgccaaagaatgcatgccatatccatagatctttagatgcaactgcttccagtataattgtaggctcctttttatagcccctatacatcccgtgccatgcagtaggacaattcttctagctccaatgcatacaatctatggaacctagcataccaggaaatcctctgctcgctccaattgtaagtaacctagcagcatcctgttcattaggcttcctcatgtactctggcccaaaaacctcaacaactgctgcaacaaactttctcaaagcttctagagcggtgctctcaccaatacgaatgtactcgtccaaagcatcagctggtactccataagccaacatacggaaagccgctactaccttctgcagacaagataatccgagcacaccggctgcattcctcttctgcttaaaataatcgtcatgttcctcaacagctttcattatgcgaagaaatacatgaagcctcatccgaaacctatatcatgatgcaattaaattaaattagcaatactataaaacacggcacataaaaattacataaacattatagagaacatgcgaacctgcgtctaaagatgtttggtccaaacgttggattatctgagaaatagtctttgtaaagaagattgtgccacaatagtctatcccgatgcactacctcatgtccctgaacagatccaattcgacccagattatttactgattcctcaatgatcatttacgcagcaccaaaaaatagatcatgctcctcattcgacgaagagggatcaatcaattcgttcattacgaactcattaaattcatcatcagactccataccctgcacgcaagagtgatcaatttctactgatgttaattgaattcacgcaagattgcagtaccaatcttcctctacatggcgatagtgcacgcacctgttggatgagtggccggcggcggcgtgatgacgcaacaaggaggcgcgcggcatgcataaacgatctgccgccggcgacgcggtgcaacgagaggcagcgacgtgcagaaggaagcagccggctgtgaacgacgtccaagcgatggccggaaaccagcggcggcagcggagaaacgagaagtcgcggagtcaaccggtccggaagaacgggagccgtgacgtggacccttttgaatatggagagtcaatatttagctaggctgttggttttacccctctgtttgggatcttttttcctttttacagacctctttactctctaaacttagctaatcatatacataatctcttggagttgcaaataggttgtaagaagaatgcccccacgatgaccttggtccacacagagttatttttccctttgacagaagctgaatatcatggcatagcatcctactatttccaggatgaactgacaaatgccggtgtattcgaagggcgtacttgcgcaactgatgcaggccagtagtttggcagcttctaaaattttgttcattctgctagtgcatcaaaggaggttgcgttttcttctcaaacattgttagtgatctgcaacagactttgggttcacacgatagggctgaagtgttcgtacaggggtgtcatttctgatcatcaatatggcatgagtcattttacacatgttctttcttctgttttattcgatagcttacactcatacaatttagttttggaaagaattaatatataacctgttgcatgctcatgattctctcataaaaaatatgtgcccataagtagcgaaagaactcctctacacattatcttcctaacttgttcacatgtaaatgccatcctacaagttggccaaaatggacaatgtcggtcatgggcctcacctttttaagtacttcatgacaagaaacaagatacccaatatagcaccgtgcactttgtttctgtgctcctcagatagctattcgattcttggaaatccttaggctacccaccatagtaacataaaatcctacataatttcatggctaggattctttatctaatcaatttggtggttcttttccttggctttaatctgcacagagctctctcatggaggaaccaaagttacatgaatgatatcgctgatcgatgtgccccttcaccccatcctttaagtatgtgccagtcacgagcagcagcttttggctatccatgtgaagaatacaaggtacgactacatcttagtcctgtatggttcgcttctgtaagaaaaaactcatttttataaagtatacggcatgacttgcaggtcacaacagaagatggctacattcttagtttaaagaggattccccatggtcctcatgactctaacacctcgactgagatgaggccaccggtactgcttttccatggacttatggtggtaaggacattgttgtaccaatcttgtgccatctgtgctctcatcatacctgaatcaagtgtgttgtttggacaggatggtgctacttgggtaatgagtactccaaaacaatcacttggatttattttggcagacaatggatttgatgtttggattgccaatagtcgtggaacaaattccagccggaaccatacctcactctccacaaaagatccggttctcatctcaagctttatcaagatttaatttgccatagaattatactaaaagcatgttgggtactcttttcaggcttactgggaatggtcgtgggacgaacttgcttcctacgatcttcctgcagtgctgcagtttgcctatgatcacacaggcgagaaaatccactatatcggtcactccctggtgagctcatatgtgccacttgaaaatgtcaattactagacacttctgccttttcagtgatgctgtaaaaaaaattgctacttgcatttttctagggaaccttgatgattcttgcagccttctctgagcacaagttactagatgtagtgcgatcagctgttttgctctgcccaatagcttatctgagcaggacgaaatccaaactccttaagcttgctgctcacatcttccttgcagaagtaaaatgctgtaaactttcttgttcttattgttactggcagatcatggttgattctatttatctctttgtttgtcttgtgcagacagttcactggctaggcttttacgagttcaatcctgttgggtaggcacttccacaaaacttctaatgtacttgaaaaaaaaaatcagtaaatgtacttcaatgccaagttcttgcttgtagtttttgcatatcacagcaactctattaattaccagtagagatgcccatacttgtaactcataacgtgactatcgtatcatggaacgatgtgtcactgtcaccaaatttgctattgctatatagggatagtctacagtttatactggtattttggataactaggcccaaatgtgattgtgcttacttaaagccgtaagcattgactactatgggtgtcctgctgcatgacaggccagttgcacatgaagttctaagccaaatatgcggcgatcctgaaattaattgctatgatctattttcggctgtagcaggtattttttttctttcctccaatttaccacgccctaaacaatatgtgatattaagctcatcctagtaacaccaattgcatggatttgattttgtgactgaaggaccagattgctgcctcaatacttcaaccttttgtgcctttctagagcatgctccacagtctacctccgtcagaaacctcgttcacttgtcgcagcgtaagaacctcttatcagaaatatttttaaggatgttattcttcaaacctctgtcacatcactcactcttctatttcctgatctaccttccaaaacagtggtaagaaatggaggtgtcagcaggttcgactacggcaacgccaaggataacatgaagcattacaaccagccacgcccaccgccgtacaacctctcctccattccgaatcatgtccccatcttcctcacccatggtggcgaggactacctcggcgatgtccccgacacaaggcacctcctgaggacgctggtcaagaagcacaacagcgacagcatcgaggtgatctacgtgccagactacgcgcatgccgactttatcatggcctacaatgctccagaactcatatacggaccgatggtcgacttctttaagcgtcactgaaaccagatccaccagatttcaccattggctgtatgcattgccaaagtagcagctgtatgacaagtttcagcattgaagatttcagtctcactgagcttgcatccatcagtacatctttgtcatgtcaaagtatatatgtcagttccaccatgctagataacacgaaaataaaggatttgataaattgttactcgatctcgttgtaatcacaatgttcttgattcactggtctcttgcaaaaaatgaatatggccaacctaatttgtttttgtaccattaattcttattttctattgtctatcagatctattgcttctagcaacaaatccaatcagatgtgttgtgatgttgatagttgagatgctgccatcaaaaagagatggagtatctgaattgggcgctacagccgccagaattgctaggaggtcccaggtgtcccaactcccaattgtccggattttccttttcccttccaactattttggtagaaaatcacatgaatgatgaatcgtcattggtttttttcccccttgatttctagcggcaaccgtcactgccgctgagctgaatggtggtaatttgcgtgacttagctttgatgggatgtgatgagatatttgacagctttgaggtcatggagatgcacgcgattcaacttggctacctgccatttcatacctttgtgaggtttataataggttactggcatactcgctccgtcccaaaataactcgacctagaatgggtcacaggttaatttattttgggatggagggagatattattgagctgaaatgtagaattacttatatagatagatgatttttatttcttgcatatccagtgccaccaaaggaaagaagaggttggtagctttatatggaaacaagacaacaaagtaaaattgtatactagtatgtttttcctctttagatgtatgacagagagccagagctttcttgcaaataaaaaagaaaaggaaaaaggagtttttaccccaaaaagaaaaggtcagagggagacccaaattaactgaacttattttatttccagattttttttcctttttattcatgtcctcctttgtgctgccaagggttgccaagaacttggcagcaaactgagccagatgttcatgtggctctctctatttgcctccagggaattatgtgtcatatctggctgcaaatcagggacaggaaaaaggctttgacaagtgcttggcgttgacattgttatctttttcggcaataatgctctagtcaaataattctagacaggttaatttgtatataaaatatcaaattattgagaagagtccaagtctcttgctcctgttgagtttctctttagtctcttcccttcaatgaaaagagcctgacattttctcctcaattagtacagtactctgataacacagagtagctgtgataaaaaggccaatgtattaattgacaggttcttatcagataagcaaacacatgagtacatgacctataggagaaccaagagtccaaacaaaaaaaggccaagtgatcaaggtgacttggcttccatgtttcatcaatcaaacagcacaaaagggaatgaaaagaacttgccaattctttacttttagaccatgtgtgactcagcatcatctgttcttgtcccttcaggagccaaagaactacagtactactaccatcacttggaagcgtagcgacagctttccgagttcaattaggattaactaatcacttgattaaggaatctttttttaagtaaacctgattaattaaagaatctggagccacactaccacctggagatatcaaccgcggtttctgacgacacgtcgtgccggatccagaaccttgtacctgcaatgatgaatgcaatcatcagatgcagcaaaagaccaaccgtttcgctcatagctgattataaatcatactatttattagcatcagataataataatttatataattagaattttcatgcgttcttagcgattgaaaagctaatattaaaaaagaaactatgatataaaaatgtgaaaatcaactcgaaaattaagttttgaaatttatattatggataagttttttctgaattgttatccggtcgctttctgatcatctggttagattagatcacaggcaggaggatatggcttgctgatggccagctagcccagcagatgagcagggtgtgtggttatgtgtgaggaatcaggctggatcacatggatgattggtcgtgatcccggtggtttactgctaatcatctcacttggctagtcggcccgcgttcttcgccgcaccgtctgctgctccttgattttccttgcaaatcattgcatctggcgattataaatttgtaataattcgttagctcgtgaagcttcttgtcagaacttgttggaagaatactgtactgtactggcctaacacaactgtaacaactggttcctgagatatcttcccttctcttgatctggaagatatatcttctctgaatcacgatatgtgcctggtggtggatgattaccgcgcatacatgcagcttggaaataatctgcaattacgcgcgtttctgattcagttagtggcatatgaatccccctcggatcttgacagattcctgaacaataccgaaaacgaaaggaactgcataattgctccaagttatcacccccccccccctcctgtgaaatcgtgatcacgacatgcatatatacaacctatagctatcgtattttgtgacataaattatgaaacaaaccgaagagaaaaatgcagagaaaacgaagaacacaagaaaatgtaaacgtcatatgtgttggctgttctgcagagttgcaggcatatgctgctgttgttggcgagacgccgacgagaacttaacgcggccgctgtcgcggtaggtccggcgatcgatcagctggattttcttttttttttctttgttgcagttgccctccgccctctccgggatgccgttgatcaggtgacgcttgtcgattaccgcttgtgttgggcacaataatttctctgggtgagagcgagttctcgtgcttgatttggccataagtttccccctctttctgagattgttgttttttcccctcttttgtgatgcattgtaaattttacctttttcagatttttattactttctttttttcacttacatgcctattttttctcgattacatgaaaaacacgcatgtaaacagtatatgcgtgcactccacttctagcacgcatacacttttcatgaacatatttctaatctgttaggtaatgaaataaacattttggcctttgcttaatgagctgtagccaattattataaaatccacacatagaaacactcagcacgtactgacataacataaagtaaacacaaactaaaaaacaccaacacaagataaaaaaaaccataattacttaattctatttgtaaatctccatccgaagttagaaaaagatgcataatcattgattttaaatttatgatatgcatcatttattagcttattgtcgtcattatgcctttgtaagaacatatttctaattaggccacggagtaatctctggcctcgtctattaaacctatgttataatattttctagtaaaataatgttaaaaacatgcactgccccagcaccaaaacacgcgtgataatgctatattaggggatcctcctaagctacgttccaaactacggcttaactaggtactagtattggtagtataaaaaccttcaccctctggtcacgtaagcttccattcatcggcggaaacagggtaatggaaaaaccaattgcggctctacaaggtaacgtacgtcaaataaaatcaaagcctgtcattttcgcgccatcctaaaatttactgataagaaattgcaatttgtgtcctctccctgctggtgaagtagtaagcatccgaatcttgattttttttatttttttattttttgtacttttaaaattttaaattctaaaagtaaactttttccgaaacttattttccatttgaactttttaggaatgttagtcatactatagtgacgaaacaacactatcacgttgatctacatgacgtgacaacgttattttgtcatgctggtctgactagcgtgatggtgtatttggccacaccatcctgattggcgtgactaaggccctatttgttttagcttagaattattataatctggattattagcaataatttggaacaaataggtagattattataatttataaactaggttagtataatctggtaatctcctctaaacgtactttttttcatattattgggtggttaaagacccactacccttaaaaacattatagaaattatccattgccattgaacctaacagcctgagcacatctgcttcctctctcctccagctgcgcgccgcatccgcttcctctctccccagtcgagcgcaaatccttccccaaacccttaaccctacgtgcgaatcattccccaagcccccaccctacgccccagctcatttcccaagccgtgtcgccgccgccttctcatcctcctcccctaagcccccaccctacgccccagctcctttcccaagccttgtcgccatcaccttctcatcctcctcccactcgccgtctcatccttctcccactttgcaatagctaagggcatccaaaataacttgggacattataggcattagcctttcaaacctaataattcatgcttccaataatcatataaacagataacttataagttattctactatagcttattacggagtataatctagcttattgtaatatgcctttacctcaataatctggattaatcaatcttaagttaaagcaaacaggacctaaaagatcaaggtttttaaaaaataagttttacaaaggtttatttttaaaatataaaatttaaaaagttcaaaaaaattataaaagttcccgaatctttcgctcgcctcccttgccggctcgccttgccgccctgcgcctcccccaccacacacctgcacgccacgccaccaggcccaccaccaccagatacccagatcccaggcacacgcaat

SEQ ID NO: 73180 - DNA, 9520 bp, Oryza sativa
acaaaagttgtaccagtggattcatattcggaagtgcttccacatgaattggttttgttgccactaacaatatattgtaagagaagttaatggtcaaactgtcaaattatacttttgaagcctatgcaaatcacttatcaaatagaattactattagaaataagtcccaaccgggtgcaaatgtgcatcagaacatttgagaaatctgaattaaatatctgactctcaagaatcaaacaatgctggatcctatatagcttcattcatcttacaaccttaactaaaattaagggctaaggttgaaaaactaataccaacacccgaggaccataaaagaaaccatgatacagacaaacgaatatggtactgatgcattatccagaaaaatgaaattagattttcatgttgtatagtcacatcataatagttgtcctttacttcgctatgatgattcagctcttccaatccttagtgtttaatttgaaaagttgagtatataaatttcagaactgtcgctacagcaaggattaaaattcaaaatattcaacatcacaacacatcaactcacaattgatgtctttcgcagtccacggctatttaatatcaatatgctctctgaagatgcaacaaccattcagaaaggaacaaacagcagaatacactattcatgaaagaaagtatagctgcttacacacctttgagcacacattaaccataacaactgtcaccaccagcacataacattacttcaatgagttttaatagaaaaatacctgatctgcggcatctgtttcagcagactctctcttaactctcacattctgaatactgctcctcctaaaagacaaaaggatatacatcagaccatgtcatatgattctaactgctagaatcccctgaacggttacagaactgaatagaaacaaataccttcctgagtcatccaaaggtttgacatcatccatttccacatcagaatcagcatggtgcctttcatcaggatcctcttggtcttcatcttgctgcacgagacacatagatgtaactaagcgaaaatccttcctctcactttcgaaactacatccataatcaatatgggcatgccactgggcatcttacaacacttgtaaagtttcaaagctataaactgagacacatcagacaactggtccttatgctaggaattagtaatttaaattatatgcattcagcttgaaaattcaaagtcgatttgaacattattaacagaatgtgaagtgccagcattagagcacacatgacagattacttcaagcatgaaaaaatctgcatagataatccataccataatataaagcttttgaccataaaacaaaaaaaacgaacttttcaaaattcaatcatgtaaaaataactaaccacctgtcaatttggcattcctgatatttccggagctgacatttacaattcatacaaattgtgaaatattattatttacagcaactactagaaagacgccttatactcctttatccttgaagctgaggaattctacaggacaaaaaagaaccataatgccaataatttctcactcacctcaggtagctcagcctcagggggtcgctcttgaaattggacgctaggagcatgtcgaagttttgaaagattatcaagaagtcttgatcttatatcatccaactgctggcgtgtgtttttgttctccatgttacttggtgcaacatgaagtgtataatctggaccaaagtactcaaaatactcatttggaggcatcttgtcagtgagctcatgaccaagtgcaactcctgtctgcataaacataaggagaaaaataagaccatacgggaaaataatgattacaataaaagaaacatgcgtctaaaagcattagaagctcaaagtatttcataaaattctcagacaatcattggttatatactgttagatttcagtgattaaaagtacaataattatcaaacaatccatagtagttcatcacagagtgagttgtgcttattagaatagctataacagtttgaaatgattaacagaggtttttttacataagtacttatagatgtgagtcgcttagtcaaaacagttgtccaaggtgctacatacacatgtcaggcatagtgccggcgctaaaatggatgctagaagaactatgccatttcatacatctttaaagttaataaattagtgaaggctcttcaaacaaaaacaacagagaaatgtatgtccaggaaatgcccctgatacatacctcatagcaccaacaccgcgcaacatttcttatggtatacccaccaccaccaagcagcaacagcgggacattgaaggacctcatgaatctcacgcattccgcgtggcccctgattgacaggttgaagcaacccaacctatcacccgacagagagtccgcaccgcactggagcaccaccgcgccagggcgaaaaacctccatcaccttccccatgatcggcttgaacaacgactggtagctctcgtcgtcgataccgtcgtccaacgggacattcagagagtaatacttcccctttgagtgcccaatatcgcgaatgtccccggtccccgggaaataatccccaaacttgtggaacgagaccgtcatcaccctgtccgtcgtgtagaacgcctcctccacaccatccccatggtggatatcgatatccacatagagaacacgctgcaatacaaaaacaattagcacacccaaaaccctaattccgcaagattattaggctctccagcgcgagagaacctggtggtatttgaggagctcgaggatggcgaggacgatgtcgttgacgtagcagaatcccgaggcctcgcacttcttggcgtggtggaggccgccggcccagttgatggcgatgtcgtggccgtggttgagcttgacggcgccgccgacggatcccccggcgtaggtctggcagaagctgtagaggccgtcgaagacggggcagtcctcgccgacgttgaagcgcttgagcgcccggatctggtcctgctgggtctccggcgtgacggagcggaggaaggcgacgtagtcgtcggcgtggaagcggcagaggtcgcggtcgcgcgccgggtggggcttgagcacctgcatctggtcgaggaggccgtagtgggcgagcagcgcgtgggtcatccggatgcggtgcggcttcatcgggtgcccctgcccgtagtagtagttccccacctccgcgtcgtagaagtagcacacccgccgcttggccccgtcggcccccgccgtcggcagcgagttccccccgcctccggcggaggcgtccatggcggcggcggcggcggcggcgaggaggaggagattttttttttatctcttttttttttcttttcccctctttgccctctccttgggtttgggtttgggctcgcgggcggcgttttgagtttggaggggaggggaggaatagccgagatgggatcgtgggccgttggatcgtggagagacgcgacgtgggccgttcgatgctttcgtggtgcgaatgggagagcgtcggtcgggtgtagtagaaagttcccgagcaaacctgggaaactctggaagctttagaccccgttcatttcctctggaaaaggatggattaagttttggattttcgtgacacgcttttcaaaccactaaacggtatgtttcgtgcaaaaactttctatatgaaaattattataaaatatcagattaacccacttttcaagtttgtaataattaaaacttaattaatcgcacgttattaccacctcgttttacgtgaaacacttaattttcatcttcatcttcatctttaggagattcagacaccaccttatactccaaaacttaggtaatcacaaacctcaaattccaaacgagattttggttgagtggtgttctttgaggaggggttaggaatccctctcctccgtataaaaggaaagacggattaacattgattaattagatattagcttaaaaaattaaaaataaattaatatatttttaaaacaacttttttatagaaatttaaaaaaaaacaaatcgcttagtagtatgaaaaaacgtgcgcgcggaaaacgataaagtaaaggtcgcaaaccttgaattaagaacacatccttaaagttttactccatccatctacttttgatagtcatatttccaaatctgaaaaatttatttttgataggcatatttcaatccaacaacctatcatcttaatgactttctcggatttaatgcatgactctctattcttccacacatgattggctacatgagcattgagaaatgtaaatattaataaatcgcttgtttacaaggaatgactagtaccatgtttaaatgaatgataagtagaattgcttatccttggtctgtgtgccaagatgaaatattactatcaaaagtagatggagggagtatttcaattcaaaaaattgtaaaaggattttattttttgaagagatacattttttaaggggggaagggattttattctttcggaaaacattcattgttgcaccgtttgaaacaaaggaatgtctgaatagtactcactaatgtttgaggtcatttcctccgctctgtgttccataggaaaacaaaatcccatcacaactttgtgcaacttgtattgtacaaactagagagaaatatttcctccatcccaaaataaaccaacatcgtacttgaatgtgacaagtataaggttggtttatttttacacggatgaagtaggtcttggtaccctatatttactgtccattagagggaaagaaattcctttatcccaaaaaagtcatctaaatgttcatgcctctgcattttatttcttatgtttcagaattgctttcttgtttctgctctatattctgttgggttcgaaacgggcctaaaaagtttgccttttgctacagtttagaatcaaagtagaaagtgggacaaatgaagttaagacaaaaaaaaaggtaggaagactccaaaacttcaaccagcatcactccgttcgctctcaaaccacaaactccttcctcccaaataatcctatatatatatatatatatatatatatatatatatatatatatataaagttcattccacctaagtgtagttaatgttaattctctcttctcttatgaaaccacatcacctcaattatttttaatctttggatgattcatcaagggtgtaaattgcatctcttcctcttaaaatgcataccatagaacccaatcatttatatcctttgaatgattgtataaaatatataagcacatgaaaaaaaaatcttatggtaggttagaaagaaaattttaaaactcatatatactctattatcacacaattctcccacagcaacacgcgaggtgcccatctagtaataacattgaaggacgtgaaagttatacactccttcgttcccaattaatcaatatatttgtcaatgtcaagaagaaggcataccctctatacacaggtttgtggacggcaataccatattatacgagagaaggtattctttaattaaggaaatacaacagataaaaagaaattatcttaggtatcccttaattaaggacatacgacaaaaaaaagaaattatctttccggaatagaagatgccagagttctatttggggaatataaggtcttctcgggcttgtatcatgctttatctcttcgagttccacttaagatgatctatgctatatatatacaggtccccctcatctagggggacattgagttacaagtcatagcaaaagacatattgagaaacaatccggaggaagccagaccatatttggcgaatagatctcgtcgagtcgttctcgacagcttctagtcagcggattagtctagtcatcctattccccattgtaatccttgtatttacatccatatatccatataaactgtagtagggttattactcatcttgaaggcccgaatcaatataaatccttgtcccatgttccgcaaatccgacctcacgtacatcctagttccaacgatccccatattctatgaatagcatatgcaggtataacccggtgacaatattatagaagtacatcaagacccagggaaaccaataactctcttgctactattcactttcacacattgaccagtgtctatttttcatatatttacgaaggctaaaatgatctcatactattaaaggtgtattatgatctaataaataccagcatgaaacttttattcattttactctaaacatttaagagtaaattgtggtcaaagtttaaatagtaaagtgaaaataatcaattatttagaaacgggggtgtaaatggttctagcagccatgcacgtagtagagcttaacaaaaccgattgaaaaataaatcatactctctcaattccaaaatataaggcacatccacctttaacccaaagactaagaaataattattatcatcatgtagtttggatcatcctaataaatataatgcatgcatccaataggattagataacatgagagtgaaggattaaaaaagtaataatttaatgaagaagatgtcatagttaattgcatgtttgtatgcatgccttatattatggaacacctaaaaaaagttgcgtcttatattatggaatggacaatggagggtgtacatcacaaaacctcttcacacccctgatcctaaaagccaacctgatcatcacttccatggcatggcatattcacagagtgacatggatgggcacagaagcaacaaagaagcaagtaacaaagcaatgcgatatctctatttaccttgtaagctagcagagctgtagctgcattacctttcaactagcaatcatccagttctttcatattgaagaaaacagaaaagagaataagggatgcccaaatggaacgtttgcaatcaacggtttcagacttgagacaaagatagtgactgactgacaacatggtcgttctcatttggacactacatttccagtcagccgcaggtcgcctgctgagttatcctcaaatagtatgctacactgtcacactgacgttttagtcaagttgataaaacttggagaaaatgatgcaacacatatgtacatcatttgtgcttgtgaaccgtgagaggtcatataaagaggaattactgcgagtattacacgagaatcaggtttctaagtcacagcctaataggaaatcattatatcgaaaaaggattgataatagaaaaactgataatgagcatgcaacaaaatatggacttgtttgacggtgagttcagagttctgagatggcaatctctctttcaatgccatttccgaatttgccgtgtcagttactcagccaataagcttataaaggcatgcaaagaggatcaccgaatcatattattcaccaagcatcaaaggtcacaattggcagtggtttacacgtaagtcctgtccttgtcatgctttaccacgactttgagtcttccatcacagcctgcgagcaccatttgaaggttcatgtacttcggtttcacaacaagttatgcacttgaaactcagaagctatttaagacaggtgagttcgccttacctgagatgcaatacattatacccattgtctcttgatcatcctgggttcaatggagctaggaccctgcaaatgcacaacaggtgcatcctgggcagtaagctttcttcttgcagctgctttgctatctaacgccccaagcaccaccgatgcctccatgctcaaagctccaactgcaaacactgcctccaacagctcagatcgccaagtgctcctctcattcaagtcactcataacaaaagacccctctggagcgctcacctcatggggaaacaggtcactgcaccactgcagatggcaaggtgtgatgtgcgggaagcgtgggcgtcgtcgtggtcgcgccatcgccatcgaccttaacaatctcgggctggctggtagcatctccccttccatttctaatcttacgtacctcaggaagctccacttgccacagaaccagtttggtgggcacatcccacatgaactcggccttctcgacgatcttaagtttctgaactttgtgaattgtgctaaaatcagtacggtgtattccaggagagcactagcatatacaatggtatatgggcctcatgggccaacagtaaaataagtctaagactacatcgctatacacatatctaacagcccccttcaaactcaaggtggatttggagaatgatttggaggatctatcacattgagtttgagaatgtaaagacggtgttgctctctagtttgagccttggtaaagaagtcagcaacttgaagttcagatggcacatatcgaagagaaattgttgactgctgacaatgagagcgtgtgaatgatgcatccactccaatatgcttagttaactcatgctttacaggatcattggcaatttgtatagctcctgtgttatcacaaagaagaggtgttggatccttgcattctacaccaagatcagataataaccaacgaagccaaacaatctcagaagtggtagtagcaagtgcgcgaagttcagattcagtactggatcttgacacagcagtttgcttcttggacttccaagcaatgagagaagtaccaaggaaaatacaatatccagtaattgatcgacgatccattggatcactcgcccaggttgagtcagaatatgcatggaggtgaagctgactcgagcgtgcatagaatagttgtcgagatgcagtccctctcaagtaacggagcacacgaagcaaatggctataatgaacagaggtaggtgcactgacaaactgactaagcacatgaacaatgtgagcaatatctggtctggttatagtgagataaacaaggcttccaacaatttgacgatatcgagagggatcctcaagcaaaacaccttcagtagaacgaagttgaacatgtagctccattggagtagtggcagtcttggtatcagtaagaccagagcgtgttataagatcatcaatatatcgatgctgagaaaggtagtagccatcctctgtattagtgacctctatccccaaaaagtagctaagagggcctaaatcagacatcatgaattgctcacttagacattgcttcacaaaagcaatatactctaagtcatcccctgtgattagcatgtcatcaacataaagcaacaatagagtccgtccatggtcagaaacatgaatgaataaagccggatcatgatcacttggagagaatccagcagcacaaacaacggagctaaaacgctcaaaccaagcacgaggtgcttgctttaaaccataaagagcacgattgagacgaaaaacataatttgcaggggcatcaacaccaggaggcggtttcatgtaaacctcctcctttaggtcaccatgaagaaaagcattcttcacatccatctgagatatggtccaggaacgagcagctgccacggccacaagagtacgaacagtggtcatgtgagc

SEQ ID NO: 73181 - DNA, 9488 bp, Oryza sativa
atgttcttgctgaaaaccgcgagcaactaagcgagctttgtagcgctcaatagagccatcagagcgagtcttcaccttaaacacccacttgcaagtaattggaatggcatgacaaggaagaggaacaatatcccaggttcttgttcgctctaaggcagcaagctcctctgtcatagccaattgccactcaggaatggcagcagcctcttgatatgtactaggctcctgaacaccatcaattgctgcacacatatagcgaggatgaggcattatcttgctgcgatctcgaagaccatatcgtggtgtagcagactgtggtgatgacacaagtggatcatcaatgagcggagcaacgggtggatcatcagattgagcattaatggtactagttggaacatctgaaggaagacaagagggaggctgagactcatgtggagttcgaggtcgacgactatagtggaaaggaaaaggtgacatctctgaccttggtgttagagtggatgatggtatatccaaagagggtgaaggaatggaagatggagaaggtgtctcactgatggtagttaggtcttgagaaggaataggtggaagatggagaaaagaaatggactcctgaggagatgaggaggacgagattttagagtagaaatatggacgatcctcaatgaaagtgacatctcgagatatgcgaatacgacgagaagaggggtcataacaacgataccctttatgttcaatactatagccaagaaaaacacactcaactgattgagctgacaacttggtgcgctctcgagatgccaaaagaacatagcaagtacaaccaaaaacacgaagatgatcatagcatggggaagatccaaatagaacctctcctggacactttccttgaaggcgagatgatggctgaatattgatgagataaacagcagtggaaacagcttcagcccaaaaatgagaaggtacaaatgatgcaatcaatagagtgcgtgcagtctcaatgatatgccggtgcttgcgctcagcaacaccattttgaggatgggcaccagggcaagagagctgaggaagagtaccctcggaagaaagaagttgtcgaaaagcagctgagaggtactcccctcctgaatcagaacgaaaaatacgaatagtagcagaaaactgagtatggatcatgcgaataaaggattggtatatggataaaagttgtgaacggtgtttcatgaagtaaatccaagtgtatctcgaataatcatctataaatatgacataatatttgtgtccacccttagaagcaaatggggcagggccccatacatcagaatgaacaaggtcaaaaggacaactagtcctagaattactaatagggtaaggaagttgtatctgttttccaagtttacaacccgtacaatcaaaagtagtatcaatagagacatgacctagaacaccctgacgaattaaagttgaaaggcgggacccacaaagatgccccaatctatgatgccattgtggaaaagttgtagaagatgcataacccaaggctgtggaactagtggtggtggagccaaaagatgaaggtggaagactcaagtgatcgagaacatagagcttcccaggagaactactatggcgatggccagtaccaacgagtgctcttgtctgacgatcctgcacgaagcaagaggtattatcaaaacccacaaaatagttcatgtctgtgagttgtccaacagaaatgagattgatggaaagttgtggcacaagagaaacatttggtacagtgagttgtgaagtggaaagagtgccctggtgagtaactaaacaggatgtgccattagctgtctgaacacatgtaccattgataactggttgacaggatgcaagctgagacacatctgatgtcatatgaaaagaggctcctgagtctaacacccatgactgagaagtacctggtgcaggggccaaagaagctgatccattaggttgataagcattcatgtagggctgattggttgaagttgcactaactgaagctgcagtcacagcgggagcagcaagtgtaactgaagtactaggggcacggcgagatgcaccacgcttggccctaaactcagccaacaattcaggatgtagcttgaagcatttctcaacacggtgaccagacctcttgcagtgggagcaaacaatctgagtggaagaagttgctaaggacccatgctggaaagcatgatcaccagacaaggaggttcccatcaatgaagaagcaaggacagtgtgttgcggtgttgtggcgttgggaagtgactgtagacgagtttcctcggcaattaagtctgcgagagcctcagccatggtaggaagagtagaccgaccaagaagctgcaccctaataggttcaaagtctaaccgaagacgcatcacaaaatcaaacataaggctctgctcctcatatttctccttgcatatacactgtctgcacccacctccagcctttggcaccatagaatccaattgtctagacaatgaggtgaaggcattatgaaactcctcaatggtcatgtcgccctgttcaaggctttgcaagctcttgcgaagagaaaagcggagagctgcactgctctgttgatagcgttgttgaagatactcccacatcttcttagcagaagaaagatcaataaaattcattctaatggggacctcagcgctcatgcacaagaaggccatcacacgctcatcattacgccgccaagctgcaattttcttctcatcttccttctcatgaggtggatcatcattcaagtgagaggccacaccatacgacctgagttgcatacgagcagaggaagcccactcacggtaattttgtccattgagttttatatccaaaggcaaaagaatgacattcccaagtggatctgatgccatggttgcaatctgaaaggctgagctgctgctgcacttgaaacgctgctactgcactgctgcactgggctgccgctgctgcaattagtggctgcaattaggtattgtaatcagcagcaggagatccaacacatggcagatttgttggaaagagtcctggcggcaagtgcgacagcaaaggatggaggctgcgggtcctgcagactgcagctagccgacaccactgcagctagcacaattggataatgcaacctcgagcaggagaaaaagaagcaggagaaaaagcagtcaagcagatccagcaggagaaaaagatgctccagccagaagagaagagggtcgatccccaaaatcaagtagcagatccagcaggagaaaaagatgctccagccagaagagaagagggtcgatccccaaaatcaagtagcagatccagcaggagaaaaagatgctccagccagaagagaagagggtcgatccccaaaatcaagtgaccacgaaaaacagaacacacagcagaaaacttccactgggagaagagatgagggaggacactcgccggagaccaagaccggtgaagagctcgccggcggcggacatcgacgggaatcgcaagagcaacctagctctgataccatgtgaattgtgctaaaatcagtacggtgtattccaggagagcactagcatatacaatggtatatgggcctcatgggccaacagtaaaataagtctaagactacatcgctatacacatatctaacaaacttgagtatcaactctctcgagggagaaattccgacatctctgtctcaatgctcgcgtcttcaaaccattagtttgtggtacaataacctccaaggcagaattccatccaatcttagccactgttcataactccgaaccattgaggtctttgctaattatctagagggagagatacccagtgagcttggttcactccaatgtcttgagctcctcaatctttacaataataatctcacaggaagcatcccttcttacatagggaatttaaaaaacttaatcttgattgatataagtgataatggcctcactggatccatccctcctgaaattggcaaccttcaaaatttgcagttcatggactttggaaagaacaaactttcaggatccattccagcatctttaggtaacctattctccctaaattggttggatcttggaaacaacagtctcgttggaaccatcccgccatcacttggtggactcccttatctcagtacttttattttagcaaggaacaaacttgtagggaacatccctccatcattagggaacctttcttccctcacagagttaaactttgcaaggaattatcttactggaatcatcccccattccttaggcaatatttatggtctgcatagtctccgtcttacggagaacatgctcacaggcaccattccttcgtccctaggcaaacttattaatcttgtttatattggtttgcagttcaacaaccttataggggagatccctctattgctatttaacctctcatctcttcagaagctggatctgcaaaataataagttaagtggcagcttgcagaattattttggagataagttccctctactccagggacttgccttgaatgacaacaaatttcatggtcccattcctttatccctttccaactgttcaatgcttgaactaattcaactagatagtaactcattctcaggaacaattccttcaaatctcggaaacctcaagagattgtccaaactgcgtctcgattacaataaattagaggcaaactacaactctgactgggatttcttgaatgccttgacaaactgcacccaactataagttctgcagttaagtttcaataggcttaggggtgtgctaccacactcactttctaatctttcaatcagcttagaacaccttgcgattctcaacaatgaagtaggaggaaatatacctgaaggaattgggaggctttctaatttgatggcactttacatgggtcctaatctcctcactggttccatacctgcttctctcggaaaactatcaaaattgaatgtgatatcactagctcaaaatagactatcaggagagatcccaccaactcttggaaatctcacacagttgagtgaactctatctatctatgaatgcatttactggggaaataccttcagctcttggaaaatgccctttaggtgtattagctcttgcttacaacaaacttagtggaaatataccaaaagaaattttctcgtctagtagactaagatccattagcttgctgagcaacatgttagtagggcccatgccttcggagcttggtctattgaaaaatttgcaaggtcttgatttctcacaaaacaagctaactggtgagattcccatctcaattggaggatgccagagtttggaattccttcttgtttcacaaaatttccttcatggttcaattccttctacaatgaacaagttgacaggccttcaagagctagatctttcaagcaacaacatttcggggatcattccagtgtttcttggcagctttattggtctcacgtatctgaacctctccttcaacaacttgataggtgaagttccagatgatgggatatttcgtaatgcaactgcattctcaattgttggaaatgtgggcctatgtgggggcattccagtattaagtttgccatcatgtacaaaccaacaagcaagagagcataaattcccaaaactagctgtagccatgtcagtgtccataacatgcttgtttcttgtcatcggcataggtttgatctccgttttatgtaagaaacataaatccagcagtggaccgacatctaccagagctgtcaggaatcaactgccaagagtttcttatactgagctatctatgggaacaaatgggttctcctcttcaaatctcattggtgaaggaagatttggttcagtgtacaaggcaaatatgagtttcgatcaatatagtgttgttgcagtaaaggtactcaagctccaagagaggggagcatcacatagttttcttgcggaatgtgaggcattaagatacctacggcatcgcaatcttgtgaagatattaacagcttgctcatcaattgatcctagggggcatgattttaaagcacttatctttgagtatctaccaaatggaagccttgaaaaatggttgcatactcatatagatgagcaaagtgatcaaagtgtcctaaatatttaccagaagctaagcattgccaccgatgtaggatctgcagtggagtatcttcatgattacaagccagttccaatagttcattgtgatcttaagcctagcaatattcttctagacagtgatatgatggctcatgtgggtgactttggactggcaaggttcacaaatcaaggagataacaatgcatctcaagtctcatccagctgggccgcatttagagggaccattggatatgctgctccaggtgcgcatttatcacttgccaaaaatatacttcttgccttgttaccatttaaaatatatgagacatttacgataccttgtaaataattaatttacttaggtaatgacccattgagcttatgcttgtgctgcattcacattttcagaatatggaattggcaatgaagttactacaagtggagatgtttatagctatgggataatcttactagaaatgtttacaggaagaaggcctaccgaacaaaattttgaggagaatactaaccttcacaggtttgttgaggaagcgctgcctgatagtgtagaggatgttgtggaccagaatctcatattaccaagggaagacacagagatggatcacaacacactcctaaacaaggaagcagcacttgcatgcataacttctattttgagggttggtatcctctgttcaaaacaattgcctacagaacgggtgcaaatacgagatgctgtaatagaacttcacaaaatcaaagaaaaattctttccatgaagaatccatttatgaagaagggaaagtccagtaccagaaaatgcatgtgagcaagcagagtagtaggcagacggagttcataaagcttacttcttaagtagcaaaatagtctggtactagatacatagtccaaaagtggagtttgaataattgaccatttaggcatcaaggcttgtcatattatcttgaatttcacttcatatgtaaatcatgtaatgcataccagtattatcttcctaaagcaataaaccatgttgtatcggtactttgacttcaaggatgtgaacttactaagaaaatgatcaatttttcgtgttggcagtacagtgaataatacaaaaccaaagagctactgcactggtagtggtacctgatagtgtcttggagtgctagcactgtaggtctggcatatgttgatctttctcctttgtattgtgtttgtgtccggtgtatgccatcagtcatgggattgtattactgcattagcacagaaaaccaacaaaattgatccccaaacccaagcaggctgcacttttttctgaaaaaaaaaagaaagaaaaagaagaaaaataaaaaggattgcaggctacgcccgtacgaagcatgtcagcatgacaattgacaatgacaagtgcatcagcatcctaaccatacccttgtgacacacgcagcaaagcttcgggagggctacaggcgctgcagctgcccgagccctgggaacaaagaaaggctcggcatttcatcgaacatcttgtgtgcgaccatgagataaaagtagcagagagaccaccctgccgtgagctaatggcagtgagaggaaaggttgcagacaacggctggtgggatgagacggccctgaccttttataaaaaaaaatcacctacggtctactgattgatttggtggaagtggaccaagtcgcgtgagctcgcgtgggtctccggatccgggctccggcgaggcggcgatcggttttcagccagcgccgctgcattggagagaggaaccgcagcttacgacttctgtagttgatttttatggggaattagctaaaaaaaactatcgagtgtttttttttggaaacattcaaatctaagtatatacttcttccgtttcacaatgtaagtcgttctaacatttctcacattcatattgatgttaatgaatttaaatagatatatatgtctagattcattaccatcaatatgaatgtagaaaatactagaatgaattacattgtgaaacggagtgagtaattcactagaaatatactataataaaaataacttgtatatatgtattaaaataatatatgcaactttatatctaatttatatagagataacaatatagttatagggtagttacactatagttacactataattattaattatagttgtaactacaatgtaactagaatataacttagatgtaactacaatgtaactagcatgtaacaaatctgccataaacatgtgatgatggaactagcttataaaaagagggtctacatccgatagcaaaatatctcagcacaaatgttaacgcggaatcaacagtgaaaataatcgatagttttcactgtcgacagtcagctagcagttccatttttatggtacaagtctacgtgaggagtggggtggttttgcattaaaactgagcatgtggatcgtggatgggtatatgtaacaaaatgatttatgagtggaatttcaaacttcaaatttcatatggatagtttttgtgctttcagggcatgttcattttgatgctattccaaaaaattgccaaaaaaatatctacatttagtttattgtcaaattttatcaatacataagaaatcatgtcaatattacaatcttgccaaaatttggtaaggtttattttggctaccatctgaacaggtccttaaatattactcactcatttttttaataaatgatgcagttgatttttgacgtgatatttaaccacttgttctatttaaaaatatataaatattatttattttgttatgataaatacttttaaatgtttttgtttttctacaacgtttgactatgttatcattaaaagactttagtatgacttttacttttaacatttgtaataatgtacatatatttttaatgaaccaatggtcaaatgttattataaaaaagtcaatgacattgcacattaaaagagattttcaataaggtagcatcaattaaaaagttacaacaaattatttaaactcttaaggtacactacacatgcctttgaatgtaaggtatacttgaacaaatttatagacagaaccccttacatttagtgtcggaaagaatacaccattaataaaaatgggttaattggattcatgcctctataaatatgacaaataagaaaaatgtcaccattattcatgaaatcgggtagatgctactgtaaattagaatcatgccacactactacaaaagtgatttttctatacgaggcctcatcatttttccatgcggaccataactagtggcgtctgcaaaaatcgagggtcatttttccatacagctgcttgagtggcccg

SEQ ID NO: 73182 - DNA, 10387 bp, Oryza sativa
  unsure (1)..(10387): unsure at all n locations
aaattcaaattcaaactgttcaaataaagtcatagggaataatgacaaatgcaaaagttgcagatcttgataagttatacaattttgttgttgacaacttttctatttgaaatcatttactatgtaaaaaaattatttgaatttattatattataaagttcaaattttatatagttcaataaaactcggatggagaaatgaccaaaagaaaattggtagatctcaacaagttctacaactttgtttttggcaacttttttatttgagttcatttagtattaaaaaatttgattccaagttctcatatttttaaattattttttaataactattttcgcatgcggctccttaagtggtccacatgcaaaaataccaccccaattttttcatcttcctccactcttttttccctcccaccacttcaaaatttttctacctcatctcatctctctccctctattaatttattactctcccctctctctccctctctctttctctcctctctctccctctctccctctccctctctcagagcggccaggcggcggatggcaatggcgtcggcgcgggtggcggatctggcggtgccgccctcgggagggccggatccaccgccatagggagcagctacagcagcggcggcgggcggcggcttggcagcctcggctcggtggcctgccatcccctcctcaccgacgacgatgagacggcccttcctcttcctcaacgccgccgcggcaggggtggcttggccgcctcgggtggcgccgcactgcgcggatccggtgcccccgacgacggcgagcggggggggcgacggatcccccgcaagcacgacgccgggtgactagggcaacgcatccggtgccgccgccgacggatccggcgggggcgacgacagtgggcggcgggggagacggatccggcggggacgacgatggcgggcggcgggggagacggaagcggcggcggcgacgacggcgggcggctggggcgacgacggcggacggcggggggcaacggatccgcttccggcgacggcgtgcggcgtggacggtgggctagggtttgggattttttggatttttattttttttgggggttttggattttatttttttttgtttgctgaatttattttcgcatgctgccctggccgcatgcaaagatttgcattttcgcagacgatttggcgcatgcgaagatcgctccggcccgttcgcaaaaatggtttttttgtagtagtgccacttcatcacgatttccgtcctctccgtcacattttccgcagtctccgtcttcatcttttcgtcgtcctcgtctcgacggcggatgggcagctggaggacggcagcacggcggcggatgcaggagtcatccgcatccctagtccccgcatgagacattgcagcattcattgatttctccggaggaagaagaaacaaagagtaggaaggaagcatgccctcgccggcggcggccgcggccgcgctcgcgaccgtccttgccggcggcggcggcgcccgcacccgccaagcgaccgtcctcgccggcagccgcgcccctccgcgacctccccgcgagcgtcctcaccagcagcagctgcgcccgcgcccgcgcccgcgagcgctccgtgacaggtggcggccgcgcccgctcctcgcgctcgcgactgtcctcgccggcggcggcctcatcctctcaccgctcgccagcgcctcatcgtcctcgccgctcgtcttctcactgtgcagacgtgagccgctcgccttctcactctgcagacgtgagtgaggaggatgacgtgagagaggacggaaatagtgataggagtgtcatggtttcaatttaaaaaaattttagtggaatccagccaataacgcgaatagtagtgatattcttctgatttaccacgtttacaatcttatggatccaattaacctaataaaaatactgctcaaaattttgcataacacacaaatttaatagcatcgctttgtgaaattgatggtataaggacatccataatatagcgcttcagcaagtagtaagtattaaatatcttattgtttgcatatgaaaaacatcatgagagctgcaaaagggtcactaacaagacatggcctggtacaaaggtgggctactttcatctcatttttaatcgcaccaaggctgatgataggctaggttggacgttgtcccatcttattttctctccacgcatacgtgtccgttctactagttccgctaccaaacaatggacccaccattgtttcctggtcagcaataaacattaccggtgcactaacggatttttgctcccatagactttagctgtactgaagaattcttaaggtagctagccacttttaccgtacactatatttccaacattccctcgtgatcactttctcaatatgacgggaaataagttggtaatgattttttggtgtaacagggatagggaaaacaaagctatcaattgacatagctgataaaataaaaatgtgttacgacatggatatcagcacaaactctgataaccaaaattctattagagcatctctaacagcctctctaaatcggactctccaaacacccatataaccaactttttatttgatttagctagtcaaactaaatgctcacttcaacagattcaatattaatcatctccaaaataataacagacccatgtgtcagcctctactactcttctttctctctctctcccccttcttccttctctttccttcttttcccctttccttccttcccgttcccttccttgatgccgatggcggcggctcgcggtggctcaatgatgcggggaggcgggaggcgagacgtcgtcaagatcccctcaggttgccagatctagaagggggcggtgacggagctcggcggtggcggctcgcgacgacaatctcgatgacgacccggggcaacgacgacctcgacgatgctcggggcggagcttggcggcggcggcagctcgcgacgacctcgacgactgatctagaggagggaagggggggggcatctcacgacgacctcgacggcggatctagaggggggcggcggcggcttgcgatggcgacctcgacgacgacccggggcaacgacgaccttgacgatgcctagccgctgcgcctgctgcggccaccgtttggcgagtcccctcgggctggccaaatctagccagccgccgagcgagtttggccatccggttagctagtctgttgaacattgtttttgtgcttgaatggccaaaatttgacttggagagactgtagagagcctgttagagatgctattagagtatcgatgcaatatatcttatcaccttattgggtctatgataagcattgcatgtgatttttatgtatcatttttctcgatcttttgcatcaaccatagcaacctatattttaaggcatgcccatataccaatagtcattggtcggtcgctaattcaggatttggttttgctgataaaacttgatcggtccctcatatatgggatctctttggacatacataattaaagtgtttcttaattaattaatatctcatatgctatgataataacataataataacatagttgatgatggattggtcgaggagactaggaagtatatatgttaactaccctaaagtacagtcatccacccccttaaaaaaccactcccttcccattcttaaaaaaccgctcaaaaggaaatctttaactacttaaaaaatgatgtcccttctttaaaaacccgtctccctctccttaataaaatattacaaaaaaaattaactcatgataaaaaccagcataaaaaactgaatcatatcatacttctttctcttgatccctttgcaatacacggatatgtaactaattataataaaatgtctgttaatgggtgaaaatagcacggcatcatacttcattattggaaaaactatacatatctcaccgtaaaaacaaatttatacaaattctctcttgttcttcatctctctcattttcggcttttccgcggtgtctttaggccctatttagatctcctgccaaaattttacactctgtcacatcgaatgtttggacacatgtatgaaatattaaatatagacggaaaaataactaattacacagatcgtgtaaattgcgagacgaatcttttaagcctaattgcaccattatttgacaatgtggtgctacagtaaacatttgctaatgacggattaattaggcttaataaattcgtctcgcagtttacatgcggattctgtaatttgttttgttattagactacgtttaatacttcaaatgtatatcgtatatccgatgtgacacgccaaaactttacacctctgtatctaaacatagtcttactaacagttaatctaatgtagtttttttccccgcaaaaaaaatcaaaatcaactgtagtttctgcacccacaaaaaattcttccaaccttcccctctcccgttcagtcaagtgtccacccagttcttgcatgacggccaagaatagccagagcctctaagcaccagccgatcaaggaatacatgcacaaacactactagaaaaagccactgcaattctctagctcacagctccagagacacaggatcaaaaccacaggcgtgtggctcgcctccctcctcgcttcaccgctccctaacaatgggcaccgtcgatgcatcccaagctatatatatactcatctgatccatttcctcctcgcacaggccgagcaatggagctcatcgtcctaccttcacacagctgaaaaaattccctcatatacaagataaaggtaggaggagggccgggagctcgacggatttcgatcaattgtggtttttttttgtggtaaccgtataagagaggagattttgtttaacgtagctagatcatatctgagttgagttttagcaatggaggtgctgatccggtggagcaagctgccggcggccggctccttggtgctgtacgccgtcttcttattgctgtcggcggcagccacatcggaggccaacatcggggagtacgatgagtactggcagaagcgcaagctcatggctgatgccgccgccgaggctacctacaagcgtgaccccttcgaggtcaccaacagcttcaaccgcgccgtccacaggcacgccgatcgttcgttcaatcaatcaatcgtgagaatagctcagttggttagaacatatgatagtaacgtgtgcgtgcagatcggaggaggagagcgggaggagggagctggcgatgacgaagaggaagaagttcgcggggccgtgcaaggcgacgaacccgatcgaccggtgctggaggtgccgcgccgactgggtgacggacaggaagcggctggcgcggtgcgcgcaggggttcggccggaacaccaccggagggctggccgggaagttctacctggtgacggacggcaccgacgacgacgtggagaacccgcgcccggggacgctccggtggggtgtcatccaggacgagccactgtggatcatcttcgccaaggacatgatcatcaacctcaaggaggagatgatgatcaacagcgacaagacgatcgacgggcggggagcgcaggtgcggatcaccaatggcgcgcaggtgacggtgcagaactccaacaacgtgatcatccacaacatccacatccacgacatcttgcaaggcaagggcgggatgatccgcgactcgccggagcacttcggcttccgcacccagtccgacggcgacggcatcagcatcttcggctccaccaacgtctggctcgaccacctctccctctccaactgccaggacggcctcatcgacgtcatcgccaagtccaccggagtcaccatctccaactgccacctcaccaaccacaacgacgtcatgctcttcggctccagcgactccttcagcgaggaccagatcatgcagatcaccgtcgctttcaaccacttcggccgcggcctcgtccaaagaatgcccaggtcacataataatactaccagtagagaacaccatacataaaatattaataataataatattatattattatatatataacatcattcattattatttatcatgtattgtgcagatgccgatggggatttttccacgtggtgaacaacgactacacgcactggctcatgtatgccatcggagggagcaagaacccgacgatcatcagccaggggaacaggtacatcgcgccgccaaacctagcggcgaagcggatcacgaagcagctcggggcgacggaggaggagtggaagaactgggtgtggcactctgaggaggacctgttcatggagggggcctacttcaccacgtccggtggcccgatccagaagcagttcagcaacaaggatctgatcaagcccaagcccggatcctacgtcacgaggctcacccgcttcgctggctccatcccatgcgtggccggcaagccgtgctagagcgcggtggccggcccccaccggatccacggctagccggagatgattcttattttgtagttgtgtgagcttattttttcttctacacatacgtacttactcaagaaatcttgatctgtggccggccgggttctggtcaatgtgatcctataggttctacatataaaaaagttgtattaattaaaagcatttttggaagcggtggcgatgcaaatttagagggcgatagggcgaggagcatgcatgtttgtgcgtataggtctacttgttgatggtgatcacgaaagagccaatgcattgtcatgatagaggacatgcgcatttatgcagaaggccctagggcaggaattatttttttttcattgattgttttaaatgtattgtactgaaactacattgttgtttcattaactgcacgcatctccaatgcaaagtgctaatgtaaggtgtttaatatatagtgctaatgtaaagtgcaatgaagcatctcactactatagaagatgacttcagtgtcgggtcgtaacccctcatcagtgttggaaatcaaaccggcacgaggtcatgagtgccgggttaagaaccggcattggtgaggactcatcggtgccacttgttggctacaaataacgtgtgcaatgatttgtaaatacgtgatattttcaacacaaatatataaaatataagtacatcccaacaaccattcattcaaatttgatttgaaaccagaaagactctagcttagataccatactagcaatccacaccgcaatttctaagaaatcatgctacaccgtgaaataattaatattacacaaaagaattgaaaatatgtgagcaatgggattaatcgactatccgtgatcctgccttgcgaggggcgacacgcaagagctgtgcggaacaatgcaaccagaaatgaaggttgtaatattccctgaaagtgcatctagccctttaagtgggttttggtggattaatgacaaaccagttaagtgactaataatcttgtgaagaagtgtgtgcaggtgttagtccaaaatgaatggagacatccaaatctaattaatggaatttggagcgagaacttgaacagttattttaaatttcttttgtgttttatctcttgagttctaggaccttcgtattatcaagagggttctcaacagatgctcaatgtctacaagtgctcatagtcattctctggaagagagacacatgtttcgcacatgcacactgggttgtgccacctttttctatctgccaggagttctcaaagagatgcctggaaacctccgggcctaagtgttgaccggaagttctccgggggctagcccagaacttcgggctctgtttaagtttgaatttgagagcaacgtctagttgatgtcgcacgagtaactatatattccagcctctcccacctttgttgcctggcaattccactttagttttcttgtccttagactctcatatgatgttattcttggagggcaacctcctagatggataaatttcgcccgcgagcatccatgtcattgtggattgaccagggaaaagtttgtgaaggttttcctcgcctccgcaaggaaaagaggtagtttgagtgaaaattatgagctgagccttcggaagttgtcttggtagggtaatccacattcgtggtgttctctaggtatccaagttgggaatctttgtggtcatttgaaatctagagaagtacatatataggaatggtggattgaaaatcggagacttcttcctagggttttggttggtgagacaaggggttaatagagacccaactctttggagctcctcaatggagattaggattcttgtaatccgagcttcgggtgaaaaatcctgtgtctatcctcttgtgcagtttatgtttctcctttgatttactgctttgaattgttcattaatcattactgtcttttgcgcctttgtaagtcttggnnnnnnnnnnnnnnnnnnnngtgagtctcgaggagcgagaacccgaaaatttctggaaagaatcgtggaagttccaggtagccctcactgtcttcgggtaagagatgctaggaagttccaaaccctatatattaacctctttaatggaagaaaattgttcaatcaatcaatcatgaggatagctcagttggttagaacatatgataacgtttgtgtgcagatcagaggagttgagcgggagaaggaagctggcgatgacgaagaggaagaagttcgcggggccatgcaaggcgacttatccgatcgaccggtgctagaggtgccgcaccgactgggcgacggacaggaagcggctggcgctgtgcgcacaagggttcggcttaaacaccaccggagggttggccgggaagttctacctagtgacggacggcaccgacgatgacgcggtgaatccgccccggggacgctccgttggggtgtgatccaggacgagccactgtggatcatctttgccaaggagatgatcatcaacctcaaggaggggatgatgatcaatagcgacaagacaatcgacaggcggggagcgcatgtgcggatcaccaatggcgtgcaggtgacggtgcagaactccaacaacgtgatcatccacaacatccacatccacgacatcgtgctcggcaagttggggatgatccgcgactcgctggagcagttcggcttccgcacccagtccgacagcgatgacatcaacatcttcggctccaccaacgtctagctcgaccacctctccctctccaactgcaaggacggcctcatcgacgtcatcgccaagtccaccggagtcaccatgcatctccaactaccacctcaccaaccacaacgacatcaggctcttcagctccagtgactccttcagcgaggaccagatcatgcagatcactgtcgccttcaaccagtttggctgcagcctcgtctaaggaatgcccaggtcacataataatactaccagtagagatcaccgtacataaaaaatattattatatatatgtatataacatcatttattactatttatcatgtgttgtgcagatgccgatggggatatttccacgtggtgaacaatgactacacgcactggctgatgtacgccatcggagggagcaagaacccgacgatcattagccaggggaaccggtacactgctccaccgaacctgacggcaaagcagatcacgaagcatctcggtgcggcggaggaggagtggaagaactgggtgtacatggcacttggaggaggacctgttcatggaggggacctacttcaccacgtccggcgatgcgacccagaagcagttcagcaacaaggacctgatcaagcccaagcctggatcctacgtcgcgaggctcacgcgcttcgccggcttcatcccgtgcactcccggcaagaagtgctagaccgcgcgcggcgggcggctagccggagagacgattcttatttgtagttgtgtgagcttaattttttttcttctacatatacgtatacttattcaagaaatcttgatctgtggccgggttctggtcaatgtgatcctataggttctatatataaaaaaaagttgtattaactaaatgcatttttggaagcggtggcaatgcaaatttagagaccgggcgatagggggaggagcatatatatgcatgtttgtgcgtataggtctacttgttgatggagatcacggaagaaaccaatgcattgtcatgatagaggacatgcacatttatgcagaaggccctagggctggaattaatttttttttatttattgttttaaatgtatcgtgaaactatattgttgtttgattaactgcaggcatctcaaatgcaaagtgctatatagtgtagctacatagtactacctccgtattttaatgtatga

SEQ ID NO: 73183 - DNA, 635 bp, Oryza sativa
aagcggagaagacgaagagctcctgaaggcttgaaagtttctcgcaacagccggactccaaaatggattcccaaaactcccttaaataggcgcactaccgacggtgcgaattccaaggaaaggagagagatggccaccggaaatttctgggtccgttgcgtcaggcggtttcttggactttaatttaaatttactcataaccgttggacttcgcatggtgttgtcgaacactctttgtctctacggtcctcacaccgagatcgaccagttgagaacgacaacaattccgacatcagaagtcgcgattggttacatgagttcatttaagtagaagtcgggggctattgtcagggttacggataaggtataccctctacccttggacgtatgctatacgcaatacggtatgtcggtgcatatacggacgtcctctgaatacgctaaggaagtccatcacaaagtctgtcaatggaaaggttcctacccgtataggactgggtcgttactatattgtgcagggtccgatgcctccgagtcctacttggagaccgcctgacctgcgatataaaagggaccccccgcggggacctaagggatcgaatctcataggctacacgacgaccacagcctacgaa

SEQ ID NO: 73184 - DNA, 639 bp, Oryza sativa
attcctgcagccctcttctcctccaatcccgtttaattaactctttccaataaatgatcttgcagcttagctgatagccatgacaatccattacccagagtaggcatcaaagaccggatcattgacatcctttctattgacctccgtttctggggatgcatgataggcatatccagacggtattacctcgacatgcgtctttccatcagcgacatgatccgcggcgttgatcattctctttaccataagctcttcataatatacaccttgtgtcttgtcaagtggattgctggtaattaacttttgcatttttgttccactcaattctacagtatacagtatcagagctggtcacaccacatattgcattgcaaaattcattagccttttcgtattcagtgctatgcaggtttgtgttcgcaccgttggtcgtgatgatttttcttactcgcaagtactggaaaacaaggattgcaattgatgcagtcgaaaagttccttcggatgcaagatatgctaggccccaagaggtacgcctacacggacatcatagcaatcacaagccatttcagagacaagctgggccaaggaggatatgggtctgtgtacaagggtgtgtttctcccgggtgatgttcatg

SEQ ID NO: 73185 - DNA, 672 bp, Oryza sativa
gacgctgcgtcgccgccattggcgaagcggccccgcgcgggcgggcgccgtggtgttgggcgcggaggcggaggcgaggccgtctcacgtcgtttaagtccccgtctcgggcggcgaggaaggcaaggacgaggttgacgtcgaccgccgcggggtcgtcgccctccgcgctcggcggcggcgagggcgcgctcggcggtggcgcgcgcctctcggagtcgctcaccgctcggcaccggcttcatcgacaacccgctcagcaccggcttcagcgccgtgccgtccctcgccgccatccccaccaaccagtccgtcgcccgggcgtcatagtgcaggcggcgacggggaaagagaaggcaggcggcggccggcgcgcgagagggcagcggcggcggtggggaaagagaaggcaggcggcggggagggaggggacagctatcgttgcacaatgtttttctggtgctggatctgctggaaaacgcatgcgagtcattacttgatagcatcgttgcagagaatgcaaagcgtttctgcttgatctgagtgaagctatctggaggcaatgtaagcatcatttttccatgtaaccatgttcagtatctatctatgccatttgattgcgattcagataaccagaaaacgctcacatcagcatgcatttacccaagttca

SEQ ID NO: 73186 - DNA, 18477 bp, Oryza sativa
ccatgtttctgccacctccacctattgttgatccagtgcagcagcagcggattcagcagacaccaccaatccagccggttgtgcaaccaatccaacaacaggtcgtacaaccagctcagcaaacaccaccaagccagcagcctctgcaaccaattcagcaaacaccaccaaggcagcagcctctgcagccgatccaacagactccattaaggcaacaaatcgttcagccgatttagcaccaggggtcaatgaacgcatcggctgggttcgcagcacctggtagttagcccatacaacaatttgtgaaccaagtcgtcccagaacatttggttcaccatgtacagccagacggcacagtaatgcctcaggttgttcctgagcacttggtgcgcaacatccaaccgaaccttcataattactaagggggtaacttgagttatcaatatcagcctccttccccgcaagcccaatatcagctagggggattggctcaaccccagttcgcatctcagcctccttccccgcaagcccaatatcagccagggggattggctcaaccccagttcgcatctcagtatggtcagtttgagcccatgcaacaacagccacaaggggcagctcagcaacgaccgtgggccgatgtgattgttgatgtaatgagagaacagtttgggcttaaaccaaaagagactggaagcttgtatcggcagccttaccctgagtagtttgagagagttcctcttcccaaccggtttaaagttccagatttctccaagttttcaggacaagagggcgtgtcgacttatgagcacattagtcgattccttgctcagtgtggtgaagcatcggctgtagacgctctgaaagttaggttattccggttatctctgtctggatcagcttttacttggttttcctctttgccatatgggtcgatcaatagttgggccgatttggagaagcaattccatagctatttctacagtggggttcatgagatgaagttgtcccacttgacagtgattaagcagcggcatgatgaacccgtgcacgagtatattcagaggttcagggagatgaggaacaaatgctttagtttgagtttaaatgatgctcagttagccgatttagccttccagggtatgattgctccaatcagggagaaattctcgtctgaagactttgatagcttatcatacagaaggtaaccttgcatgagcataggtcggcggaagtcaggaaaagctctaagaaggttaatcatgtttgtccgtatatgtatgggtcggatgatggggaagacgattctgaaatagctgcagccaaatgggtgaggagtaaaaaggtcataccatgccaatgggtaaaaattcctaaaaaagagaagtatgactttgatattaccaaagctgacaagatctttgatctactactccgagagaagcaaattcagcttcctgctggtcatacaatcccatcggctgaggaattgggcaaaaagaggtattgcaaatggcataattctggatctcattctactaatgattgcaaggtttttagacagcaaatccaggttgccactgaagggggaaagattaggttcgatgattccaaaaagccaatgaaagtcgatggtaatccttttcctgttaatatggtgcatacagctggccaaacagccgataggatccgtgcaaagggttttcaagtaaattcggctaagattatcaacaagtatcagaggaagtatgacaagtagcaggagaagcattatgaagaatacgacgatggttttgatcctcattggggttgtgagttctttagattcttctggaatgaagggatgaggttgccatctatcgaaaactgccctgggtgcagtgatatcatcgagagctcgagccggtcatataataagggtaatcggctaaggcaggcaagacttcctattcatcaaagattgggtccgatgaatcaagatcatggccaagaggatgaggtaatcaggaagaatcaatggtgtccttctggtattttcacaaaaaatcagaagagaagggttcaaagattgaggaacagggagcgccttcaggaggttgaacaagaaatcaaccatcggctgaggaaaccaaagccaagacaggagtggcgtgttaagaatcaggttcctgtagccgatgatgctgcagccgatgaggcgaagaggttggcaaaaggaaagagtgttgtagcggcaccaattaacatggtctttacattgccagctgaattcgggatagatcaagccgatgtcgatgaagtggaagaggaatcggctaagttggttctgtcaccagaataggcagtattcgagaaacccgagggaacatagaatcggcatcttaaaccattgtacataaacggctacgtcaatgggaaggcgatgtctaagatgatggtcgatggtggggccgcggtaaatttgatgccttatgctacgttcaggaagttggataggaacgccgaggatctcatcaagacaaatatggtgctcaaatactttggtggtaatccatcggaaaccaaaggtgttctaaatgtggagctgacagtcggcagtaagactattcctaccacgttttttgtcatcgatgggaagggttcgtgcagcttgttgcttggaagggattggattcacgccaattgttgcattccttcaactatgcatcaatgcttgattcaatggcaaggcgacaagatagagatcgtgccagtcgacaggtcagttaatgttgccagtgccgatttagccctttgggagatggatggccttgattgtttatctggaaaagtctgggatggagattttctaaaagtgtccgattctgatatacagccaattgaagatggagaacccaagctattactttgagggcgtcgtggagggttctaatgtctacaccaaggatacagtggatgatctcgatgacaagcaaggtcaaggtttcatgtcggccgatgagttggaagaaataaacataggtccaagcgatcggccaaggccgacatttattagcaagaatttgtctccagagtttagaaccaagctgatagagctcttaaaagagtttagagattgcttcgcttgggagtattatgagatgcctagactcagccgatcgattgtcgaacatcggctacctatcaagccaggggttagaccacgccagcaacctctgaggaggtgtaaagctgatatgcttgaacctgtcaaagctgagatcaaacgattgtatgatgctggttttatccgtccctgccgatatgctgaatgggtttctagtatagtttcagttattaaaaagaatggcaaggtcagggtgtgcattgattttcgagatttgaataaagccacaccaaaggactaatatccaatgccagtagctgatcagctagttgatgctgcatcaaggaacaaaattttgagttttatggatgggaacgcaggatataatcagatctttatggctgaagaagatatccataagacagcttttagatgccccggtgcaatcggcttatttgagtgggtcgtcatgactttcggtttgaagagtgctggagcaacatatcaaagagccatgaattatatatatcatgatctaatcagctggttggttgaagtttatattgacgatgtggttgttaagtctaaagaagtagaggaccacatagccgatttaaggaaggttttcgagagaaccaaaaaatatggcttgaagatgaatccgacaaaatgtgtttttggtgtgtcggccggccaatttttgggatttcttgttcatgaaagggggaccgaggtaactcaaaggagcgttaatgcgatcaagaagattcagcccctggaaaataagacagaactacaagagatgatcggcaagatttctaacttgtctggaaggttagagccttttacacccttgttaaggttgaaagccgatcagcagtttacttggggggcagagcaacaaaaggctttagataatattaaggagtatctcaactctcctcttgttttgatccctccacagaagggggtaccgtttaggttatatttatcggctggtgagaagtcaatcggctcagttttgattcaagagttggaagggaaggaacgagttgtattttatctcagtcgacggctcttggatgctgagactcggtattcccctgtggaaaagttatgcttgtgtctgtatttttcgtgtacaaggttgaggcattatctattatctaacgagtgcactgttatatgcaaagccgacgtagtcaggtatatgctatcggctccaatattaaagggaagagttggaaagtggatattctccttgactgagtttgatcttcggtatgagtcgccgaaagcgattaagggacaagctatagccgattttattgtagagcatcgtgatgattcaatcggctcggttgaaatagtgccatggactttattctttgatggatcggtatgtactcatagttgtggcatcggcttagttataatttcccctaggggggcatgtttcgagtttgcttatactattaaaccatatgcgaccaataatcaagctgagtatgaggcagtgctcaggggtttgcaattactcaaggaagttgaagccgataccattgaaatcatgggggattctttgctagtaatcagccaattggcaggagaatatgaatgcaagaacgatacattgatggtttataatgagaagtgccaggaactaatgaaagagtttcggctggttactttaaagcatgtatctcgagaacaaaatattgaagctaatgatttagcccaaggggcatcggggtataagccgatgatcaaagatgttaaagttgaaattgcagcgatgacagccgatgattggaggtaagatgtgcatcaatatttgagtaatccatctcaatcggcttctaggaaattaagatataaggcattaaagtatacactgttggatggtgaactttattatcagacgattgatggagtattacttaagtgcttaagtgccgatcaggctaaggttgcaatcggcaaagttcatgaaggaatctgtggtactcatcaatcagcttataagatgaagtggttgcttcggcgcgcagggtatttttggccaacaatgctggaagtttgtttcagatattataaggggtgtcaggattgtcagaagtttggagcaattcagcgagcgccagcgtcggctatgaatcctattattaagccatggccgttcagaggttggggaattgatatgatcggtatgataaacccaccatcgagtaaaggacataaatttatattggtggcaactgattatttcaccaagtgggtagaggcggttcctttgaagaaagttgattctggggatgccattcaatttgttcaggagtatataatctaccaatttggtcttcctcaaactattactacggatcagggttcaatcttcgtgtccgatgagtttgtttagcttgccgatagcgtcggtatcaaattgttgaattcttcaccttattatgcacaagctaatgggcaagccgaggcatctaataaaagtttgatcaaattgattaagcggaaaatttctgattatcctcggcaatggcatactcggttggccgaagcgttgtggtcttataggatggcttgtcatggatcaattcaagttcctccttacaaacttgtttatgggcatgaggctgttttgccatgggaggttagaatcggctctcgccgaactgagttacaaaacgatttaacagccgatgagtattacaaccttatggccgatgagagggaggatctggttcagtcacgattgcgagcccttgcgaaggttaccaaggataaggaacgtgttgctcggcattataataagaaagtggtacccaaagatttttcggaaggagaacttgtatggaagctgattttgcggattggtacttgtgatagtaaattcggcaagtggtcgccgaactgggaaggaccgttccaaattcataaggttgtgtctaagggagcatatatgttgcaagggcttgatggtgaagtctatgggcgagcactcaatggcaagtatttgaagaaatcttacccaagtgtttgggttaatgcatgataggctcgtattgccgatgcatgatagccgatgtgcttacatcgccttgagatggctgatattgttatatcgcccttagttgtttttcatggtgtaatcggttgtggtttgccgatgtacaatggccgatattcttatatcgcccttagttgtttttcatggtgtaatcggttgtggtttgccaatgtacaatggccgatattgttatatcgcccatagttgttttataattttatcaatgcttttgacattgtaaaattaggggggcacatatatgtcaaaatgcaatggaaaatttttgaacaagttttcaaagtcatattaatcggcacaaaggattgttaagacagtacagtattagaatgtcttagccgattacaaaaaattctaagtcctattacacaaaggttattgagacaagtatcgctggatagccaatatagccttctgcctaatctattctacttcttctatggcttgggcatcttgagcgtcggttccagggataactttcagagacttggtcagatcagcaacatgcttgatagccgatttgagtcttgctttctgttcttcaatagtatttgggagatcggctagttttttgtgctccatatccagctcagcgttgcattcttcaagttgtgctaagagttcaatcttgcgagcctcgagccgatcaatgttggacttgattgggccttcagatagttgatcaagcttggacttctcttcatgcacaagttgtcggttagcttggatagtagcttcaatgtccttgcgctctcgccgttcggccagtcttaacttggctttctccagtttgaattagtgttgctcaaggtaaacggctggggtaaggatatcggctaactcatctgggattagagcctgaatctcatgtagccgagccctgattgagccacaatcaaccaccaagctatctagtgatgatgcctctagccgatcagagatactttccagagttttcttcacatcatcagataaagaggctaaggctttgcttgtggtatcttcttctccttcatcaagataatctctgatgttaaaagagaaaagatcggctaatacctgcagcaacgatttagaagcagttagaggttaaataggcatagccgatctgaatgtttgttgagacaaagagaaacttactgggacagcaggagcagttggttgttcttcttcctcaacgtgatgactccccacagccgaaggagtctggtcacttgacgattgctgtacagaaggagaaggaggaggaggaggctaaaaggaaacaagtgttagacagagtcggctgagaattaactaatgaaagttaaaattatcttactggtggagctagtttagatgttgttgcagccgatttcttcttcactgcagtcttctttttctgcaattataaaacttggaagtgatcggctataagacaaaataattatgaaagggattaaagagagatacttacccttgtaaagtgaacgggggcagaaggagttgggggcgtttgcttgggtgaagccgatggtgttctttctgtgtcactcatttcggctacagcctggtcaacatcttcgccaatttcctcttcatctaaggcttgttcaataaatggatccaaggcgggcagatcatcagccggcttatcagtcggtttggttttcttgaacttggcctttttctttggagccaagaccaaggtattcacggctgatggtctggttttccttttttggcctgcatcggctagttccctagttaggccgtgaaggagagttgaagtcttgggggcatgatagccgataacagggggagatagcccacctccattcagaattaaacccgaagcatactcaatattcttgccactattactttgatgaggaggggaggactctgttgtctgcaaagcaggagcaaaagattggtcaagtaatgaatcggctaattgactatgcaatttagtaatgacaaagtttacctggggtatgacgtcggggaacagatctgtcatatacatcgtagccgattgatgaaacagatgcagcttccattcaccccaccatctgtcaaagtttttgcttctaaatcctgccaactcaatattttcaatgctgcccagaggaggcccaggtaggttaagtagccgatccatcattagagtggatgtgatttgtcctcggcactgaatcttgtcggcaaaaaataagccgattgggagttggcccaatccaagttgtctggccgagctcattgggtgataaaactcgtaggagtcttggatgtttctcccttgatgaatgccgacaggaaggatgcatgggttgattgcggctataaaaacttctctggatttttggaatttcttgtgattaatatcttcgaatctaaaatctgatggaagttcgaggtctgcggagtcttcataagggaaccagattcgtgcatctttcttaaaaccttcgtagaagctacagaaccagtccttaagcagctcggccgataactttgctcctgcatcggttggtgtggatgcatattctccatacgacatgcacctgcgatgggtgcgctcttctccgtcatcttccacgatcggccctggcagtgtgaattcagcttctgttatagagggccgattgacaaccttcataactatcaggtttaaccaagtttgcagcagccaccagggtccacctgctccaaccactgagccgacggctattctagccgatgcattgttcaacatctgatacagatagccgagaaggattttgcccaaagggaattctttctttgattctaaggcttcagctacgaactgccaattggttgtagggccacaactggatccacagaagaggaacttttccagccacatgagcaaaaaggctacgtgctctcgaggggtaacagatccttggcccatgtatgccgccacatagccgaaccaaccacctatgctcttggtcttcaagtcaaattggttcttgatatttatgctcatggggttagccgatgaagtcacatctaatccggtaatcatggtgatgtcgattaaagttggagtcatcggcccctggttgaataagaaagcgttgatggtgttcgaccagaagtaggtggcggcagccattagaggttcatccttagcagaattggctatggtgagagcaagtgcttggccgattccaatctcgtcccaatgaactttcttactagccgcgttgataccaagtagaccagctcttatcaggtgtgagtttttcgagagatggccaagacttaaaggtattcttccagtgacccaagttagggttggctagcctaaaagggatccggttggtttcaccaatgatgaaatcagtggggtcgagattgccgattgggccaaggaaatagtggttctggtgcaaaagactgggaattgcgacttggtgggagagatgctacaaatccaaggcaatcgatataaggaaaacgatataagataggagaaaatcgatctgctgataagaaaggggatctagccgatagagacttacctcagtgtactcggttgatggcgcatcagatgggttggtggaagacgacatcgttgcaagcggaggtcttgccggagaccaagtcgcccgggagtcgcttttgcatcggaggaatcgccggagagagaggggattaagattcgcttgaacggtgaaaacggaagtcacggtgtgagatttctcgagggtgacggttagtatttaaagcacggcaataacggtcggaaaacggcaaagtgcgaaacttcgtcggagtcgatttacagcaaatccgaaacatttccaaatattccggacttgggggcgtgtgttaacaaccaaatttggtaacatcggcattgggaaagaagattagatcgaagcaaagtcggaggcggagatcgagttcgaaaacagagcaggaatcggctggagtccagatcggctacgatgagatcggctgagtctgagacgggctaggtgagccgatgtagccgatcccgacaatacgacttgtatacgacatcgggtttaagttaatgtgcttcaagatgattgccatgcacggatagagtcctgggaaggcaattgtatctattaattaagatattttatgtaaattccttatagataaatgtgggcaaaagtctaccgcaaagacttatggtattttagggtttgttagatataatagtcgtgtccggtatgggtatatcttgtaattctcgggtataaatagaccccgagccctatgtaattgataacacacacgttcaatacaattttggcgcatcgccacccttttgctttagttttgtttcgacgagttcttactttcgggttgagctgcatcggattcgatcttcaacaagaggtaaaacttgttatgatgacttatattctcgggattagtgcttccatctttatgacactctaatcttgtttatgtaattcgtcgagttatcatatatcttacataatctctggcaatatcgctatctaatctactatcggctaacatctgttagcagagggcaaccgattaggttagattttgacgttgatctagattatataagatatctaccactctatgaaacttctagcggcttgattgtctagatatcgttcttcttttcatacttaatgctatatcagttgagtttgatctattaagtcgtgcttagaatatcgatctttagcctgccttctagttgctgattagagtagcgtcggagtttcagccgatcttatctgatttaactatatttgttctatatgcttcattgacatgttaaatctgtcctttatatcgagatattgttgtatctaagtatattaggcctttgtttgatatattatacctgctttaatttcctgatatagagtagtatcggagtattagccgatacatgctagatctatctgatcggctatgctataaacatatatagtcctgttattgatatatatatttcgatctaagtgatttatactgtctcggcatggtgaccgatctatcccgatcacttgatttaagtatacatcgatataaggggtatatatcgttgatatctacagctgatcgagtagatttagttctttcttacttattcatgactgccgaccgatacacagatgacatcagctcaaagataaatgatatgtcatcggcatctagccgatcggctatcatttatagttttaatcacggtttctttgcttctatttcttgttgattacaggatcaaatcaattggcacgctcatacattcgaaggcgagctttggacctgcactggagttaagaagatctcccaggccacgtgttttttgtcaacagatttatgctattcgtagcttacgcgtatcccatcatcagcctgtcacgggcgctggggtcgtcgcgctcgcggtggctgcacaccagagccgctgctatgattacccacgctagagtcgccacgcctctaggttcgggatttgacgctgctattaacgtgcgggaagaactcaagatggggaatatgaaccctagagcgagaggaactctcccttcccctcctattagtttgcaaccgcctggtcagcatgacaacatggcaaatacggtccagtcagtctgccacgtgtgcaaaacctcctcgtgaaacagcctagggggttaaatggactggattataaggtttggggggctagataccccattttatagttctgggtactatatagactcttgggcatagtctagggggatttggacttttttctatccagtaaaagtactacttagaatataaaaatgaggaggaagagtctcttttagtagaatttttactaagctattatgcaaattgaagcgcgggaggaaaggagctggctgtggctggggagggggcaagtgcgggtgctcgtgcgctcgcgtggtggtttggcccccttagtctctcatctctcctctctacacacacacgcacacacgcgcgcgcgcgcacacacacacacacacatatatatatatatatatatatatatatatatatatatatatatatatatatatatatatacactttatataaatacgtataaattttgtatatacgtacacaaattatatatacatatataaagtacgtacatatattgtaatatgtatatgtatatgttttttatatagatatgtttaatgtataaaaagatatatacacatgtataatgatttataggtgcgtataaaaactttgtatacgtacataatttaaaaacaaaataactgagagaaaagaaccaaaagaaaaacatatcacaaactttatatacatacacataaaagtttgtataggtatgtattaaaaaagggtgaattggaaccatctagagaaaaaaaaaagagtgagaaagctgaaaaaaaaatataaaaaaaagaccacgtgcctctttcccacgctccgcccccttctccgcgcaagccacgtgactgcgccattagatagcctttttgccaacctagtatttcctcagctgctcagctcgtcagttgtcctataccacgtaatattgaaggagggatgacctcgaagctaatgccatctggatcggtctcagcttctcgtgccgtcgtgtatgcttaattatgtggagtatcttttatgattatgcacgtgacaaaactatatgcaaaaacaaaagactatatctaacgaggagaataattttgacgagctaatagacagagagaacagtgaaaggttattaaaacttggccgacaggaagcacgtggcgccggtggtacgtccgacgaaaggacggtacccccggctcgcagttataaaactagcagtacaaggtctgctcatattgatacagcagctacacagctagcaccactaataacgagcaagctagtcgtcagtggcgaatctataacgaaaatataggggtgctcctttctaatgcgttttaggaagtatggatgaaagcttgcatgtcatctaaatagttctaattaatttgaaaaaaaataacaatatgtattgatatgaaatatattactccataagtatataacttctacgagttacaacaaaaataacaaattaaattgaaaatagttatcgtacattcacaattatatttattttttttgcaacatgtagaagttgaattttaactttcatgtttgtggagtgatatatttcacattaatcatttttttaattttttgatgattatttagatgacatgcacaaaacgatgtgatatcccctcgagggataaaaacgctttcccatgatggaagacaatacgacaagggcacaaccacaaattcaataacacaattgttgataattgttggattactttgtgagtaaaaaccactcacttccctaatcccctgatcgttccatccattgaagtaggaaaaaaaaaagaaacaaaaactaatacagtagcttaataaggaaggtctagcagccaattagtccacttaatcacccatggatcgcgatatgttgtctttgtttgctccttccttgcgacctggttgatctgcacttatgctatacgctgcttctctcccgaaaccatgcggctgctgctggttctgccgagatggagctggggctcaagccccaacgagccccaacgagccccaacggtgaatccgcccctgctagtcgtagctagctagcgagtgaatcagtggagtgacgagagatctcgcgatggcgaaggcggtggtgctgccgctggttagcaagcttcaggaggtggccctgagcgaggggagggcgctggttggcgtcggcggcgagatcaaccgcctccgcgacaagctcatgtggctgatggccttcctccaggaggcggacccccagaggcgggcggccgacgccggcggcgagctcatgcgcgtgctcgtgcaccagacccgcgacgccgcgttcagcgccgaggacgccctcgacgactacgccgtccgcgtcgacctgtcccgctaccccggctggtcgcgcgccgccgtcggcttcctcgccggcatcaccacccagctgcgcgtccgccacaggctctccagcgacatcgcggccatccatgcccgctttgaggagatcgtcggcaacaaggacaagtacaggctggagggctctgcgccctcgtcgttgctgacgtggactgcctccgccgcctcctcgagtgaatcaatcctctggttagtcaaacacagtccttacacgatcgaaacgctctattcacttcatacgtcctccttccatactcgtaaagaaaatcgacaatatttaacaatataaattataaataactcagtcaaatcttgagaatataaattataaataactcttaagttattgtgtttaaaaatataaaaattatataaatagatttgtcttgaaaaaaactttcataaaaagtatacatatatcatttttcaataaatatttttatagaaacaagaagtcaaaattatattttgaagaccgtgttaatatcctaaacgacttcctttacgagtacgaatagagtactcgtacggggatacaagcgagctaagcggcgaacccgcttataaacaaaactagtgcataacccacgaattgactcataggttaccttctaagggtttgttcggcacctccttttcccaacccctctatctcgttttccgcgcacacgcttttttaaactgctaaaaggtgtattttttgcaaaaaatttatatacaaaagttgctaaacggaggaagtactcggttaattataattacatgctaatgcttcatgtctttgtatacgccattcaaaattccagtgaaagattcatatctcggggctgtgtttttttgggaggttgggaaccctcccatctgcacggaaatcggagcgatagattaacacgtgattaattaagtattagctattaaaaacttgaaaaatggattaatatgatttttaaagcaactttccattataaacttttgcaaaatgcgtaccttttagcagtttaaaaagcgtgcacgcgataaataaggaagatgagttagagttcatgggaaagaacacagctaggcttttccttggtttcaacgattaggcttagattttcgacacgggcgtgaaacgtgaaaaaccgttagcatatactctatgctaattattgaaaaaccactagagtaactaatctagtagcattaatttttttaaacttgaaaaaagttatttatttgatttttaaagatactccatagaaaaattttacaagaaacatatcgtttaatagttagaagcgtgcttacgaagaatatgaaaagtttataagaactcacacaagagtggttttctggatggcatggtaatatatatgtagtgaaacgttttctttatttttgtaaatccaaataaaggaaattatctttagacagttttttccccaaatacagtatagaatctcatgtgtacacacagagcttatgatcacatacacgcaacctaccaagtatttctgagaaattgagctgtcatatacacttaaaatataataacccataaatactaacatatcagtattgagtcggttacaacaatgcatggtagatcatttgtgatcatatggacaaatttggtatgatttaaatagaaatatgtaaatatcatcagttcattttttttatattacatgaagtcatttctcacatgagaaaaacttatttcactatatacagatgttaacacagatactctatacagcaattgtgtgtatgttcataatgcatgtatatagaagtcagtactttaaaaaaattgagaagaagtcgcttactacttaattaagattccaaattaaagtggttttagcattgtcacgcattagtaaagctacagtaaaattgtgcaaagttaattaggctcccatcggatggcctaatcagctaaagaaaaaccaaattttaaatttcatacttaattttgagattgattttcagatgttttcaacgtagtttctttttcaaccttggcttttaaatcacccagaacacatatataaaagttttacctacaaattcatttgtattccctaataagccgttttggcttattagagaaaaagccaaacgatggggaccttagtttagtactcccatccgttcccaagtagttattattataaattgtttagcatatattaatgtgttgggcaagaaataaccatagtaccttaatatttgattcatgtgttgttgggagtgagagggtggttaaaggtaggaaggaaaaactatatattgaggataactgaggtaacaaaaattactctgaagtaagttactctaaagtgataagtctttttagataaattacgaatccttaaacgacgaccagctatataggacggaaagagtatgataaaaaacagacttgttccgttttaaacgaacgtcgataagacctctttaattaatttgtttttatatcgattcttttgaactttttcttctgcaaagcttccggaattattattcaatctcttgcggggaattattattcgatctcttgcggggtacgggttgtttgcgatttggctgcatcactccgttgactgaccacaaaagtctcgtcaaatcacgtgtctggccagtaaggggatagcacatacttgcattcaaataaccttgttattaagacaaaacgaaataggaaaacttgccacttggactaaatgatatgcaccacttgtacttaaaagaacgacttacgtacctttagtctcaaattaaactttggtttcttttatgtcatctattcttcaacaagcaacttataagaatattctaaacacaacatcatctaactatcgcaacagtacgcatgatttacacccctaaacttctatactgaatattttacaccctccaaattttcaaattgaacgaattaccctctaaccaagccaagagcagtttgatgccaagtgatatacgcgtggtaaccgagccaggggattttttttttcaagaaaagtttaactagcccacgtgtatattcttcctcccaatccacttcctttctttctcccctttctctatttcttgtctcagttgcttcgagcacatgcctagctgttaaaaaaccggtcccaaaatcaccattggaaaccgaacatggaagaaacgccataggagatcaagcacgatgagaacaacgagacacgatatttgttaacgaggttcagccgaagcctacatccccggggcgctgattacaagcgctatttcccgatccagcatattaaaacgtatcagagttacaacgaccctcggccggacgccgcaggcggccgctccctctcgctatattaagtcatcatatggttacaacaggtctgactctctatttaagagagatcttaagatagagtccgactcttactctagacctaatgcctattacaactccaattcttaaattgtaacctactttgtacacatattcgacacaaaacactaacaaattccacatcggtgaatatgccacgtcaacctgaatttgtcccatgtatgaacctctgcttacccagacttgagttggttcctttttgccgttcatgttgagccgcccccgacgaaccttcacccggctcccgttaacgagagaccttgctatccccgtaaattatctctcttgactccacccgcaacagggctccaccttctctcatatcactatagtcgtcttgccaagtgaaattaaatttcttcttagctggcacacagcagactccgcaaagaccttgttcaccttcactttccattttaagtttgagttgatctaatccatgatgtgataatacacgtatcaccaaaatagataaatcaaatacactagaaatgaagagaaccctttatgtatcctaaatatatcatgtactgtcaaacagtccgttgacactctcaatgatattcatctgctgctgcctgggtcctactcgcatgctgcttgacaggtcgagtctccctgcactgcttttctgcccgaaccaatactttgacttaatatgacaccgttgcatagccaatgcaagaaattccttacacatggtctgaattgtagcatgcgggattatgatgaagatacatgcatgcaaatgtatttaccgtccaggagtacaataattgtgttataatcctgaccaagtacctatgcgtgtaatattcttgcatgcagtgcagacacctcggt

SEQ ID NO: 73187 - DNA, 12479 bp, Oryza sativa
  unsure (1)..(12479): unsure at all n locations
tcctgcagcccttaaattactgctagaactttgtctcgcagtgtgattttcattaaaaggaaaagtatttacaaaagataattacaaagagagcactgaaaatattataatggttataaccaatcaaaaactctttactttaaatgatctttcattccgcacatatgcagaagaccttctttcttgaacaaaattctccaggcctcaaaggaagaattcttgttctgaaatatctttccatttctttctttctaaatatgccgggcagcaataaagaaatttccaagaagcccttttgccggaaacgcagtcacgctaccacaaccatttgaaagaaattgagattaggatcccaaagaatgcctaggtgccgtcaacatctctgactgaaaggacaaaagaagaaaagatgtcctcttatttccctatgaccatttgtacgaagtacacatgtaagatcatcatcctcctttgcacaatgccgatgattaagcatatctctagtgttcaacctgtcgctaaaaagaagtcatgcaaagaccttaattttcataacactacgtgttttccaaatccaaacataaggccttggcgtctgcaaagacatgaatataagcttgtaaaatctcttagcagtatatctagtagaattccatatgtagctccattcatctcccttgccctcgtccaaattgagaagagagacctcatgttccaatttgagatactccttgtaagcttgactgttcagaggcaaaagaaaacagtcctctaaggatagttactatagaccgatcatatttgtgctaatttcttttttttttcaccgatcctgaacaccaatatatattattgttctttgcacgtgatagttaaatctgattttttttagaggtgatatcacctaactatcacgttatagttaaatctgattttttttttgttagaggtgatatcacctaactagtacattcaaatccatacaatcaatcaaacaaaatatatttcaaaccgtatctcatatgtgtatctcatatgtaagtaatcaaacaaaatctcatactagtcacgctaaaccaatactcctttcattctaaaatataaggcataaacactaccaacatgaatacaaataaataatttaatcaccttatcggttagatcatatcgatgaatgcgtgcaatataattgaggtgcttgatggtaaatatatagatgcatatacgtttatattatgacacataaaaaatgattgtattttatatcttagaatagagggagcacaaggaaccaaacatatctccttatcgtgcccaacctcagcctggacgaaaaagatgggctagactaaggctgcgttctttgcatagcggtagaggaagatttacagctcacgcgaaacgcaaagcctattagcacataattaattaagtattaattattataaacttgaaaaaacaaattctatatagaaatttgctgcaaaatacgtatcatttaacaatttaaaaaacgtacttacgaaaaatgaggatgttgaaatttggagttgaagaagagagctgggtctaaggagataagcaactaaaacaaccttaagcggatcggagatgggaactaaaaactcacccatggggctggatgcaagtatagctcatcacaacacatgagcaaaacccattactaccacacattaaacaaaatgtaagcatcgcaattattagtatgcaagcatggcacatcaacctactaacacacaaaaacttaacatatactagcatgataattattagtacgtagtaaaacttaattgcaactagactactccctccatccctgtttacttgtcgctgggaatttaagtcattgtccatgtcgtgggcagctagtaggtgagccactagcatgaatagttttattaatttttttctccatgtttgttgcagacatgtaatggtaggcgtaatactagttttgtgtcaaattttaagcattgaaatgattaacataaaggcacattggtcatttttacaacactatattttgtcatttctatgctagaaagactactaaactgggataccatctacaaattataacatataaacatgctaaataattatttcttatataactcttataatatcttaatataaaacgatcctaatttttatatttgacatatattcatatataaatctgtaagtcctatagtaaagtagccgaatcctgattgccgctgcaacgaccgcgactcgactccgcgaggtgcgacgcgactgcgcgattcccctgagcgacgccgccctcatgccctcattcctcccgcgcgatgcgagcggctgctcgatggagataggcacctcgccaagctgatcgacgccgccgccgcctccgtgccgaccccgtacgtgagagctccaggcgctgttctccccgaggcgagagtagcccctggcgccacaacactgtccggcggccatggacgccgcgacaggaaccccggctgatcagagcccgaacgcgcccctgcctgtccgcgtcagtgaggatggcgtcgaggtgtcgcggccgctgacagcggtggcgtaggcaaggtgttcgacggaatgcgtcctggcttctgaggcgccatggctcgacgacgcgcgaggccggccgtgggcggacctcccggcggacatcctcggcctcgttgtcggctgcctccccctcgtcgaggaccgggccaggctgcgctccgtctgccgcgcgtggcgcgtcctccaccagcggtcgccgccgccgctgcccctgctcgtgatggccgacttctccttctccagcttctgcgcaggagagaccatcatgggagtgcgtggccgtgtcccgctgccggagagggagagggagatggcggctggtggcagcgtctgctgcgtgggctcgttcgagggatggctcgttggcgtcaaggccaacaaaggtcgctacttcggtgaccgccggcgtttcttgatgaacagtttctcccgggatgttatccgactcccgctaccttcgggagcctcccgctccgctgatgcctacactaggtctctccccatcatcaatggctctggtgtcttgcattgcacgatcaacgcagcgaagtgcgtgatgttgttctggaaggtcgtcttgtcctcgtcgcctgactctggctccaagtgtgttgtggccgccacctccatggtcaaggatgcagttaagcttgctctctggcggcctgggatgaagtcgtggagcgtgtgtgatggtgatactatcattaggtccattgatattgtcttctgccatgccaagggaacctccacatgctcagtttcggcaaattcaccactaacctcttagtctttgagatctgtgaagatgacaatggcttgatggtttctcgtgttgagtcttgtgtgatcaaactgcctggggtcatgggtaccgctaatgagacttggagcatagtagagtggcgcgggaaactactgatagttgtgacatactttggtgaatttgggcacaacattattgagattagagtatatgaggtggactgcagcacaaaccctgccacattcactgagatcaagagcttggatggcgactgcaactttatcagccaactcagcagcaagtcttttcgtttatctcattatgatgtagtcaaagattatcttatctattttatgcatgaccgctcttttgataaatctgtgtacaacatgaaagatggtacaatgacaccaattactgcagacatgtcagaggacaaaatttagacaccagatggaagactgatgaattcgacatggttatttcctcctgaatgaactgctgcatatcaaccccgatcctactgagtcttaatgtatgaagcactgatttttatagtagaaaaacttatgcatacttaatttgttttcatgtacctatgtgaacaagtggatttttagttgctttcgcactcttggttgtgggggtgttttaagttcctgtctatatgaaattatgaacaatgtttctccagatttcccatccactagtatgctgcaatgcggttatatcaatttctcttttaattcaagctgaagtgtttttcgtgtttctaatcaaggacccctggactgtgctgtcattcttgactgtctaggaatctggagcagtttacttaggggaattatagtcctctaggttgatgttacgataattaaatagaacatggtgtttgcatatcatcatatgtggatctgctaggcaagatattcgttacttgaaatgcatactgtttttccttggacactttcggtcttctgagtttgtttcggattacaggaaattagcacatgcatttatattttgtcttcatgatacaactttattgttttttctaacatatgtgcatttcttctctcgctctttttctaaaatgttgtgggagctcttgtcaaaaaaaaaatgttgttggagcatttagatgttactcggctatttttatttcatctcgaacatcagtcgatttttgaccaatgacaagttgacccataatatgtattaagttccatgcatgaagggaaactcagctgttttagttcattatttccgtcaggtttttatttcttataatagaggaaaaaaatcgactacgtcattgttggattgctgttcaaaaaaattgagtgaacaattctcttattgtagtcaattgttgtttagaaatttcgtttttttgtactatatatttttatgaggctgacaaaggtcctgtttggttccatgggctaattattagccctgaattagccctaaaggatctaaacaggtgggctagtttggagctaaagtgaattagcccccctcaaaacattagcccctccaaggggtgctaatggagctaattttctatggagaccatcaaaaagcagccctatctccctctctcttctctctttccaccttttagccccaaattagtctaaggatccaaacatgtcaccctacattagcctaccaattcaagactaaatattagctctcaaaattagccctgggctaatcttccaaacaggaccaaagtgacaactgacaaggctcagtccaccgaggcgcaaaccaaatcattttaaatacagaggtggggggtataattgtgatgggtttgcgctggggtggtcgatgcccaggtatttgtattgttttgctcccaggaagaaacccagtatgagcacagagcactcttaattcaaatgtaatagggaatgagaatcaagtgaggatatatatgtcagcaactgcagggacttttacatgtcatcaactgcctacagtgtgtagttgatagttagaacatgttgtcatgcatgaaagcaaattaaagacgagaaacagagcatgcaaactaggaaggcagcacttcctcttctatgggttacacatttttaagataacaataataatataaaagtcacagtctctgcgtcatataatattgcatacaactattatatatatcaagcatggaaactgccggtcgaccggcgcttagagcaaggtcaatagttagccggctgctggctccaaccattcttatattatttcgtagttactactaaagccaactattacaatagattagctattgtgctgactataattttgtaatcaaacaattaattgtgcatacaggtattgacatgtatgatcataagtggatcctattcttgtggtcattgttgtgatatgagggtgaacacaacaaagcaagctcgcgatggattagctccatccatacatcgatcccaccgggtcttcatgaatgatcagtgatcagattatgcgacagcacaagacgagggacggtcaccgctacttacctcaccacgtacccaaattatcaggatttggcgcacgcatgagatgcttctcgtcggtagcaattgcgccgccaagacttcatggacgaggatgaggaactgaggatgagtgtgcgtggtgcaggatggaggacgagactgcgtgatttgtgggggcggtggggttttctcgctcgctgacaatgaataacactagcggaactgcggaagacatcgtccgtcggtcgacgaagcaccggagggcggaacgaaggaggatgcgcacgggatcggataggtcaccatgggacccacaaaatatgtttttaatcgcgagtgcgcgtgaaaacgcgtgctatcgccgggcctgcgttgttctctctttgattctctctcctccatctatgaaaaaaacaatataaaaatttttggagcctcctgactaggattatcgtactgctcttagaacacatgccaagccacactagaaaacttttatatttcaaccaggtttctagacttctacgataatattccccttgttgatgacgtcatggacatgaaaaatgtgccataataaatagggttaattggatccatgccattataaattcttcagttttgatttataccattactattcaactatttagtgttatgcaattatacttttttaggtattggaaatatgccactacataccccttcgatgtgtttcacaaaatttttagactaaattgccctcatcttcttccttggcctcatcgtcgtcttctcccatcgtcagatccaaatctggcttagggaaaaataggaggtagaagatgaacgagagaagacgacgagggcaatttagtctaaaaattttgtgaaacacatcaaaggagtatgtagtggcatattttcaatacttgaaaaattataatggcatgaccttaaatagttgaatagtaatggcatatctcaaaactgaagaatttataatggcatggatcaattaaccctaataaatactcatttaccagcgaatgcaaggagacacatcaaagaaaaatcaggcattgatgcctaccatacctaatccagggtgatcacggtttgcatttagtccatatgacaaataacaggattgccactcataacagaaacaagaaaatgagagggggagcataagctatgggaagcaaataaatgcaagtctgtacctcgcaatacctttgcacatgaaaggctgcagatgaattaattccgttaactttgcgagccatgtaaacaaacaagccatttgattaaaatttattgcttaatcaagtttgttatattcgacctcaatatgtttggtgatgtattaaagatggaatcgcacccaaatattccacgaaaaaaataaccctgatgaagaggcacgcacaaagtagcgaaaaaaaaatcgtagtccatgcatgccatatttctagctatcaactttccagatgctccagatccaaacaaacaattcatatgatcactaatcgagtttattcagtggttgtgtaagttgcaatagtacagaatgatccaggaggcgggtcgcatttccgcgcacaaggaaacgaaattaatgacgaactacaacacgtcaacacccgactcctgagaaaaacgaaaacaagaaaacgaagtacaagtctacttacaggtaatttgcgcattgtgtaaaaattgcaaacagaaggaaatcactttcgcaatgtcatattgcagaattggtttatgattgtcgatgacattttgaagaggaaactgactcttcgtcgatgacatcgtacaactttcacttgaagattttnnccctttnttttcccccctttaaaaaaaaccccaanccttgggnaaattangcaaaaagaaggatatccaattgttacatgcatgtaaacaacatatgatggaaaaatacagagctaaagcgatataatttgacaaacttacaaggatatatgcttgttagcctttggttatctctttctgatgacaagtgcagatacgctgaaaaagatttatgtcctcatgtctaatcttgttgataatcttgtgagtaggatggatcgagtgttggtaatttctactgttcccaatgatatgcaaagagaccaatacaggcaaagcatgctcctctatcacaacacgtttggacgtgtcgtttacttccaattttttcaagcaatgaaacccatcaggcctgaaaacaagctcttctccgtcacaagaaacatccttgagtgtgagattggaaagaaggggcagcttgcctagctttccaatgaacccttgttgcagacacgtctttgacaatgacaatttgctcaagttcggcagctggaaatcagaaggtgaagtggtcatcttgtctatttctggtgatggagttgtgagcaggatggttccggttagttctatagtcttgaggaattgcagggaaggtgccgtaaaaatgctagagattgggaggtcaactcctttcaagatcagtgtagtaaggttgttgagattgttaaggttgtctgataacttgcgcgccttctcctctttgagcttctcttggatagtcacatccagtaacttgaggttaaccattcttctcaacatagagccatcccaatcctgcaatgctctcaccgacttgagtgtatttagctgtttcagttcacgagtccatcttggcacgatcagctcagagccaaacacatgccttagcgatgtgatcttccaaaaggaacacggcagttcatgcactaagctttgtctgacatcaattgtttgaagatttttgagattcccaatcgacgggtggatcctcctcagagatcggcaacgcgtgctaaggtaacggagatgcaccatgcctccgattgcctcaggcaactcggtgccgatattcaggccttcgatcatgattactcgtaggaacttggatcttttcagcagcttggtgaggtcaaatcttgaaattttcggtgatctgtgctgctcgcatgaacagcaggtggggaagcagctaggagatgatacactttcttctgctgtgctggctggtatctcttcgaagattgcaaagatggaccgtagcttgggcatcttgttatctagtgccgcgtatctgtccatactgttatgtagtgtgaggcgtcgagccctgtccggcgatgggaagtagtcaccatcatgcagctccatgaagtttgcctcatgtgcctctgaccgtgcaaacaagtagacactgtcatggaggaaaaagtggcggatgtcgtagtcaccatcagctgatgcttcagtaactagtcccctagtggtaagctgcctcaggtatagctgtcccagttgctgtaccgtcttcccgtgccgcggcaccacaaagccctctgatacccacaagttgacaagcacgttctggtacaccttgtagctgaccgggaatgctgtgaagtagaggaagcagagcttgagctcatggtgcaggtcatcgaagctcagggacagtatcctgttgagccgcttctctttggctgactcgaggtattttaacaccctatcccattcatgtggatactccttgttgtgcatgagtccagcaagcaggataactgccaatggcgagcccccggtaatgtcatacacacgctggtagtatattggcaggtaggtttggttttgttcatcctcctctttgccatggagcctcatgtggaacagcttcctgcagtccgtttgattgaggcatgtcagctttatctcatggacatcattcattgggtggtctagaaactgtggttttattttcgtgatgagcactacccgactacctctttcgttcttcggaagagcatggatcacagcattccagtcagcgatggacatctgcctgccatcgatgatgatcaagtagcactcttcaccaagacgtctttgtatcttgcttctaggattctcattgtcactttcgttattttctttcttcagttctttgcttatcaaactcaggatgttggatataccagcatcttttccgaccttcactccaattcgctctttgaagtgttctctgacagatggttttgaacagacactgtttacaaggatcgtcttaccaacaccactatcgccgacgacatatattacggcgaggcatcctgcggagctgagaagcattgcctctagttcctgctgctggtcgtcacgcccgataattggtggcttggatgtacccctgcatttccaacaagatgacaatctacaggttagtgtatggccatcaacagaacattagccccaaatagcctaattttggggctttgtttggtcacttccagaagttgccacaattttgtagcaaaaccacgacatgtttaagttatatatggattgtggcaccaaaattggtggccacacttgtggtaaaacaagctaaacaatatttcataaaaaaacaaggcaaacaatatgtgacgagtcagatcaaaattaagaaattatggcaaaccccaacctgtagtaaatgattaaaacactagctacaaattatatatctatatatcctatatagttgggaccaaaagctcaacatacataaagccacatcaccctttaaatcttaaccattgtatcattaattcttgatatgcacatgtagctcatgatatctgttggattgtttaggagagagatgactgttatcttcttgtgtaactgaggaattaaattcctttaattatttctattcatgaccttataatgttacctcccaatgcatgtgtcaattcatctaagcaagctcatcaacatacattgacccacgtcaccgtttaaaccttaacaattggatcattcttgaaatgcacatgtagctcatgatatctattggattgtttaggagagagatgactcttatcttcctgtgtaactaagaaattaaattcctttaagtatttctatttatgaccctaaaatgttacctccccatgcatgtgtcaattcctttgagcaaccatggtccacaaaggttaagatattcattatgaatgtatcatactattgttgtggcttgaatttgtgttggtaaaaatacattattgtgattaggatggtaccaacaatatttgacgatgttctcacaatattaaaacatctgcataactaatcatcaacatatttttgtcctaaccatctattttttaaaaaaaacaaagaaaaattaaaactatcataagaaattctaaatattataaatagtatcttgattcctttaatgtgtatttcttttcattttagctcaagtcatctaaaagtgaatattattttgtttctaggtactaaacaccagttcatccccactaagtgtagttaatgctatttctctctttgtcatgaagccacatggatgattgatctacggtccaaatttattttcctctttatttcttgttattaaattatatcaccttaattttgcttttggatcataacatctatattatctcccttatttttcttttctcattgcaccgcatcaccttagttttgttataaaccatatcatcttataatgtttaggttttttctttcaatagtcaaccaaagataaaaaaatatataaattattccctcctttttctcctatcaacttagttttgcttttggatgataaatgtaattatctcccttcttttctttctcattgagccacaccaccttagttttgttataaactaccgttcatagttttttttaaatagtcgatcaaagatgaatattgtataaagtatataaagttgtcatctagctatcttaaatgatacaaaactcctgcagcacgggtttcatcaagtatcaaatatgactaactcaagtgttgcaaactactttaattagtgaatcacacacaccctaactaacatatttcaaccattagatccatatcaaatcatcaaaatttcttcaacaatatcttatctagacaaccaactgctagcctcctttgtcttcaatccaagacagtgacacacgctacaacaaaaataacttgtagacacatttttctaatattgtaggatattttctaaatgtatttacaaggctatagaggcattttataaaatgtatactttgtgtcatttttgaacagatgttaaaggcatattctagaggcattcaattgtgtgacaaacataagaaaccactatgaaaaatgagagattcccttattctaccaatccttgaacttaacaattctcgaaaaaatcattcacaccttcaatgtacacctctaaaaaatgcctctatagaagttggaatgcaaccaagcaaatgcctttacataaggaaatttttaagtgcctatacaatacctctagtagataaaactaacaaaatttgctaatagtgcctctaggataaaagtatcctaggcaatttttaaagttctaaaaagtgtctctacacaataaatctccaaattttaaaggaaaattgaaaatttcctttagaaaagtgccacaataaaggtttttcttggagtaacataacaccatttttggagaaacaaaatgttaggataaactaatgtaaatgtttaatgg

SEQ ID NO: 73188 - DNA, 650 bp, Oryza sativa
tatatctcctatgaaatatgttttggcaacattgaatttattcgtaaataacagattttaaaaatggtagaacatattgcacttttgtacaatgcatgcaaacaattgactgctgccgctttcacttcacgctccagaaaataattccttctaatcatactgcttgtaaacacttccttcgtaacaaaataactagttggtgaagagggcgcaaagtacagcacagagataaatgaattaccgaaatcgcagtcacattgacataaaaatcaatcagtgttgccaccaaccacctacacagagaaaaattacaacttcaagttaaggcgcttttggacaatagttctgacctccctactctgatgcaacacatagttcattcgttaagaacatacaaactctctcaaagccttgggcacaaactacaaacctagaggtctagagcataattggtgcacttaattatccaaagttgcatccatcgagaactacctatacttcctgtctttctgcagcaccattgtgcaggtcacagacaataacattggaataatacttaaaatagtactagtgactcccaacatttgctaatcattacgcctaaatttaaacaaaaatccaaagccttgcatgcctgcaggtcgactcta

SEQ ID NO: 73189 - DNA, 552 bp, Oryza sativa
tacttcaaatgtgtatccgtatacttcaaaaactttgcacccaaagaactaaacacacccttcgacaatttggtcactttcatccacacagtgtcctcgctctctcgaatactggtcaagtaccatgtattttctttccaagtgatatttgtatccgtttggtgtacgctagggtatggctgtaatgaaaagatgatacttttgtatgtttgcaacattattctgttccgacctcttgtttttgactcaatgacaaatcccacggatgttgtatgtgtgatgtgatattcttattcgtcaatatttgtatcagttgtttggaaacttggacgttctttggttgtagttctacacacgtgtttagattactatatacggtaagatatattaggacatggcgttggtgccttcgagcatcataatcgcagtagcaaagttttgcttccgttgagctgttaatttgtctgcattcgagataggtttggacctgtacgcttacaacggatgactgatcatataccctactgaagaagacttcttggctatatacac

SEQ ID NO: 73190 - DNA, 570 bp, Oryza sativa
cctgcagcccagggtgatccaggatggtgtcttgtccagagcatgataattgcatcccaggtgcgccgcatgatggaggttgtgtcgaaagccggaacgggtacctgatctctggtccatgcttgctgcaccgatgtgatgaacaagtcttgaagaagtcttcatcatcacttgctgtggcaacatcagatttgtatttcagaggagcgagtaggaggagcaccgtgataagaaggttggtgaagtccatgcagtgtaatggagatgagatggagtgaatgagaaggctgtgctttagaaatggtcacttgttttatcggtgtgaattgatgctgtgcttgtcatgatgtctgaggctctgagcagtgccaatgaaacttttgccatgttctatttcttcgaaaggtattccttatcatttttggctcccgcatgcccttgattttccacaactgattttattccgacttgtttttttttcttttggtgatgttgaaatcaactcgtgaagttgacatggtgaaactctgtggtggtagtggagtgactggtgataatcttttttaaagg

SEQ ID NO: 73191 - DNA, 1017 bp, Oryza sativa
gaattcgagctcggtacccttgcaggtctctacaccatccccattcaacaggacaatcacgaaactgaagatagcgggactacaagagataaaggtgtataaaacactaaaattgaaagcctcgtacaagtgagaaaataaaaatagcaaatgttgtctagatgtggataaatacctgctcgatgagagaaattaaacaggtcaagcagtatatagccttttcccccttctcatgcctaagtgcagatttcaacagggatgttctttgcggaaacaactgtgtattgaacaaataaaacatgtcagtaaactataacatacataaccaccccatgccatttgctcttcacaattagcccataatactaaagatgcagatgtagtccctcaaccttggggaaattaggccaataacctctaagtcatctgtatttacagacataacacaattcacactgaacttcctggtgacatgaccaacaaatgaaatcatgtaaaccaaatcatagctgctgtattgctgggggggagggtgattatatttttcagttgggaaggggaaggaaaacgcaaggtaactaacaaacatgcaaatgtttcctcttctgttgttgctgagtatggaaaattcaacattctaactactcggagagttaggaacagtaccaaggagaagcaagaacgagtccactaatacaacatggtcccagtggcagtggaatgcttctgaaaagatgatacattatccttttccttttcttcggcgttgcttgtcacatatgaagctggagcacttaaggtgtctttgtgaaagttttgcagtggtgttcgctacatcatgacaatggggaaccacccgtaggggtttactgcacaaggatcacaagggccctgcagaggaaaggcttgacccaggctagtagaataacctctacccgctaaaaatagcgggagtggtatgataccatccgaaaaaggtaagcaagtgaggcatatcagatgttatgcagattctca

SEQ ID NO: 73192 - DNA, 7733 bp, Oryza sativa
aattcctgcagccccggcaaagatccggtcgaatctaccaagcccgatgccacatgtatcgtcttctcaagttcctcacaccacctccgtctctcccacctccgtctctcacattattagtactggtactaagagcagtaagagcggatacaatagcagactataagccaactataaatatattttaaagagataaaaggaagagagaaaagagcagctgcagcacggactccgagacgtaatgtgtgtatgacagtcacggagctcgtggctcctcaccgggagaccgcgcagacccccctttgccagttcggccgggggcttagggtgagatctcaagctctctctgtatgtggaaagatcgcgtgcccggaagaaacgcgagacacagacgatgtatacaggttcgggccgctgggaagcgtaataccctactcctgtgtttttggtggatctgtgtaagagcaagttacaaaatatcaaccagccctctcctctcccgggaaaatcaaaatccccccttctcttcgtgggcatggtcctccttttatctcttaaggggataccacatgtacccttccctttttaaactggacttttcttctttacataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcaccaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtatcacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaatggtgtcttggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgtcgcttcatgccggaatccgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccagtgttgaaccgctacatcccctgcgccctccgcaagaagtgggacgattggaagagcgactggttctacaccccccttgccaacgaagcgcgcctccgactcccaagccagcccccggcgccggtctccagctggcgggcgccagtggatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccatggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgaggggacggggcggtgcgtgccagccgcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagccgctcgggaggaggccgcccgggctcgtcaggctgaagaagccactcgggaggaaaccgcccgggctcgccaggctgaggcgatggcgtcttccgaggcggttcacaacaagaccgccggcgcgtcgctcgggcccactccctcgggtgacgctcaggcgacaacctccggggcagcttgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcgtcgccaccactgcgatgattgaggcgcaggactccctccgccttcaacacgggagctgggaggcggagctaaagaaaaagctcgacgccgcccagggggtcctcgacgccgccgctgcccgagagcagcgagcaacagaggctgaagcggcgtcccggcggcgcgaagaggcccttgaggcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccacgacacaacggctggcagacagcctgtccctccgcgaggcagcgcaggaggagcaggcgcgccgcaatctggaatgcttccgcgccgagagagccgcgctggagcagcgggctgctaacctcgaggcgcgagaaaaggagctgggcgcgagggagcgcaacggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctctaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggctagggaccccggcttctccccatggatggcgctggaggagttccctcccgggaccgaggacgatgcgcgcgcgcgggtccgggatgccgccaaccatatcgtccaaagcttcgaggggtcggcccctcggctcgcgttcgccctcagctccgacgaggagggcgacgccagcggtgaggacgacggtggcgacgaggccggcgacccgggcgcattggaatgagcccccaggcccccgccaatctccaactttttcattttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcatggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgcagtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagtttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcatactctgctatattattggtcgtcgaaagtcaaggcggaccagatatctaaggacgtctcctgtcggggaggtcaacgtgacccccgcaccggcaccctggagggacagagaaccatcgaactgcatcactcagtaggtggtgtgaggtagctgcgaggggttcgtgctggcctcggggattgagacggtctctggagccggggtccactctgccacaaaatcggcgagggcctg

SEQ ID NO: 73193 - DNA, 3047 bp, Oryza sativa
cgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttcgggccgctgggaagcgtaataccctactcctgtgttttttggtggatctgtgtaagagcaagttacaaaatatcaaccagccctctcctctcccgggaaaatcccccccccccttctctctttgtgggcatggtcctccttttatatcttaaggggataccacatgtaccctctcctttccaaacggacttttcttctctttatggacggagattggtatggttgccgtccgaatgacacttcgatgggacagcccacacctacttccactcccggcggagacaggcgcaatgtgggatcgtggctgtctgttgctgacgcgaccagtgtcagaccggtcacagatcggtcattcttgtcctctatgcgtcagttcagcgatctgcatgatcacccttctttttatagcatcttgcctgtaatggttgggatgaagcctggtattcatttaaccagggctaagtgccatctctaagaggtaacacgctagccccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgtttgaccagaccgcaataaatgcggttaggtgagccctaccgtgttcacccaacctatgtacatagtgcaaaccccacagggggtcggggcacctcggccctcggggtcggggcaggagcaacccgacccccccccccctcggggaaatcaggaggagggcggacacctcaccctcgggcccgacgtccccgaaggtgccaggccacgtgggcgattccatctgcctcaagcctccgggcgcaatactcccggtcccatatcaccgacaaggttaaatactaatatcgacttagattatatagggtatccaccatcctatgaaatatccaacggcttgattgtctagatactgttattctttccatacttataactgcatcagttaagtttgaccttataagtcgtgattagaatctcaatctctagcctgcttttggttgccgattagggtagtatcggggtttcagccgatcttacctgatttaactcctttatattttatatgcttgattgatatgttaaatccgccctttatattaagatcttgttgcatttaggtatattaaacttcctgtttgatatattttgcttgctttaatatcttaatatagaatggtatcggagttttagccgatacatgctagatctatctgatcggctatgctatgaatgcttataatctccttgttaatatatattttgatctaagtgatttatactatctcggcatggcgaccgatatatcctaatcacttgatttaagtatatatcgacagaagcattatataccattaatatttacagccgatcgaatagatttagttctttctttcctatttatgactgccgatcgattcaaatatgtcatcggctcaaagataaatgatatgtcatcggcgactggccgattggctatcatttatggatttaaccgctatttttttgtctttatttcttgttgattgcaggatcaaatcaactggcacgctcacgaacctaaaggcaagattttggacgtgcactgaagttaagcagatcttgcaggccagtgtgtgtttttcgcatcaacttctattgtttgtaaataaatgaatagcgtacgaaattcatttcactgttgccggcccggcagaaaattcatttcactgtttacaatcgtttctagcttcagcattttacagcctacttacaagctagctagctagctgacttggcttccaagcagacacaagctttagtgctcatcctcctccgagatttcagttagctcagagaagaatggtaagaatccactgttagtgtgaacgcaaaatatgatcttgcggctaaacctaaagtcggcaaagagatattttgtttagggtgatcgctacagtgatcgatctctcatgaacatccctgatcgggggataaccgccataccctagtgtcggttccccctgtgtgcagtggctataaatagagatcaatacctaagtgttaaaccctaagagatttctctcgctacccgatcaaacaacccactgaaacacagggaagaatcaagacacgattctcttcgtgcttccaaactagaagagaagaaagaagaacaaagacagagagaatgggaactccaggagatcaaggtatgatccaatcccattttaatttgtagttccactttgtgccaaaccgattctatcaaatccaacaatggtatcagagcaccgggttggcctcaaattggaactcaataagtgtttatgttcaaattgttcttcgtgttcatgcccaaatccctctgttaaagttgagttaagcccaaatcatgcaatcccgaaatataag

SEQ ID NO: 73194 - DNA, 7185 bp, Oryza sativa
ttactttgtcatttttaatttattgtaattatttctagctgatttaactattttccaattaacttagttttcaattattttatataaataatcatataataattccacatagtattcattttttcattattttaaaatttctaaacatactttcattgtttttcaatatttatatatatttttccttttttcctataacatatttatccaaattattttaacctaattttccctctacaagttttctctctcatcatttcccaccatataccttattggagacaatattgaatacaaacaaagccataaatgtaacatgctaaacatacatcattagatggtgttgctaaccttttcgattcctccgatttgtatattatcaataaaaatttcattaaaaattttggtagcacctccctccctcaaagctccattttgcagcaatggctcgagctagaggaggaagaagggatatataaagttgggtctaaagatctctaatgtctttagtcccggttccttggccccctgacagggggcacgcctaatgggcgggcagcgatcacccatctgtccccctactcccccctctctctccccgcttcctcctccccttcttctcttcttactacagtaaaccacaaaaaaaaatctaaaatacaaaaagttagaaaaatttatgtatagaaatactatgtataaaaaaattgaattcaaattcaaatttgaatcgggtatgtaaacttttgacttataaacttcaggtctataaactttaggtgtataaactttagatgtatagaaatactatatatagaaaatatttgaattcaaattcaaatttgaatcggatataattaaaattcaaatttgaatcgggtatgtaaacttttgatttataaactttggatctataaactttaggtgtataaactttagatgtatagaaatactatatatagaaaatatttcaattcaaattcaaatttgaatcggatataattcaaattcaaatttgaaacgggtgtataaacttttgacttataaaatttaggtctataaactttagatgtatagaaatactataaaaatatttgaattcaaatttaaatttgaataggatatataaactttcgatttataaactttgggtctataaactttaggtgcataaatttactaaaataggaaagtaatgcggtgccaaaaaaaggaaacgtggagggagggagggggggagaggtggtgatcgctacccgatcgctccgcgatcgatcgcgcattagacttttcgcctgacaggggtctagcatgccctgttagggggcgaactgggactaaagacgattggtgttaccaaccgggactaaagatcacttagtcccattggagtaataaaccgggactaaagaaacctctttagtaccggttctttatagaatcgggactattgtgcttttcggccgacccagcaaagatcagttctccagtagtggtagttgttctagactattggtcctactacaccttcgtattcaactactacaactcattgccatggtggtctcctacctcgcctgccagctatatattagaaacatcgttacgcgtgttcatcctgtgttgttgccaggcctagtaaacctattacatgatcttgtcctccatggtttgacaacattggctcttcgaaatcatatttctaaatgactatcatgatcgtatcattgttttcagccttagcacgtccgtgtgcaaatatgatccgtggcaccaccctgcgcgcctgcgaccatgccatggtgcattttggacgcctcacggcttagctagcttgcttatcatcggctatattggcgacgactactctaagcactgttacttcagtatgactctattgtgtcctttatttttggctatctcggcaacaacataaatggctgtcagattctctcgttgatttatttttccagtctaggcatgctgatcatgtttggactattagtatgttaaatggtatgttaaagtatatataaaatataatagttataggaatatgaggatatgattgatttatttaaagttacctttattcttatattctactagaaaattggtcacgcacgttggcgtgccaactatttagcccgtgtgtgctggttagactaactttagaatgcatgaaagacataatatttgaaccgattagctaaataattgttggcatgttttttttttttgaaacggacgatttgtcagccatcagattcacgtcgtaaatggcaaacctgagttacatatagataacatattatagatacactataattatactataattatactatgatgattgcgttggaaagtttaacccataattgaaaggattttcttttatcaatgatcattgcaagaaagtttttgcacttaagaaaatgaaaaacatcacattttccattcacgtttgttttttcaaattttcatagcttttcatcaaattcatgaaaatcaaaagatatattaattaggtcatgaaggaagatacttatgatgtcgtccttgctggttgaacacaacatccaccaatcgatctcctttctaactattcttcagatggaaagactaatggaaggagaagtatgatttggaacgttctgatgtctaataggctaatatttttttctagattcgcttttttctcttatgaataacttggagatttatttgaaaaatttaattattgcgccacgtggaacaagcggctggcggtaaaaaccgccggcttcagtaaagtaagatagatatatatacacaccataaatttctgtgtaattctttataagtgatacaactctggtaggataaacatactttggatgctgatcaaatactatatgcctctaaaatataaaatattttcccacatagactaggtaatacacaatctttaacaaaaaatgtaacattataaaaaataatattaaaataatgtacaaataaaatacgactaacacagacaattaagataagtggctgttttattatctgtttggtagatgtatagcttcaactctacctctaaagcccaactaaatagttttaactctatctaaacttaaaaaaatgccaactaaaatgctctcgtaaaataactcgcttgttatgtctaatatacttagtctaacctgtaacttgggtacgctcttttcttttgtcgaagaatcgaaaaaggatattatccaataaaacctgacatgttgaactttttgcttttccagctgtatgaaataatataccgaatttaggctgcttcctgatttcactctgtatcatcttggaattaaatttaggatttggtcctgccgacaatacccataattagtccaactccagcacgccggattgccggaaggttggcgacgcgttatcattgcccaggcctgctgccccttctcccctccttctccttggtgaatcgtcggcgatggatatcgctcttgcttctgcggcggcgacatggctgatcaacaagctcctggaccggctgagcgactatgccatcaagaagctgctgggctcggagggcctggacgcggaggccagctccctcagggatgcgctgcggcgagccacgctcgtcctcggcgccgtgcccgccggtgccgccgcaggggtcaggattgggaacgaccagctacttccgcagatcgacctggttcagcggctagccaccgatttggccaggcacctcgacgagctcgagtactacgacgtcaagaaaaaggtatctacactgtcactactgttgcaatttgggcgattcagtttcttctttcagcactcgaaatttcatctcttttttttttcatttgcagactaaatttttttttgggagcgtttagctaaaactctaaggttgtcctcgcaaatttttttttaaaaaaatctgttaaggttgccagactaaatgttcgtgtcacagactagcagtttttaggaacgaatagttgcagcaggaaagcttggttgagtttaagcttggctaaaacaaaaaaaaaattggggcaaccgtaactccaataaaataccattttttatagttttataaaatgtaaaagatctgttctgtcttctggctttctcccaaaagccgggtaatagtcattacctgttgtaaaaaaaaacagagagtaaaagctaagtagctagataaattagaagatgttaacatctgggttggtgggggttgattgtgaaaggagtactatgagtcttaattaactattactaacttattagacacctgatcctagggcaaagccgagtgattagctttccagtgaagcttttttgacatctctacatgtgggccatgagccatcaaattgtcaaagtgtctcaaaatatgcttatgcttcatattgcaaaactttgtttacatagtaatcggaggctctcttgagggctacgccccttaattatcggaggaaataaggactgcaattcccatatagtagatattcctgcatatggactcgcaatcagtacttaagtcccattcaactcctattgtagagtccagaccatgtccaaacagaatgaaacaaaactatgcataaaaaaataagtgagatgtggagtccaattcaatataaacaagaaaatgatcatgccatccagcacatatggttccacaaaaaatatgtaaaaataacaaggcacttctatgactacaacgtgcgattatattaaccaaatgttgaaatttaaatcacactatactcaggtggccaaatattcaaactcgacaaaaatcagaattaagtcacttgtttgtaagagaaatttttttataaactgtattgttaataaaaaagaaatcttagacttcatagtgttcacttgagatctaattttgtagcggaaggtgaaatctagttggactgtgaaccaagaggatgatatgcttgtgcaggaaaataaataaataaatataaaaactttaacatgttaagttagtggtaaaaattgtaaatgtagcaaatactaactcttgatttgttcaatatataaacataatgaaatgggaatttcaagtatatcgaattgacatatattgcaagacttcggatgcaatttttaaccaaactaatatatatagccttggcaatttagtttattgagattcatacgtttaattataaaaaatgtgataaattttatgtacagatgtacgtataagaataaaaagacaggacatgggcactcaaacctttaccaaaaaagaaaccagaaaataaccgaaaataaagaggttgtaggtagtcacctgaccaaagggttgcctcatgatggcagtcagcaatgtgtatctgcgtgctagaactcctggatggcactttgtcagtgagcatggtcacatgtggcagttgttttaggattatcatgccacagctaaataataagctgttctatgtgcattttagatccggttagtaaggtggtctattgtaggcttatggatctcccaatcggttgacttcagcatgggaaaaagccccttactgttccagtttaagcgtcctacagttaatccttgcacgctttatcaaccatcctctcataagtgctagcacagttctattttcgatttcgactgtattaatgcttctgtagtctgtaaaatcttgatctgaatttcacccattgtgacccccattccattatatggtatagtgatttcatctatatcctttgacatcctagccaccattttccatttatgttgtgtaggtaaagaagaaccagaagagcagcaatccattatccaaaatgaatttaccccttactcaagctgggcaatcaaagccgaagtacaatagaacagacataaaacagattagagatactgtgggatatttgcatagcatttgtgatgatgttcacaaggctctcttgctagataaacttgatgcaattaaacaagctgctcaagatgcaagtacagacaaacgtgagactgtggataacttcactgaaaatcctagaaataaggtgttcccaagggaagaaatgaaagatattatagaactaattaatagtgctgcatcgagtgatcaagaacttttagttgttccaatagttggtgctggtggtgttgggaagacaacacttgctcgattggtgtaccatgacccagaagtaaaagataaatttgacatcatgctctggatctacgtatctgctaactttgatgaagttaagcttacacaagggattctggaacaaatacctgaatgtgagttcaaaagcgccaagaatctcactgtgcttcagcgtggtatcaacaaatatttgaccaaaagatttctgcttgttctggatgacatgtgggaagagagtgagggtcgttgggacaagttattggccccacttagatccgcacaggctaagggtaacgtactcttggtaactactcggaagttatcggtggctaggataactagcaacacagaagcacacattgacttggatggtatgaaaaaagatgacttctggttattcttcaaaagatgcatatttggtgatgaaaactatcaaggccaaaggaagctacagaatattgctaagaaaatagccaccagactgaatggcaatccattggcagcaaaaagtgttggtacacttttgagaagaaatattaatgaggattactggacaagaattctagatagcaatgaatggaagttacaagaaagtattgatgacattatacctgcactaaagctcagttacaatcagcttccctatcgtcttcagctactcttcagttactgtgctatgtttccaaagggttacaattttgacaaaggacagttgatatgtacatggattgctctgggatttgtcatgaatgagagaaagaaattggaggatgaaggaagtgactgttttgatgatttggtagaccgaagctttttccagaaatatggagtgtcacagtattatactgtgcatgatttaatgcatgatgttgcacaagaagtctccattaacaaatgccttattattgatgggtcagatcttcgaacagttccgtcgtccatttgtcaccttagcatctggactgagccggtgtacaatgagcaaagcatagaacggaatgataactttgaagagaagtta

SEQ ID NO: 73195 - DNA, 25513 bp, Oryza sativa
ttccctaagcggttgcagggggtgtcatgctcggaaaattcactagtaatttctgaacttatttgtgcataaaatcctcatccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagaagtaaaacagtggagtaattaattagaaattttaatcaacactgaacagcacacccatgctgcacaggcccaaccatcctgaacaaccatacccggctgtacagatctaactccaaaccaggagctaagcaaattattaccagttatagcatcaataattattgtgagagctgtgagactaatcacgaaaaacattgctcaacccgcccataaccgtgggcacggctattcgaatagttttactctggctagaggtgtaccactgtacccacaagacacaactccacaatatgtcaccatatcatcatgtgcccatgctgaacatgtcaccatatcatcatgtgcccatgctgaacatgtcaccatttgtgtagttgtgacaagacccctcgcataactcaacccaaagcagtgcaccgttcccggatcatagtgacccccttataaacaaggcatggactccccagtgacccccgtgggcttatctccgccacttctcagtctggtgctccgcagtgagccttgttatacaaagtgtccagccgttgcccattctggcttgtggttggcacggttaatgtttcacaaccgaaaatcgtgaaccggtccttaattgtcatgagcacgaccatcaaaaccatgtgctcacaacccaccattatcaagttttagttgacacattaattaattaaccaatcacgattgaccatcgtgagctatcattaaatatccatcattaagtaatagtgaaacattagttatcccaattgtatgctaatgtttctaagcatggataagtaattatgtctaacatctagctgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggaactgtgtttgggatctgtgtgacttgccttgcaataaagggtcttcaattaatcttcttaacacttccggcgcactcacgaaccttcgaaacgacggaaacgacaagctaacacgcaaaacgaggaaaaagactaataaaaaccaaatagacaatacataaaaagtaaacaaacatgtagatcataattttagatgaattatgagacttgaacggccttattcggacttcatatgaatttattacaaattttacaagattaaatctaattaaaacctatttaaaaaggattaaataaatttaattcaatttatgtataattttaatatgtagatctttattttatacaacttttgcaacttgaaccacattaaactgagttacaaagaattagttatgaatttttaaagattaaaccggattaacgcatttttatggattttaattgaattatgacgcaataatgaattatttttgaaaaggaaaagaggattattgcgtcagcgggctcggctcacggaggaccaggtgcatggcgacggttcacgaaaacgaacggccgagattcatccatccaaaacggacggccaagatccatcggtccacgaccggaccacggcggacggcaatgatgacgtcggcgatgacgtcatcaccggcgatggctcggcctcgcgtgctcgtcggcgaacgacggcgcggcggcgcaaacggaggacacctacacgtagcggacggcacggcgaactcaccggtgctcaccgatacgacaaacgacgacggacgacggccggcggcgaggtggacggcggcggcggcttcggtcggcggtggcgtcggagctgcggtggtcggcggcttcgggggtcaggcggccgggcttctccaccctcccgcacacctaacggtggtgacggcgaccggcggcgacgacggaggcggcggcgcgacgcggatggagctcggccggcgacgatagcggggtggagcacgtggcggcggcgctacgaggcacgggagatcacgggagagggggcaaacgaaagaagaggactagggggtcctatatatagggctagggagcggcggcgaaggcccacggcgaccggcgacgagaaggaaggtttagggtttggaggagagagatcgatccgaatcgaactcaaatccaacactttccaagcgattttagccggtgattccaaaagagaaaagatagaggagatcgagaagatcatttcccctctattgatttcaccggaaacggaaaggaacggccggatttggaatggcggcggcggcgcagctcggctagggtttcggcgagaggaagacgacgagcctgacaggtgggccccacctgtcagcgggcgaacgcgcgcgcgcgggcggctgactgggccaagggagagagagagtggtttgggccggctttcggcccaaaaccaaaagggacttttaaaaacctttttccatttaaattattcatgaaatgcaattccatttattaaaaatacttccttggctcaaataaatcccagaaaaatctaggaactatagaaacaagagaagtatttaacaaaattttatctagcccacttttatattgagatttaacaaattaaaattagatcttctcttctaagcttttaagatcatttctaataattcccttttagacaacaatttataaattaaggatttttaaacaagaaaagcacttaacataattataattagattattaatgattaaataattactgaactgttctttgtatcatttagaaattgagctccgaaaaatccgagaaaatttcagagagtataattaatcatggagaatttaataaaaattaaatccatccatgctttaaatttaggaaatttttatttcccacatttaacttcacttataaattaaagaacatttaatataaattctattaataatttattagataatttataaaccctaaaacgaaaatctggctgtgacacgtagatggcttggattccttccctaaggcggttgcagggtgttttggtcatttcccatgcccctaaccgtaatttggagcctatataaggagtagttcactctcattccaacacacacaattttgaactgaattacaagaggccttattgtatcttttgtacattagaataaggtagagagtgaggggaagctctggaggagtgcctggaagtttggcactcatccgacttctacctcgacgagtgtagcttcctaggaagaattctggaggagtaccagagctgtcagtacactctgctccgggttcggagaacttcttctataaagtaagcattcgtgttcctttcttatcttatttaattatttaatctgagtaagatagacttccatctttttgggttcattgtttagtatttatactaagtgctctagtactaggactccggatagagaaggaagttcctgcgaatgtattagagtagtaactaataacttagacgtggtgtctagattagagattacctttgtttgttgtgtatcccacggatttgtcagagataggcggcaggtggtgacagccctaaatcccgtcctagtaatcctccacgttcggatacatcatagagctatagccggaaccacgctggcagaccagcaggggtcggtgcccgaagcagcagataggaaattatgttttgcttagcttagataattaaaacatatagagagtcctgtctagcctgcctacctatagttgttatccttggatagtcttagccttagatagattacacatgttccctgagttcgatatcctttagggctcacccaaaggtgaaatgctacagcggtattccgtgcgcttgcggatttatctgtggtcataagaaataccaacaggcatgaggtgaactatatatggctaagcaaaatgaaccatcccacatgacattgtaaaataatgcaacatttaatagaagacgaggcatttataaattaggtacaatatgatcaattgtaatgcatgacttgccttgctctcatgttgttgggacctccgcaacgacttcgcagaacagcggtgcatcggaacaaccgaaatctacgcgataaacaaagcacacaagcaaaacaggcaatgagtctaccgaaacaggaaacaaaaccacttttaatggattctagggatttgtatggatttactacaatttgaatggactcaaatggagcttgcatgaatagttatgatttttaaaagattctttgtgtagaaaagtccttaatgatttattgcgaaataaacccaggggtgactggaccacgcgggtggtccaccgccagcccatgggaccaatggtccagatcagcctcaaggctgatctgacggcggcggaagcggctgcctggctcgggcacggcactagaccgccccaccggccatggcacacggtggcacgagcggccactggcggcacaggtcggtggcgcgtggcgcgggagcaccggcgtagctcggtgctaggagggagagggggaaaaggaaacaaagggggtcctcaccgaggggttcagccggcgcggggaaagatgacggcgaacggcgacgacgggcggtagacggcaagacgagccgcggatggcgtccggagcaatctaggggagcaaataagaggaattagagggagagaggaggtctgcggcgagcggcaatgccggctgaaggcggcggaaatggaggggctcaccagcgtgcggggaagggcgattttcgacggcggttggcgacgggtgaacggcggacaagatggccccgacctcacaaagccaacggcggcaacgaagcggcgcgatggtggcactagcggcggccagaggcggcggtaggcggcggcgctaggaaggagtagtgcggcggcggtaggcagcgtgggagaggacggcgaaagaaggaaaaaggtggaggaggatgcggggatggtttttataggggcggagagttcggacgtggccgggacgtggctctatttcgccggcgacgtggggaggtggagagagagagagagatggaggatttcgaatccccgccatttgcgagcgtgtgcgcgcgcgcgcgacgtggggtgtggaatggagcggagaaggtgggcgacgatggttggagctagggctccggcggccggaggttgaagaaggggccgacaggtgggccccacttgtcggtgattttgagaggggaggaggcgggcgccagccaggccacggccacgggccggcccagtaaggaggactggcgcggaaggcgtattgggccgacggcccaagaaaggaaaaaaaaggaggatttcgaatccccgccatttgtgagcgtgcgcgcgtgcgacgtggggtgtggaatggagcggagaaggtgggcgacgatggttggagctagggctccggtggccggaggttgaagaaggggccgacaggtgggccccacttgtcggtgattctgagaggggaggaggcgggcgccagccaggccacggccactggccggcccagttaggagggctggcgtggaaggcggattggaccgacggcccaagaaaggaaaaaaaaaggaggaaaagaaaaagagaaaaaaaggaaaaggattttcctaggatttatttattgaagataattgattttaattggataaaattattttcaaggctatgaaaattccattaaaaatcttgttaatgcattaaacatcgggaactcaagaaaaattccaccatgccatttccaaatatcaaatgcattcattaattagggttcagctcaaggttaaattgaacaatttctttaggcgttttatttgatgaatttaaagctagaaatgggaaaacttcagggcgtgataatattagacccgtcttgaaatgtttttattttcactttgaactacctattgttaccaaatgttgtacattggaccaagtgcctcacatgtcaatgaaactaaccacctctattatgtgtcgcttacacgtggaccactcgattcaaagtgtagcatttgacaagaatacatagtccaaagcaaaaaaaaagcattacaacggtggtccaaagtgaaactttggtaagaatttgcaacccaaagtgccatttacttttttttatatttttcccggtcaatcatgactggatttgcgttacccaccaccgtccacgcattgacatcctcatcgtccgcgttggtcatcattagctattgggttcttcttcgccaacatcgagcatcgccaccacgtcttctcaagataccaatattgctggtctaagccagtggtttaggtaccataggttaggctaccgaccttattgttctatgttgttggtcttgctgcttcacttttgttttcatctaccttcaccagcgcggtattggcaacaccgttgcacacattcaccttgagttatcattgagcctggcaaatccgacatgatatctcgtcctttacggttcgacaacatcggctcttcggtatcatcttccccaatgatagttatgatcgtgtcactgttttcaactttagtgggtcgtctcacaaccacgacgcattccatgcatccgtaaacactacttggcaccccttgcatgccacacgacttggctactattggtatttcttacgatcacagataaaatccgcaagcgcacggatataccaatgtagcacttcccctacggagtattccaagggtatcgaatccaagggaacgtgtgtgatcagagcttcctccggttcatccgaggacaccaagcaaatgataggccaggatacagatgatttactagtgagaaacagtgtctagggaaagcttaattctaatcctaacgcaatacttcaggcactgtcaacctgctgttcccagatgtcgctctactatgtacccggacagggaggacttaagtgatcgcgagggctgtcaccacctctacatctacctcaaacgtactgtgggatacgcagcaattactggataacaattacctaaacaccatgtctaagcaattaatatctactttagtgtttataactcaccaaagcaatcactatattttagttgattatagtgaacaataatcccgtatgctatttaggaactaaccaagagataattctcacaagataaatctaaattactcaagaagaatattatattgaattcagagtaataaacagaataaaaaaaataggagaagattaccgacaactccggaattcttccgacttcttctactctactctcttcctattctagtatacaatatagtacaatagagcctcttataattcagctcaagcttggaagtgtgtgtgagagtgaatgaagtgaggtccttttatagggtagttatgacggttgtgagaaggggaaatgtccgaactgccccgcaaccgtcattgggagaacatctggaacgtccacgccaaaccctaggatcaacagtgatcaggggggttcagccgaaccagggggttcggccgaacctgggctgggccttcctggtctggccttcagtcggtgaactccctgggctctcctctgtccatttctcggagttttgggttgattcactgatgttttgatgaagttcacaacccctccttgtatgaatacataattctcctcacattagtctgattttcctcccaacatcggggtttatcatctgcatacaaatatacaccaacacttgtagaatatgtgagattaagcacttatcactatgttggatgttttattatctgatctttatgcagatgttggcggtatagaatcggcatttaacagctgccaacagctacctcgacatcaacatatccgactttggctatatcaaccatggctactctacacatggctatgaagttgcatttatccccctagtgggttttggtgattaatgacaaatagggttaagggactaatgagttttattgaccattctcaggtgtttaatcccaagatgatattgtgtggtcaagagatgcttggagaacccccacaacttatattcaagcggaattggaactcgaagggtgcataggatagtttatttcttgcaatcgaattttaggaaaaaccgtactattaagaggggttccaggtgtggttctaggatataacaagtgctctttgtgagacccaagtgtcaaaatatttttgggagctttgttggaaaatggccctaccaggatagatcaggccggccggaagttccggtcctatggacccggaagttccagaccttgaaaggtgaaaattttcccaagtgttgtccggaacttccggtggtcaggaagttccagacccattccagttcaaaaatgtgagtaacggctagaagacgtcacctagccgttatatatatatatatatccaaaacgtccccagctcactctttggccatttcacttttgtttctccactctatagctgttgcaagcctctcccaaaagtttctttgcttcctccacccaatcttgagccattcttgagagagagtgagattttgagggtgaaggagaagttttggagaaggtttgaagactaggattggtgtgaccacttggggtatcttgtgggttgacatctcggtgcttattactcttggagatcatctcctagacggttaggtgtcacccgcgagcttcttagcaactgtggatgtcccagaaaagtttgtgaaggtatttctcacctctgcaacgaaacgaggtaagtgagtaaagaaccttgtgctgaagccctagaggttttcctagtagagcaactcacacttgtggtgttttctagacggaggtttgtcacgaccggaaataacccaacgggcgttccttacgtgcgtgtattattccttgtcccaggaggcaaggtacaccaaaagttgatacatttcagagtttatcaagcggaagcgtaaataattaatttattacatgggcggcgaaggcccagcacacacaaagacaaacgggaaacagcggaagactagggcgacgaccacaggcgcttgacggcaggcacgagctagacactaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgctcaaagctattttgtaaacatgattctagagctatacaatattattaatcaaggccgtgaacccacacgaacctgctttaacccaaggcctacgacgattcagaccgaactggcaacccgaccatgggtcctagctcgtcccaagccaacccaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccaacccaaccccacctatggccggaacctccgggacaggtaggcaggactgagcccctagcagcaggacaccggccttgtgccatgacatctcgactactggaccgcagctcgtgtagccttcatttgccctagagatgtccatcgacccccgacttcatccatctccatttgtgtacttttatttataaccagactgagccacaaactaagccttacccactagacatgtggaagtatggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccatagtgtccaggtgatgagaatattcccaaagtctagagttgtaaaaccacctaatgttgcctaattaaccagcgaaacatctacctaaattcatactagtggtaccatgagtagagtgtccactagttggggttttgtttaatctagggtgaacaaggtaataatatcaataacaataataataaagtcataacaaaggtaaataggcatggctaaataaaacattgataactcgggaatttaagtaaagcgataatgcaataatttaaatcaaaataattttataaaatgggatccaatatgttcaaggatgatgtgacttgccttgctcgctttcccaaacgtcggcttcaacctccacgaagagcggatcttccgaagctgcagcatctacacgaccaacggaaaagaaaaggcttttactctaataaactccatataacaagcaggaacaaagcacaaaaatgggttcttgacttcttaaggaaaaattagagacttgaacggtccaactccgagttcaaatggccaagttatggccatttgaagtttatatgctctttaaatgaatatttgcgaatttcttcatttaaattttaatttaaaaagggtttattgcgtcagccgagggggaggggcgcgcggaccgtgtccacgggagtggggcccacgcggcagcctcacggtccacggtggaccgggtgcacccgggctcacaccggccggcgccgtgggccccacacatcagccgcacccgaggacgcgggcggctgacggccgggccccacgcggcagccactcggcgcgcccgagggcggccacgctggcgcggtcggcgggaggcggcgcgcccgcgccccgatggtcgccgccggcgaccaccagcgcggcggagcggcggctgagagaggggagggaagggggaaaggaggcgacggtccacggctcaccccggggcgacggcggcgacggaggaggcggccggagcggagggaggcggtggcgcggctcgggtcgacggggacggcggcgctccggcggtcggcgaccgaaacggaggggtggacgaggtcagcgacgatgcggcgaagccgaaggaggcggcgccgaggtgggaggcggtccagggcgacgacggcggcggaccggagctcggctgcgacggtggagagagagagcgatggcgcgagctcgattccggcgaggagaaggcgcggcaaagggtggaaacgggcgaaggaagtgcggggagggtttaaatagggttggaagggggagagagcggccggaggggaaggaaaccggcgcgggaggtcggccgccatcaatggcaccgacgagatttgcgggggcaaatccgcccgtttgaacgcgagagagagagggaaaaatgggggaaagggagagggaatcacggagagtatttccccccactttattgcacgcggggacgacgggaggcggcgggattcgcggcggcggcggcgctagggcgcgggcgaggcggcgggagcggcgggaggtcgtggatgacgggtgggccctacccgtcagcgagggtggcgggcgggcccgcccgtcagcggcgcgcgcgcggggaaaggccgagtgggccgcggggagaggagagagagaggggggaggagagatgggccgggccggcccaagggagggaagggggacttttagggtttttctttttataaaactttctcaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggagtttaattattctaggcataatttaaaggatatattttagagtcgttttgggacgtgacaaacctaccccccttaaacggaatctcgaccccgagattcggaagaactggcgaagtgatcgggatgggctgccttcagctcgtcttcacgttcccaagtagcctcttcctcagcgtggttgctccattggaccttgcaaaaacggattacccggttcctggtcctgcgctccatggtgtccaggattttcactggcctctgcacgtaggtcaagtcttcgcgaacttcaatttgctctgaatcggcctgctcggatggcactcgaagacatttcttgagttgcgacacatggaaacatcatgcacgttgcccaaggatgcgggcagctccaactggtaagcgacttctccgcgtcgagcaatgatacagaaaggacccacgaaccgaggtgcgagcttccctttcgtctggaacctgtgtacaccccgcaatggcgtgaccctaaggtacacaaagtcatccactgcaaattccaggttacggcgtcggttatctgcatagctcttctgccgggactgtgccacctttagattatcccgaatggttttgactttagcttcagcttctctcaggatatcagtcccgaacacttggctttccccaacttggtcccacaatagcggtgtccggcatttgcggccatacaacgcttcatagggtgccatttgtatgctggcttggtagctgttattgtaggagaactcggcataggggagactcttatcccaggtcttcccgaaatctagaacacaggcacagagcatatcttccaggatctgatttagacgctcggtctgtccatctgtctgcgggtgatacgcggtgctgaaatttaatcgggtacccaactcttcttggagcttcttccagaagtgagaggtgaattggcttcccctatcagatacaattttcttaggaacgccatggagactcacgatcctagcgaagtagagttcagctagtttgttccctccataggtggtcttcacaggaataaaccgagctaccttggttagtcgatccacgactacccatatagaatcataaccaccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccaatatttttctttcaagtccaagtacgtcttcgtgctgccaggatggatggaatagggactttcatgagcttcctgaagtatcaactttttaagttccctgtcgtctggaacgcatacccgatttccgttccatagggttccgtgttcatcctctgtgaaaccagcggctttaccctgtttcatattcttgaggatcccatgcatatctagatcattcttctgagcctcgcggatttgatcgagcaaggtaggcttggcttccagcgtagccaagaatccatgaccaactatgcttaggttcagggcttccatctgttgattaagttccggtggaatgtcacggacgccaagagtgttgcaacggctttttcgacttagagcgtcggcgaccacgttggccttaccaggatgatagtgaattcccacatcataatcgtttatgagttctaaccatctcctctgccgaagattcagatccgactgagtgaagatgtatttcaaactcttatgatcagtatatatttcacagcgattcccaatgagatagtgccgccagatctttagagcatgaaccacagcggccaactccaaatcatgggtagggtagttgccttcatggggccgtagctggcgtgaggcataggctaccacatgaccttcctgcattaatacgcaccccaatccttggcgcgaagcgtcacagtacaccaggaagtccttgcgagtatccggtaagatcaacactggcgaggaaaccagcttttctttgagagtttggaacgccttctcgcattgcgggctccacacaaatttttcttctttcttcagcaactatgtcatgggtcgagcgattttggagaagttctcgatgaatcttcggtagtacccggccaaacccaaaaagctgcggacttgagtgactgtcttgggttgcttccaatcagtgacggcggtcaccgtgtcgggatccaccgcaactcctttagcagatatcacgtgccctaagaacttgacttcggacaaccagaactcacacttgctgagcttggcatacaattggtgttcccgcaactttcccaacaccagacggagatgctgctgatggtcttcctctgattgtgagtacaccagaatgtcgtcaatgaaaaccacaacaaacttatccaagtattccatgaacactttgttcattaagttcatgaagaaggcaggatcattggttagaccgaacgacatcaccgtgaattcatacagtccgtatcgcgtggtgaatgcggtcttcgggatatcttcttcacgaatacgcaattggtgatatccagaacgaagatcgattttagaaaagacagtggcacctttaagctgatcgaacagatcatcaatccggggaagagggtacctgtttttgatagtaacttcattgagagctctgtagtcaacgcacatcctctttgtcttgtctttcttttccacaaaaatcacaggagcaccccagggggaagtgctcggccatatatatcccttttctttcaactcttccaactgtctctctacttcggctagttcatttgctgccatacggtagggtcgcttgtacagaggagtggttcctggagcgagatctatccggaactcaatctctcgcttgggcgacataccgggtagttcttccggaaacacgtctccgaactctctgacgatggggatttccgacagtcctatctgatgaagttctgaactgccgacagaggttgggggtgcaaagaaaacaaccggttgttccagcccccgatacagagtgacagtgcgccttgcgcaatccactactccttggaattgagccaatcaattcatcccaaggatcacatccaagttcttggtgtctagaaggatcaaatccgaggggaaaggaattccctggattcctataggaacggcagggctataatactttgctgtcataacccctccaggggtggtgatgagcagagggttcctaagcctttctacccccaactgatttctccccacgaatggcacagatataaatgagtgggaagctccagagtcgaacaaaatggtagcagagatggaatgaatgaggaacgtaccaacgatgacgtctggagttgtcagcacatcctcggcagtcacgtggttcacacgaccccgaatgacatccttaccaccgttgttggggcggggaggcgcttggccttgctggcgcctcggctttgggcatttatccgcaaagtgcccggactcgaagcagttgaagcacagacgctgctgaccttgagcgtctctgcggccttgaccaggctgcacaacaggcgcaggaggacggggcgcacgggtcccttgctgactctgctgttgctgtggctgtgggacgcgcaccacaaattgaggtcggggcgcggagcgtggttgctgctgctgctgctgctgcgaggaggatccccctggatagggaatggtgtagcggaccctttagttagccccctgttgattgcggaaatttgccaagcgacgcttgtgcgactccagttccttgtgcttggcttccaagcggatgctcttgtccaccaaacgctggaaatccggataatccccggagactagacgcacggacagctcagggtccattcctgccaagaacttctcctacttttcctcatcttcacgaacatcctccggggcgtaccgggccaggttgttaaactcatgcaaatactccatcacagagcggttgccttgcttcaactctcggaattcccttttcttaagggccatgactccggccggcacatgggtcctccggaaagcggcggtgaagcgggcccaagtaataggctgtccttctggctgcgtagcctggaagtggtcccaccatagagatgcgggcccctgcagttgatgggcggcgaagatgactttctcctcatcattgcactgcacggtatccaactttttccccacagcatgcaaccaatccaaagcatccacggggttattggagctagagaagataggcgggcggatgcggaggaactctgcgagtttagaatgttgcgggggtggtggtagaggtggagcattatgctgtggcggattttggatgtgatggaggaaagcagcacttctcctggttgtcaccatctgaaaatcccacacagaaccagcaaacagagagagctgactattaaaactaaccacccacgactaccataattcttgaatttatttctgctattaaattggttcattaaggttcaagttggttaagcaaataaaataaagacaggctccgacacagttataccacacaccggtataaccatgccccacatgactcaagcagaaaaacaaacgagaaaaacacacgcgcaagcctactaactgctcgtctacttctgcgacgggccagggcggaaggtgagcagcagcgcatcctccatgctaccaacgccagaggctccctcctcctgaggaaccacgggcgcgggctcggcacgaggggtctcgacgaaacaggtccatgccaaggactgacgaacaagctcgggcctggaggtactcttgcgggcggtgatcttcaggctgcggcagacgcggcggcgcttggggcgacagacctctccctgggcgatcttgagctgacacagctgcgcctctactgcgtccaagtccttctttagctgcagattctcctgacgcagctccaggatcttcatgttgttctcgaccaacccacggcgcaccatatgatggaagttgatacgggtcgcgttgtacgcctgcaccatgcgcgccaggtgcatgatggtagcgtcatcctccgagctagcatccctgaaggtggcgtagtcgcgggctcctccgcgacgagggtggtagcggtagggcgagtgctgcaactcgtccgggtagcgctggtgaagagtgccgatggcgaggagtgcagcgttctggcaagcggcggagaaagaatctccacccgcggtgactgccaacgaagtcctctcgggagagccagtgaggaccactacagtgacctcccaggcagcgtggggctctacatcatcaccctcctgctccaggagctgcttgccctggtagtccactccatgcggataccccaggacaacgcacatgccccgcagctccaaaacaaagccagtaaggtccaggccacgacggttgatgctgccggccatctacaagcaaggacaaaagagaaaaagaaataaacattttagagaccagcttttgacaataaatgaagcagcaggacagagagagactaaaggattttcacaaataagaaaggatttttatttcgaaaatattgctaaggcttgggatctaaagctcgttctagggtcaagggggctctgataccaacttgtcacgaccggaaataacccaacgggcgttccttacgtgcgtgtattattccttgtcccaggaggcaaggtacaccaaaagttgatacatttcagagtttatcaagcggaagcgtaaataattaatttattacatgggcggcgaaagcccagcacacacaaagacaaacgggaaacagcggaagactagggcgacgaccacaggcgcttgacggcaggcacgagctagacaccaaagccttcatcttccaggaactccacttctgggattgggaaaaattgagcaagactgagtacaaccaccgtactcaacaagacacacccacaattacagaataaatgcaagggagtacaagggagccataatatagggggttagggtttgcagtaaacagcattaaaagacacttagttgctcaaagctattttgtaaacacgattctagagctatacaatattattaatcaaggccgtgaacccacacgaacctgctttaacccaaggcctacgacgattcagaccgaactggcaacccgaccctgggtcccagctcgtcccaagccaacccaggccaaccattccacattttagttgttaagcaggttttaagaattaaaacactaacttgggtacattgctaggcttgcccataatcgagggcgcggctattcgaataggttatactctgatcagaggtgtacatctttacccacaagacacatctttctcacgtgtaaccacgtgccacataccacaactgtatatggacggaagacgtgacatagtttccaacccatcctagccatagacaagagtactgacccaaccccacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagactggtccttatatggccgaggtgctactatcaaaaccatgcaccccgagcctagcctaaaaccattttgaggattttgaatagagggggaggtgtgaatccaattccacaataatccatccattccatagtgtccaggtgatgagaatattcccaaagtctagaattgtaaaaccacctaatgttgcctaattaactagcgaaacatctacctaaattcatactagtggtaccatgagtagagtgtccactagttggggttttgtttaatctagggtgaacaaggtaataatatcaataacaataataataaggtcataacaaaggtaaataggcatagctaaataaaacagtgataacgcgggaatttaagtaaagcgataatgcaataatttaaatcaaaataattttataaaatgggatccaatatgttcaaggatgatgtgacttgccttgctcgctttcccaaacatcggcttcaacctccacgaagagcggatcttccgaagctgcagcgtctacacgaccaacggaaaagaaaaggcttttactctaataaactccatataataagcaggaacaaagcacaaaaatgggttcttgacttcttaaggaaaaattagagacttgaacggtccaattccgagttcaaatggccaagttatggccatttgaagtttatatgctctttaaatgaatttttgcgaatttcttcatttaaattttaatttaaaaagggtttattgcgtcagccgagcgggaggggtgcgcggaccgggtccacgggagtggggcccacgcggcagcctcacggtccacggtggaccgggtgcacccgggctcacaccggccggcgccgtgggccccacacgtcagccgcacccgagggcgcgggcggctgacggccgggccccacgcggcagccactcggcgcgcccgagggcggccacgccggcgcggtcggcgggaggcggcgcggtggagcagcggccgagagaggggagggaagggggaaaggaggcgacggtccacggctcaccccggggcgacggcggcgacggaggaggcggccggagcggagggaggcggtggcgcggctcgggtcgacggggacggcggcgctccggcggtcagcgaccgaaacggaggggtggacgaggtcggcgaggatgcggcgaagccgaaggaggcggcgccgaggtgggaggcggtccggggcgacgacggcggcggaccggagctcggctgcgacggcggagagagagagcgatggcgcgagctcgattccggcgaggagaaggcgcggcaaagggtggaaacgggcgaaggaagtgcggggagggtttaaatagggttggaagggggagagagcggccggaggggaaggaaaccggcgcgggaggtcggccgccatcaatggcaccgacgagatttgcgggggcaaatccgcccgtttgaacgcgagagagagagggaaaaatgggggaaaagggagagggaatcacggagagtatttccccccactttattgcacgcggggacgacgggaggcggcgggattcgcggcggcggcggcgctagggcgcgggcgaggcggcgggagcggcgggaggtcgtggatgacgggtgggccctacccgtcagcgagggtggcgggcgggcccgcccgtcagcggcgcgcgcgcggggaaaggccgagtgggccgcggggagaggagagagagaggggggaggagagatgggccgggccggcccaagggagggaagggggacttttagggtttttctttttataaaactttctcaactttgtttatttcttaataattattatttgtgctttgaaaattccactaaaatttatttacacattttaggcttttaggaaatatacaaaaatcctctaagccttatttgacttttaactttgcacattttaattgttggaggctttcacacggattttaattattctaggcataatttaaaggatatattttagagtcgttttgggatgtgacaaggttgagttggatcttggtggtcactcaaattctagaaaatgacctagaggtgttggggttgaaagctgtagatttgctctgagatttttgcacaagtgaggcaaggggttaatcgagacccaactctttggagcacctcaacggagagtaggattgcaagataagaatttcgggacaaatcgtctttgtctcttctgtgatgtttctgtgcatgtgttagagcacctcaactgctctgtttacctatgatccatctcgtgaaatttagctttgtccctgttagaatttcctagtttttttctgttgcccggaagttccgatacaagaacaccggaagttatggactgtctgagcagaccgaaagttccggtgttctacaccaggaggtaccgggcctgttgaattttatcgctgtgatttgtttgtgattttcaggaaagcctattcaccccccccctctaggctacatctctgcgcgttcaggctacctcgaccatggtccctttgccccttcactttagctacctcgaccagtggcggatctagaaaaatgattcattggtgtcatagcatgctaattatatttagactatagtgttataatttatggataagcagtttaatcataggttttaccgaaagtcatcgatatcgcctgacaccgatgctaacactgtagatccgaccctgacctcgataatggcacaaatgtctattatctgtgttgagcactctgacctatttcttctttagtttaagcgtttatgctattcacacttggattgcaggggaaatgaagtatatggtagttagagatatattaagatgggattgatttgtatggttgtttttcatatttctaattcctccttctctctacccatgtactccctccgtctctaaatatttgacgctgttgactttttttaaacatgtttgatcgttcgtcttattaaaaactttcgtgaaatatgtaaaactatatgtatacataaaagtatatttaacaatgaatcaaatgataggaaaagaattaatgattacttaagttttttgaataagacaaatagtcaaacatgtttaaaaagtcaacggtgtcaaatatttagagatggagggagtatcttatatctatacatatctctcaaagctcgttacaatcaactagtccacaatatattctctctgtattatttgactttgacttctggacattttggggaattctcaaaagatgggtttggagatgagttttacattttcttcaatgaattgaagtataaatttgaggtaaaatggggaagttttgggagttgctcgaaggaacttttgtatggggattttaaattttggtatgaagcttgtgttctgatttttttttaaccgagggggaactttgttccagcttttatatttggaagaagagaaatgacccagtttataaggaaaatcaggtaaaaaaccaaacaactgcacggttaattacatgaaaccggctcaaacccaccgctacacaactaacaatgacggtggagcccaaacgcaaaacatcgctgctatgctaaacataaatgcgacacaacagctccgacatcgcagaagaggtgttatcattccctagctagccgcccaagcgacccaatagcgccgacttcacaatcgcagcgacactgaagccacgaaagtcgccaaagcgaaaaacagctcgaacatccaacaatggacatcagccaagccactgaggagccacttcctttgcacggccagcatcacaactccttaaaatagactgcaagttctgaatttttgggtctttgatgttttgtgtcaatagaactatagaaggggatagttgttgggtcttatgtcagcagatggaattttggatgctaaaataggttttactaaaatatcttatccttccgctgcgaaggatatgcgagaggtttttcctaaaaaaaaaaagatatgtgagaggaaactcctaggcccaacagattgcagtttgtcacgagaaagggcgtccaggaaaggaaaaggccatctagttcggtgtggagacaccaaccgttttcctgtttgtcctaacttctttggcttttttttattatgtttcctaagcaccaggattttgtaataaaagtacaaggaaaatcgtccactccttgtcattttggtaacgctcccgctcatggatccctccattcacgtgaaacaattatcgcaatgctacatctacacttaagttgcaccacgaaccttccagctacaaattgggtacctaggtggtattcggcattaggagaaagaaaaaatgcagcacataattttcctcgaaatgagtctgcattgtatgattaaaaataatgtttgcatttcagcacatgctcatttgcccgattatcgtattattctcgtagagctgtatgcttttaatcttccttgtcatatgtattagctcaaatacatatcgcgagacattttaggatatcataagttaattttttttagagtttgatcaaatttatagaaaaaatgtgacaacatctataacatcaaattaattttattcaaattcactggtgcaaattaagtttattaaattcactagtgtttaaatatttttaaggactttctataggacagccagctgaaatttttggtcatattagctgagttttagacggggatccttcccaatctgacacatatcaagatctccaatgacagatataccaaagaagattatcatagtcctccatgataacagtagcacaaacattataaacgatatccatcaattgtagaaataattatgtttatgtttccatcttagagatagcaaaagtagttgtgaccataagcttgtgagttgtgaccagacaaaacaactaatgcaaccgatccgactaagaacaacgataattgggtcatagagttgctaggtaaatttgctttgagaaaataattttatctaattatgatattcatagtttaaaacatagtgctaacaaatagtaatgattagaaatatatattggaaaccaaatcgatatcaaagacactaggctgtgttcggcaccccttttcccaacccctatctcttatttttcacgcgcacactttagaaactgttaaacggtgtgttttttgcaaaaagtttctatataaaagttgcttaaaaatgaaactaatccatttttgataaaaaaatagctaatacttaattaattatatactaattaaccgctccattttccgtgtatattgtttcggttgggaacatggaatggcagacacagccttagagaataaaacatgctataaatatttttaaaattgttgatggtttaattttaaccgaagggagaacattcaacgattctgcagctgctccgtgctcacgagtcttcctgtaccaaaacgacgcattgatttatgttacggtgtagtaccacgtgaaactccgggtacgcctagccccccatgaatgcccaaccgacaaacaacaaaaaagcgttactgcgcccacaccaacctcgcttgctggccgttggattggattggatgacgcccacccggcccaccaccaccacctcccccctagagatggcaacggtgaattcaccgttgggggtcatgcccgcgtccccgtcaccgcggtgaaaatatttcactgtccccgcccccgtcaaccacgacgaggctataatttctccaaccccgatcaccacgcggtgaatttttccccgtggtgaacccgtccccagttaaacaatatattcacagtcacagattgtagtatgctcaccttgcatcgtcactgttgtagctttaggagggaggtggccgaaggttgaagccatggtcggcagatggcggcggcgacgacagatggcggcggcgactcccgacggcacggcgatgacggctcccgttgaagatggctgcaggctggcggtgcatcgacggagcctgccggccgctcctggtaaagacggcttcaggcgccgcgcggcccggcgccgcgtcgacgaaggcggccggtgacgggcagcttcagtctcctggcgagaaggcagcgagtggcggtgcgcgtggtggctggcgaacggcgccggaggtggctggcgaacggcggcgcggctcccggtggactggcgaccggcggcgcgcatgactcggtcgggtggctagtgtggatctagatctggatgggtggaaaatttggagattgacctgttgacttagggttagattatatatgtctgttaaatgggcttcaatattatgggccaatacatctaaaaagtctagaattcctcccttgtacagtacagtcgggtcaccgtgggg

SEQ ID NO: 73196 - DNA, 677 bp, Oryza sativa
gcacacgtgtagggtgcagatcgtgggtgcatatgaacccaggtgcagattatccaactcctataaataattactgcctcatgttataagttaaattttaactgcatgctatgtacctggtggggagcaaggtgagtgggttagaggctgtatcaggtgttatttaatacgtagcaccttataacttataagatgaggcagtaattattttactcagccttcactaggagtggtgtacaggcaaattagaggagagatgatccagtgatttttttacttgccgtacaatttttttactcattaagcgttcacatcaccagacgagtaactttttaactcgggacaaatgggatgggaaaagcctttgcaggcggtggtagtagtaaaagcggtccatgaggatgcggcacatgagaaaggcgagaaatccgaagttggacccagaaaaaactaaaagccaggaaggcgagcgctgagaggcgcgctacttccttcgtagcgccaccatgtgcgcgcgcatatatatatatatatatatatatatatatatataaaatatttacaaatagggagagaaatagaatttacaaagttattacatcaccgtgtatatccatgatttccaaataagtctttctactttcaaataggcccaaactatctcaatatttttcttc

SEQ ID NO: 73197 - DNA, 592 bp, Oryza sativa
cgctccacgtacgttcatcccatcttcgatccgcgtgatgtgtatatgtgcatggcaagacaaaactccggccggcgaaggaactcggccatggagatcgaggaggaagacgtgcacaagttggaggatgcgtcgagagagagagaggagaaggaaagtgccttgcgtttggggaggaggaatcgaagatgtaatagccggccataaatatgatatatatggagccggcctcacaataaagaagatgagaagtgggccgatctggcggcgcggaagacgtcgtcacaaatctaccggctctacgcctctaccggcgacgtttccgcgcggtccttcaaccaaaaaaaccagatgcaacaggtccctcaactattaaaactgatgtagataagatctctcgacggtttagatggtggttttggctgacgtggcgcctacgtcgcaaattcgacttggtcttcatctgacgtggcgcttacgtggcaatttgatccgaaaaaataataaaccatgtgggacccacatgtctgtttcacatacaaaataataaaaatggtgggacccacgtgggccccacatgtcatcctcctaa

SEQ ID NO: 73198 - DNA, 502 bp, Oryza sativa
acatatatcattttctccaccttgacaccattgtatccaaatgcaagctattgtatttcaaatggcccaaaatacccattttacatctcttctctcccacctcactgacatttgggccccacacatcatcccctacctctttttttctctcgttacctctctcgtggtctctccttttccatatgcctgaggaaacatggcatcgtggaggactaggtggctagagggggaggggtctcaccgccttgaagataccaacattgggttgtgtgcatctgaacaggttgtcatggggaccttttctcgtcggaagtggaggacgggcttggagtgtgcaaagtggaactaggctggtggagggcagcgacagtgggtttaggttttaggttcagcgttggacaatgatgacgccatggaagcagaagagggtggaggagatgttgtccaagaacctggtggcggagctatgcctctccaggctctactccatcgtgccaaagat

SEQ ID NO: 73199 - DNA, 2613 bp, Oryza sativa
ctggcttctgcaaacctctgttcatgcaaggttaccttctgtgcaaaatgtgacaaactatcaaagtcttgagacgagaacttctccctgatcggagcaatcataccctaaaagccaaatcggctaactgggcatcagttaaactcaaattgtagcacttattccttatctctctaaatctctgaatatactcatacacaggctcatcatgtctctgcttgatcgctgttaaatcgaacagtttcatctcgtgaatcccactgtagagatagctatgaaagtgcttctccaaatcggcccaactattgattgatccacatggcaaagaagaaaaccaagtgaaagctgatccagacagagacaatgggaacaacctaaacctcaaggcatccacagccgatgcttcaccacactgagctaaaaatcggctaacgtgttcataggttgacacactatcctgccctaagaattttgaaaagtctagaactttgaatcggttaggtagagggactctctcaaaccactcagggtaaggatgccgatacaaatttccaacgtctttcggcatgagcccaaacggctccttcctcacatccacaatcatatcggcccatagtcgttgctgaggtactccttgaggttgttgtggcatgagctcgaattgattgtattgaggaacaaactggggttgagcccgtcctccctgctgatattgaacttgcagtgaaggaggctgatattgataattcaaattgccccctggtaattttgaaaatttggctgaatattgcacaccaaatgctaaggaacaacttgaggtatcactgtttgatctggctgtacatgatgaaccaagtgctctgggccaacttgattcgcagcatgctgccttggctgattgtcaggtgttgcaaacccagccgatgcattcatcaaaccttgctgttgaatcggctgaataacctgttgccttaatggtgtctgctgaattggttgcaaaacctgccgccttggtggtgtctgctaaatcggctgcacggcttgttggtttgatggcgtttgttgaatcgactgcacaacctactgccttggtggtgtttgctgaatcagctgctgctggactgggtccacggtaggtgaggtggtaaaaacatagctgcaacctgatcttgcgttagccgattcacattctgtccactatgctgtggttgttctctcaccaacaacagatgattaactaattgacctggtgccgacgatggtgcagcgggtgcaggagccgatactggtgccgtcggcggagccgatggtgcattaggaggaattgattgaacagctggctaattatcggtgattaagggctgataattcgggaaaacacctcctggaaaataaaccggtcctgtagcctgatattcagccattgaaccgtcaaccattgtcttcaccatgtttgacaaagtgttgactaatatcccagattgattgatcaaagtatggtgcacggcatagtcaacctgatcctggaagttgttaaactgtaactgtgctgtgttgccatcttggttaagacctccaccttgaaatccctgaacaccatcaccttgaattccttgaaagccatctgcagcacctttattactcggttgagccacgccatctggagcttgtttcacttctccatccttagaagaacctgtcccagaaacatcagcaattacttttactttgtacttctgaacaagtgttcccttgcgggtctccgtgaatgagctcaagaactgattccgtgcttgttgcatcattgcctcaagatccttttgctgctcaggtgtcaatttatctagagtgatgagcacaatgttgccttcatcaacctcagatagacccagcttgtggatcttagctttaacagagcgaggctcaccagccaaagacggcgacgctggcggtttctaggccatgaggaaaaacagctgttgtgattctgacttccgatcggtcccaccgggcgtgccaaaagcgtgttgatgtgaaaacacaaggcctgggagatctgcttaactccagtgtaggtccaaaactcaccttcgggtgtgctagcgtgccagttgatttgatcctgcaatcaacaagaacaaagacaaagaaactgcggttgaatccataaacgatagccgatcggctaagtgccgatgacatatcatttatctttgagccgatgtcatatatgcatcgatcggcaatcattaataagtaagaaataacaaaatctactagatcgactatagatattaacgatatataatccttatgtcaatatatacttaaatcaagtgattgggatagatcggtcgccatgccgagatagtataaatcacttagatcgaaatatatattaacaacgagactatatatgttcatagcatagccaatcagatggatctagcatgtatcggctaatactccgatactactctatgtaaagatattaaagcaagtaaaatataccaaacaaagagcctaatatacttaaatgccaccagatcttaatataaagggtagatttaacatgtcaatgaagcatacgagataaatatggttaaatcaagt

SEQ ID NO: 73200 - DNA, 8081 bp, Oryza sativa
agaccacagtcaaacgaggctttggaccggtatgatacaataaaccaagtttagtgatctcgatgtgcgctttacaagttcatgcacctaagtgaaaactcctgacaagtttaaggatcgttggtgtattttactcgtctagaagtctattatttccatgtgtcctgccttctctgaatcttgcgagttttctgaacttgttatggtctcctatactgttcaagcaccttattttattgtcacgcttgttgtgttgcaatgccgtttggccacttgtgccctctcttttcatccattttgggtgttcatcacaggatgtacataactgaattcctctcccttttttttcgtcatgtaggaggaagacaaggcacggctagtccaagaaacagggctacagctaaagcagatcaacaactggttcatcaaccaaaggaaaagaaactggcacagtaacccatcttcctccaccagcgtcaaaaccaaacgcaagaggtaccaaatcaatctttgcacatctgtcatatagcctggagttctgccgatccattgatttgcacttaattcgaacaaaaaaaagtaatgcaggtgataacaattcgtagcagatgatcgccgagggctgaacactatgctgggttacagggcaggaggaattcatccaaagcaataggaggacaattgcttagatcaggaaatgttctgcaagatcaggatcaggagccgtatattagagaaccagttatattttatagacaaaactaattgcaagtaaacatatatagttctgtaagcgcttgatttgaagaaaaggggaaatttttccaaaggggttgtataaaatggcgaaatttatatttcagtttctagataccactgggtaatactgctcatagcactggtgttgatgtttttgttctccatgcgtcgtagacaagcggttgaaccgtccgcttcagacgatttttttcacacgtatatatgtatgtattgctgtgggtttatttagcttatctattgtgttctgctgcactctgtgtgcttaatcagttaatcacttatatatattctaagtatcatttgttaatttgtgcacaagagttgagaaaatatcacacatgatgaatactttgcattcttttatactactcccttcgtcccatttttaaatacagccatgattttttcgcgctcaactttgactgcccgttttatttgaattttttttaaaaaataaaaatataagtcacgagtaaagtattattcatgttttatcatctcataataacaaaaatactaattataaaaaaatttcaaataacaccaacgttgcccttaaaatccagtatattgcaaaaaaaaaaacactgagttatgtattatctgttgacgtgaaattacgtcatgatacatgaaaacctgggaaaattgcttaacttcaatgtattatgagtttcgagcgcgccagttagtttgatccgacaactaacaagatgaaaatagatcgataatcaagatgttgatcatcaacttagggagccgatatcaacttaggaggccaatacagtatttagaaatcatcacaaaataacttatcgctccgatgaaacactacacaaaaacttatcagcttattaatagcaatctgatagatcggatttaactgagacagttataaatggtcgttaagtgaaaactttaaccgtcaactcctgcataaaaaatataaaatatattatcaaaacatagtggtaggggtttattggtggggttggccgaggcccaacaaattaaggttgcccagaccccaacagttcttaggcccacccactcggggaaaggcctaatctccctaaaagactagtccaataggggaagggtggctctcccttttaaggtggcttcctcctcccaagctaagcaaggtgggattattcagaggctcacatggttgccgctcgacttttgcgtctttgccaacgggtaatagtggaggatgtcctcatcaacctagatagaaatatcggacttaaccgagaaagttctagccacgctgatacaagtgaagttgatgaaacttacttcattgtcggagatcgaaactaagaactcactagaataaaatgtggcaatgtgtcacacccagaaattcccgaataaaattccaagcagaatgtgcattaaaatccccgtccaggaccggccggggtacacaaacgacaaagttgacatacagatccacgtcttacaaacattataaaagtcttacataaatgcagcggaaaacttaaaggataactggagctaagccttgacttggactgcagcgggaacaccactccacaggcatcctcgatggcacggacgaagcctactcctcggagaaaccaccatctgacgcatactcaaattctggggtttggggaaaatagagcaagactgagtactacccactatactcaacaagtcataccggaataggggtatgatgcagggaattatcaagggatagctataatggttcgtttgcataaagcgggcatttataaacagaagttgaaagcagtaaaatagttgtaataattaatcaatattaatcatccactgtccaacgctataccacgttgcaacaggcctaaccatccacctatactattcaattccattagactagtctagggtgagtctaatcacggtgaatctggttgaccgcccataaccgcgggcacggctattcgaatagttttactctgatcagaggtgtacaactgtacccacaagacacagccccacgacacgtttccgtgggccgacatgccaccacgacataccggaaagaggccgtgacaggacccttcgcataaccccctctaaccaagcacaccacacctcaggtttcacccccactcctcgcaaggcagcgggcagtcccctctcatgcctaggtgaatccggaagccgcataggccatcgcagggcccatccaaactccatcacgcccacccttgcctggatgcgtcggctagaggaaagctacactacaagcccagtcattgcccacgctggcttatggtaaatacgaggaattcttccagggtttcccgcgaagcagtccttaattgccctaggcgcgaccatcaaaaccatgcacccacggcccaccatttaatattaattaattagccaacaccggagcggtgagcaataaccaacatcaatcctagaatctgatatctatgcatttaatgtagttccccattgtgtgctagttgaactaagcaaaactaagcattccctagtccaatctctagtcatgttatatcccaagctaacaaaggaacatggtacaagacagcatggctatgacactaggtaaacatcccatagtgttattataaaacaatgcagtatttgaaggaaaacaatggagcatttgcaatatagggtcaacatgttcaagtgacaagcatgacttgccttgctctgcagctggaggaacttcggcgactatttcaaggtacaccggagcgtcgggagagacggaatctaagtgacatacaaagtaaacaatacaaacaggctatatgactactgaaacagagaacaaaaccatttttgatggattctacacatttttcttgatttactgagacttgaatgggcttcaacggagctcggatgatttagttatgaattttagaagatttactgtgtttttactataaacggaaaaatccttaattgatttattgcgcaataaataaatcccggggagagagagagagggcggcgccgacatgcaggccccacatggcagtgacacgggtggcggccgcggtggaccgagtccacggactggggaaaggacggcgcaccacgtggcgctgacgtggcgccgacgcggcggccacacggcagccacgtgggcggccgaacggacagctcatccggtagatcggacggcgagcgtggctcgcggccggcgcgcgcgggcacggctcaagccggcccagcggccatggcgcgcggcggcatggcgcgcgtgcagcggcgacgcaaggcggcgaccggcggtggagggcgacggcgtcgcgacgacgcgggcgacgaagcggcggccaagcagctaagcggcggcgcggcggctagcggcgcgggagagagagagagaggaaggggaggagggatctcaccgacgacgaccgacgacggcgagcgacggaggacggcggcgacggcgggattatctccggaaccacctagcgaacacggtggaaggggttagagagggagagggaattggaagagggcgaggatgccggccgaaggcggcggccatggcgatgctcaccggcgaacggcgcggagtgggttccggcggcgggatccaacggaagaggggtggacggggtggctcgcacgacggcgaacgcggcggcgtcgtcggcgcggctcggcgcggcggctagcggcgaccggagcggtggcggcggcggcgaagaggagggtgacggcgctagggcgttagagggcacgggagggctcggcgagatggggaaaaagagagagggggtggcggtggagcttaaatagaggagggggagcccagacgtggccggtaaaggtgggaatcgccggccgacgtgggggagtgggggaggagagagaggcgggattcgaaatcgaatcccggccgtctcgggcgcggcgcgggcgagagggagggggagtgggtgcgggggacgcagcgcatgcgcggcgtggccgacgtggcccagaggaggcgggaacgtgggtgcggcagcggttgaggggcgcggcggcgccggctggaggaaggggacgggcctgataggtgggccccacctgtcggcgaccccagggagaggagggaggtggccggctcggctgggcctcggactgtcggccggcccagcgggaagaagggggggaagagagaatgggccggcggcccaattgaaagaaaaagagaaaagaaaaagggaaaagaaggaaaatggattttcctgggattaaatattgcttgtgctcaattttaattggttaaaattatttctagagctctgaaaattccactaaaaatcttgttagcatatttcgacatgtagaactcaagaaaaattccacatgccaaatccgattattatttgcattattttattagggttttctcttgcttttacaccgatattttctctggtggattataaattcaatttaggcttgggaaagaacttcagggtgtgacacaatgcaccaaaaggaattgtattgatatgtgaagatgtcttacaaagacttcgggtgtacatatttataatctcagattgatacaactttttattagacacggtataaaatttcctaacaagaaaaggaaaataactaaacctacatatttaagagatatactaaaaatatgaaactgcctttgttgtagtcttcacgattcctccttgacctcgcatgatctggataaacttccatcgataaatcaatttgtttccttaattgaatccactaaagaaccgtaccaaattttggtgttaacacatgcctcctaatttttgagtatgagaactcatactacaaaactatcttcttcctgatctttatgacttcaaaatttattcatcttttgcctcttgcaatcggttttcatgagttgataccttctacatcagatgagctaaactttcaaactcttgaatggaaaaatctttctttgataggtgttgacaatccttgaaataccaattctgctaattgtgcatcacttaagctcaaactatagcatcgaccgcgaacatcacaaaatctttgaatatattccaaaaccgattcatctacttgttgcttaagcaatgccaaatatgtgagtttcatctcattgattccagcaaagaaatacttatgaagctgcttttctagatcggcccatcttttgatagaatttgaaggtaatgatgaaaccatataaaagccgatccaaacaataacaatggaaagaatctaactttcaaagcttcaccagctgatgcttctccgcactaagctaaaaatcgactgaaatgctcaattgttggtatattgtcttgtcctaaaaatttagagaaatctggaaccctatcaaactacttaggatatgggcattgatacatataggtttgatcgatcccaaactgttctctcatcatctctatcggcccactcattattccttacattgtccatgttatagtgatgcgacattgttccttgcatacaatgatacccttcaccatgcgtatactgatgaggttcttctggccaatattgatgtagttcttcatactgatgtggttgcccaccaagctgaatacgtccataaaatatttgaggcactgctgtcatcattggcatcaacaacggcatatgtatatcaatgtttgccgatgtctttaatccttgagcaattgtttcgttcaccccgcctgagttgaatattcattctaactaggaggaagccgcaccccaatagaggtgcacgtggttttgttatttatttttctgttttgtttatttgaatttatattttgcgttccttttaactgctgtcgaggacaggtcgagcacttctttaccgtgaatattctagaggaccatcatcaagcaacatgttccattttaaaaccaaacttgtcatagttaagattctggcttagaataaatgggattgacatttttcttttatgttcagggcccgggggccatccgtttgatagcgattttaaaagaaaaagttcactttagttctcttatctaatgattgaggttgattgaatcgggtcccacaacggtaaaaccgggacatccattagctttgcctccatgccactggcctctacaccctccgccaccgcaggcaaccaccacaaccgtgcgcagccaagggagagggaggggttgcgctagaggaagacggtgacgaaacacgagctcgacatctagcgccgaagggaggggaaggaggcgccgatggccgcatccggggaggtaggggagaaggggaagaggcaccgtctcgctggcctttagacccctccgccccccaccggccaccaccactaccgtgcatggccaaggaaaagggaggggtcatgttggaggaagatggtgacgatgctcaacctcgacatccgccaccgtccaaaggggatagagagggagagagggtgatgaagggatacgggtaggctacgatagcatgaaataaaaattttctacgtagactaggaaccatgcgagttagggatcacaaaccttagtgtatttgtgtacgaaaccatttgcctcatgatatcgattaagtttaaggctagatatgtgccatcttttaaattgcttaatcatccactcgatcatgtattagattaagtgggatgaggatcaagtcaatccaaccacgttaaccgaaaccgccatccaaaccatcttgggacctcgtttgtggtttagcggttgtgggatgctattcaaactcgatcgggagccaaattaaactttttgtcatttcaaaacataaaggaaaaagtataatttgactccctcaactatcgcccgagtatgattcatgtcctccaactacaaaaccgggtatatcgactcctccaattatcaaaaccggtgcagacaatatccctaggtggttttggaggtggttttggcttacgtggcgcctatgtggcggtcttgaccaagtctttgtcctatgtggcgcttacgtggaattagaataaaaacaaaaataaaaaaaatgtgggaccccatatatcattcacacaaaaaaaagtattgtgggacccactaacatgtgggtcccacatgtcatcctccctctccttcccttcttcctcccctcctctcccttctctctctctcccccctgcctttctcttggccggagtggcggcgaggatggtagtggggagcggcggcggtggcggcggtgccggtggggacgagggtggtgccagccgaggagtgcaacgccgcggtggcgtcacttgccgagtgccatg

SEQ ID NO: 73201 - DNA, 13019 bp, Oryza sativa
ttcatattggaatcggttgtcgtttgccgatgtacaatggtcgatattgttatgtcgcccttagttcaagctataattttatcaatgcttttgacattgtaaaattaggggggcacatatatgaaaaattgcaaatttttgacaaaatatggagttatgttgaatcggcatgaaagttattaagataatttcaatgaagagtcaaagttttgttagccgattacaaaaattcctaagacctattatacaagatatcactgagacaaatattgctggatagcccaaatagctctttgcctgatttgttgtacttcttcaatggcttgggtatcttgagcatcggttctaaggatgacttttaaagacttggtcagatcaacaacattcttgatagccgattttagtcttgccttctgctcttcgacaaactttgggagattggctagctttttatgttccatgtccaactcggcgttgcattcttgaagttgtgccaaaagctcaatcttgcgagcttcgagccgatcaatattagatttgatcaggccctcagatagctaatcaagcttggccttctcttcatgaacaagctgccgattggcttggattgtggcctcgatatctttgcgctcccaacattcagctagtctcagcttggctttctccagcttgaattgatgctgctcaagatagacggcaggagtaaggacatcggctagttcatctgggatcagagcttgaacctcatgtagccgagtcctaattgatccgcaatcaaccactaagctatctaacgatgatgcctctagccgatgagagatatctttgagaattttcctcacatcatcggataagggggctaaagctttgcttgtggtatcttcttctgtctcatcaagataatctctaatgtcaaaagagaaaagattagctaagacctgcaataatgatttaaagagagttagagctaaatagacatagccgatctaaattcttgtatcaaaaggaaacttactgggatagcaggagcagttggttgttcttcttcctcaacatgatggctccctatagccgatggagtttggtcactcgacgatggttgtgcaggagaagagggaggaggaggaggaggttgtaaaagagacaaatgttagacaaaattggctgagatcaactagtgaaagcattaaagatatcttactggtggagccagttttagagttgttgatgccgatttcttcttcacagcaattctctttttctgcaaggatgagattagtgagcaatcggctgaggataaatagttataaaagagaatcaaggaaagatattcaccctagagaagtgagctggagcagagggggtcggaggagtttgcttaggtgaagccgatggagttctttcagtatcgcttatttcatctgcggcttgatcaacatcctcgccgatttcttcttcatccagagcttgttcaatggatggatctagggcaggcagatcatcggttggtttaggcttctttaatttggccttcttctttggagtaggagacgatgtatccatagccgatgacctggttcttctctttttactggcatcggctggttctctgatgagcccttggagaagagttgaagtctggggggcatgatagccgatgacaggaggagatggcccacctccatttggaataaggcctggtgcatactctatgtccctgccactattggtctggtgaggaggggagaactctgtggtctgcaagtcagaaaagaaaattaattaagttatgaatcggctaagcaattatttaaacggagttaattaaatgaagacatacctgagggataacatctggaaagagatctgtcatgtacatagaagccgattgatggaatagatgcaatttccattcaccccaccatctgtcaaagtttttgctcctgaactttgccatctctatattttcaatgatgcccagaggaggtccttggagattgagcagccgatccgtcatcaaggttgatgaaatttcccctcagcactggatcttgtcagcaaagaataagccgattgggagttggcccattccaagttgtctggctaagctcatcgggtgatagaattcataagaaacttggatgtttcttccctgatggatgccaacaggaaggatgcatgggctgattgcagctgagaaaacttccctggacttttggtatctttcatgattgatgtcttcaaatctaaagtccgatgggagctcaaggtttgctgaatcttcataaggaaaccaaactcaagcatctttttgaaagccctcatagaaactgcagaaccggtccttgagcagttcaaccaataattttgctccagcatcggctggtgtggatgcatattctctatatgacatgcatctgcgatgagtgcgctcttctccatcatcttctacaatcggctctagtcttgggaattcggcttctgttacagatggccgattgacaactttcatgaccatcagatttagccaagtctgcagcagacaccatggtccacctgctccaactactgagccgacagctatcttggccgatgcattattcaacatttggtatagatagccgaggaggattttgcctagaggaaattgtttctttgattctagggcttcggctacaaattgccaattggttgtaggaccacaactggatccacagaagaggaacttttctagccacattagcaagaaagctacatgttcccgagaattgacaggccctttgcccatatatgccgctacatagctagaccaacctcctatgcttttggtcttgaaatcaaattgattcttggtgttcatgctcatagggttagccaatgaggttacatctaatccaatgatcatggtgatgtcaatcagtgttggagtcatcggcccttggttgaacaaaaaggcattgatgatgttggaccaaaaataagtggcggcggccatcagaggttcatctttagctgaattggctatggtaagggcaagtgcttggccgattccaatctcgtcccagtgaactttctagctagccgatacgcgcttgtaccatgtaatccaacttttctcgggtggagttttctcgagagatggccaagatttgaaggtatttttccagtgacctagatctgggttggccaatctgaagggaatcctattggtttcgccaatgatgaactcggtagggtcagggttgccgactgggccaaggaagtagtaattttcgtgcgacaggctgggaattgcaactaggttggagagatgctacaaatccaaaagaaccgagaggaggaaaaccagatgaggagttggaaaatcaatctgttgcgaggaaaagagatctagccgatgagaacttacctcagcgtactcggccgacggcgcggcagacgggctggcggaggacgacatcgccgcgggcggagatctggccggagatggagtcgcttggggatcgccttgtgcgtcggagaaatcgccggagagagaaaggacaaagttggcttaggcggtaaaaacggaagtaacggagtgaagattttttagggggcaacggttagtatttaaagcattggaataacggtcggaaaacgacaaggtgtgaatttcactcggagttgatatatggcaaatccgaaacattaccaaatattccggacttgggggcatgtgttgacgaccaaatttagtaatatcagtatcgaagatgaaaaatagatcgaagcgaaatcaaagaagaagattgattcgggaacaaagtaagaatcggctggagtctaaattggctacgatcaggattggctgagtccgagtcagactgggtaagccgatatagccgattccgacaatacgactcggtatacatcatcgggttgagttaatgtgcttcgtgatgattgccacacatggatagagtcctgagaaggcaattgtatctattaattaggatattttatgtgatttccttagagatatatttgggcaaaagtctgccgcaaagacttatgatatcttacagtttgttagagataagagtcgtgtccgatatggacaagttttgtaattctcgggtataaatagacctcgagccctgtgtaatcaaaaaacacacgttcaatacaatctcggcgcatcgccactcttttaacttttgttttgtttcgacgagttcttgctttcgggttgagctgcatcggtttcgatcttcaacaagaggtaaaacttgttatggcggcttacgttatcgagattagtgcttccatcgttatgatactctaatattgtttatgtaattcgtcgagttatcatatatcttatataatctctgacaatatcgacatctaacctataatcggctaacatctgtcagtagaaggcagtcgattaggttagatagcaacgttggcttagattatatatgatatccaccactctatgaaacacatcttgattgtctagatattgtcctttttttcatacttatagctgcatcagttgagtttgatcttatgagtcgtgattagaatctcaatctctagcctgcttcttggttgccgattagggtagtatcggggttttagccgatcttacttgatttaaccatatttatctcgtatgcttcattgacatgttaaatctaccctttatattaagatctggtggcatttaagtatattaggctctttgtttggtatattttacttgctttaatatctttacatagagtagtatcggagtattagccgatacatgctagatccatctgatcggctatgctatgaacatatatagtctcgttgttaatatatatttcgatctaagtgatttatactgtctcggcatggcaaccgatctatcctaatcacttgatttaagtatatatcgacataaggattatatatcgttaatatctatagccgatctagtagatttagttatttcttactttttaatgattgccgatcgatgcatatatgacatcggctcaaagataaaatgatatgtcatcagcacttagccgataggctatcgtttatggatttaaccgcggtttctttgtctttgctcttgttgattgcatgatcaaatcaactggcatgctagcacacctgaaggcgagttttggacctgcactaaagttaagcagatctctcaggcctcgtgttttcacatcaacacaacgctaattttattggagtggattggagttctcccatggatccttcaccgattttatgtgggtgaaatttggctcttgtttctgccttatgggttgtatggaactatcaaagtctaagtttggtaggtgcttcatgagattagattattgtcaggattatcttgttatgagattagattattacccgggacaattttggtaagtgttttttttgtctccgattggaaaaatcggacattgacgacacaaatgcacgtacaaaacggattgacaaacgaaaaattttggtggccaacaaaagttagtagttattaagattagctctgattatatttacttttaacactttttattggccataacaatttaatttttattggacataataattttaccttcggtatgatcatttagcttgctagtgttaaggacgtctatagaaataatcaacaaggttgagtgggagtgaattattaattgtagggacaaaatggaattttttgtattaaatatgtgtggtgacaaatgtttacaattttttttaaaaaagtaacaaataaatgagaattaagagatacgatatgttataaagagtacacaataaactgaatttaggcaacattttggaagcgcattaccacgtcaaatgatatggtggttctcaacttttagttaatacccatgttttcatggtcaactacatttgattagacacacaaaacacaaaattaggcaatttaacatttgaaacaagtacgacatgtgtcatgcgaacaactcggacgatagatactttcaggagaaaattctttgtgtcctctagagtacgggcctatcctttccatactcagttttcgcctcatcttgctacattgctatcatttaggtcccaattgagtttttgtgattaatgataacatggtgtataagcattatggttctgatgacaagatgttctacaattttgtttcgtcctaattgagagatagcatggtgagattaaaggctatatggcactatatgagtttctcgcattcaaggagttcgaaggaatacggattagcctaggttccttttttcatttttaaaggaaaaagtacgaattacccctctaaactattgtggttgtatgatttaccctcctgaactgtaataccggacattcgacacctcaaactcctaaaaccgaatgaattaccctccccctccgcagcactattttgggcagttttgggtaggttggctgacgtagcatttccaacgtagcaaaaaatattttaaaaataatgggtctacttgttagtgcttcatatattctcacctcttctcttctacctcttttcacctcgatctctgtctctacccttgaaccgagtagggaggaggaggaggaggaggcagcgacagcggagactagtcccccgtgacgcttgaggcggaacgtagtcggccagaaaagcctagggtgatgacggtgcatggtcagcggaagaataatcctaaagcggcggcggcggtggtctcaaatccaagacaagggcattggcgcgccgtccttgccagtgcacaactccgtgacggccttcccatgccgcaacaacctctctaacttggccaggtcaagcattggccgcccgtgttgacgacgaccaacaacaccccgaggagaggcgaggacgttgccagcataggaggaggccgagccgcacgctgacatgggaggaacgccgagagatgcaaagaagggggagagagaaaaagcagcgctcacaagtgggccccactggtttttatttgtttttgctgactgtatcgccatgttgacgaaaaatccgcgctcgccgatggtgccggatttgtgttggctcgaactaagttgacgaacataacaagttgggagatctgcttagctctagtgcaggtccaaaatattgttgagatgcgggtgtgctagtcattttgattctgcaactgacaagatatgtaaacaacagatcaaatagccaatcgactgacaagccgatggaatggttccagccgatatcgatagggtttgagcaatcggcttatatatccaatgtatattctgatacctgagtaaataataatataaagacaatcggctgttgatgataaataacaataatataatccagtagaaaccaatcgaccaataatgatataatagaacaaatgatgatctggaggttaaagcatacatcgcctggaggaccaatatcgtaaaatccaaacgattaggtaaatagtgaaacctttgttgagatcggctaaatccaacttgtatgtaatctttataagtcgatgcaacattgagataactcatcggctgaatcctcgataaaatccttactggcaatcatgaagcaggctagagattatgattctaagcacgacttagtagatcaaacttaactgatgtaacactaagtatgaaaagaaatataatatctagacaatcaagtttttgactaattttcagggtggtgaataccttggctaatatagaacaatgaatcaatttaactaataccaatgaaaccctagaaaagatatggccgatataggtaaattgaaacatcgatttagattaactataagatgtatgataaataggtgtttacatcaacaatattagagtgtcatggccctaaggtgctaggttaggccagcaaccctgataaatccgctgatgatattagaatcaggacccttgagcagatataagctttcccatgaatgacactggacaactgcataaaggaaaaataacgctttcatgccgatgtaacaactctgaacaaacaaaaatattcgtgctcagaaataaatttgtcattgtaccagaagatccagatgcaacaacaccaaaagagtcaaagagatgaattttttacatctgaagagataatctcacctataaatgtcataattatacaaatagcacgtccatggcaatatgacattggttgggcagttcacgcagatggttctgctgtaaaatgataatacaaaagtttagttacaagcaaagcaaggataaagtgattttgagcagtttgcaaacagtaccactttcaatcttctaggcttctagcaaagcaaggaaaaattttcagaaccactcaatcactttcacacgttcataatctagagttggtgatttcgagcaccttgcagacaacagccctttcaatcttggcattcttacatctctaaaaatatcgagaagcaaatacaaattagttggagtgatcagtgatagagggagatcaagagcaaaagacatggagctagtggcatggcagcaaaagctataagagacatagcagcaaaatcattattgttatttagattgaaatatcttgaagagcttgtcctacttggtcagagatatgattgcaaaaattaaatttgaaatattgtcgatggaaaaaaggttatcgcaaaatttaagttctgtacaaaaacaaccatctgcagtctcttgagcatcatggagaaaattttaagcgtcttttgatcattagcttcatcaaaaattacaattcaaaacaattgttgagcatagcatctgttactggatttacaataccttgatgatgccccacaatactttcattgtaaaaacatatacactcctcattggcaggagaggaactgaagtgatttgtgttgtcagataaataatccaaggataacgaatacaactaattaggcagtgtaaatccaaaactgcaatgccgtcatacactcatacatgaataagtagtaatgccaaaaaagtcataaaagcccccagtatcttggaaactactttgcaattttcttcaaactgagtggcgatggattcatgtcagtcaccaataatggcgtagcatcaaacttggaggactggatacttttgcgttctagcctcttgtaacactgcagcattcaaaaattcgatttagttgaaatatgccaacagaccccatatgaacacggtgcttgcctttcactctagtgtagtgcagaactttccactgatgatattgatctttgatggaggctagtcattagtacattgagtaaatttcgacctaagttgaatgaacaacttatgtttcaggggaaattacacgcaaacatctcttaattcagcttttttttccctcctaaaagatagggaaacaaatgaaactaacttaaactgatttttttacattttggttctttttgaaaacttattttacaaatggacccctggaaaaacttaaaccggaaatggtcttttttaggacgccagaatggctggcgccgtcccccaacatggcggcgccagcaacactgttgctggtgccgcgctcgtgccaccgtggcaatagggcgtacgtggatggtgtgacgtggtaaaggagggcgccagccacactggcgccgccccttctatcacggcgccagccaggctggcgcactcgtcctgtgtgggcctcacccataaagccgcgcgagccccactccctttctcctctcccactcagtttcgcccctctcccagcccgagcagcagcagcagttctctccctctctctccccctcacctctccatctctaatccactcaatttgaagctgtttttcgcgggaattttttgtggaaatcgaagagaaaggtagactcctccatccccctatttttttcgtttttattggttgaatttgtagatcggagggtaaccctagaaccccttttttgcccaaatttgtgatttttagaatttgttcttgggattggcttgttgtagtgctacatgtttgcaatgtactcattggtgtcatgaatttttgaaccatatatgtggtaatgttaatttttggatggtttagttggatggatggatgaaaaattatggttgaggcatgaaagtaattttaatttgatggacttgatgctatagcctataggttaaacttttaaccattaattatatgaaggggagaaaattttggttgcattatagaaattttggttgggttgtttgacggagtatttgtaatattttgatgtgtaatgcactagtaaacttgttgatagttgtaggtggattaaatatttttttggagtagtagctttgggacaatttaagttatgcattggttataatatgtcggtttggactacgtttaggaagaaagatttaatttttgttgcaaagttacatttgattttttggtgtagatggatagacttgttcgtgtttactacggtggtagagtggtggaaccttatgttggtgcacatgttgagtttgaggatatgtcattgaagaccattttgtttcctacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttacatcaaagttggtacgtaccgtagaaaatttggatctaaacaaatctccttcttatcattacgttgagaagaattttgtgacatattcttctcgtcgtgaaaggggtgcaagtaagactgagttggtacgagaagacttggaggaggaaggagagaagaagagacctttgtttggaaatgaattaggggaggcaggaccatcaaagagacattgcggtagtgatgatatggatgcagcgagaaagatgaaaagggagttagtacaagaggggcttgatctaagtgaacatttgtcggagagtgtgcattggtcgttgtacggaggcaaccctgaatacccgacgcaagtagcaggccaatatgtgaatccagatgattactttgatgtcgaattgagtggtggtgcaaatttagttgttaacaggtggtcacgattctgtctcagtagaagtcaatagagaggaggttgacgaggaggcaagtgttgagcaatatgatgttgaatttgctaaagactctgatgatgaccgtccattccctccactaactaacaatgacaagttagcattagagaaatgtcgtgcgtttgagaaggtgtttgggaggaagccggacattcctgagtttagggacctaacacatgcccatggtgcaatactagatggcggcatcaacctagatcaattgccagaaccattccagatggatggtctcagaaagggtttagagttcccatccatggtcgcattgaagctatgactccaggagtacgccatcgtgcaccatcgtccataccgagttgtcaattctgccgcaaataggaggtacactgttaaatgtgaaaacccacggtgcaaatggaaggtccatgcaactaagaggtctagtggaacgtggaggatatcacaggttggtaaggcacatagttgtgctactgccaaaggttcagggagccaccggcagctgacatccaagttcatagcaaataggttatgcaatgccataaaactacaacctacactctctgcttctacgttagctttgtatatatttgaagttttccagtatagggttaagtatggcaaggcttggagggcacgagaggaggctatgaagctcatttacggtgaatggggtgaagtgtacgtccgtttgcccactttgctacaagccattaagcagagaaatcccagtatggtctaccacatcgatactcatcctgataggattgtcaacattgatggagtgaccaagaaaatttttatgcgtgcattctggtgctttggtccttccattgaggcttttaagcattgcaggccagtactagctatagatgcaaccttcctagctgggaaatacggtggtgccttgatgactgcattatcagctgatgcggaggaccaacttgtacctttagcttttgccttggtagagaaagagaattcatgagactggtgctggtttatcgatcttgtccgacgggttgtagttgggccgcacagggaggtttgtattatctcagatcgacatgttggtataatgaataccatgaggactcctgttccaggattgccaccggtttaccaccgatagtgcatgaggcacttcagtgctaatttccacaaggccggtgcggacaagcatcagacaaaagagctcctaaggatatgtcagattgacaagaagtggatatttgagagggatgttgaggcactaagacagcgtattcccgaaggtcctcgtaaatggcttgaagatgagttgttggataaagataagtggtctcgtgcatacgatagaaatggccgacggtggggttacatgacaaccaacatggccgaacaattcaatagcgtgctagttggtgttcgtaagcttccaatgacggccatagtatcatttaccttcatgaagtgcaatgattactttgtgaacagacatgatgaagcagtgaagcaagtccagttaagggagcgttggtccaccaaggtcactagtaagatgaagatgcaaaaaagtaaggcgaacaaacacacttcaaggtgtttcgataagcagaaaaagacatacgaggtcacagagaggggtggtataacgcgtggtggtgttagaatcggcgcaagagtcttcaaagttgaaggtgaggggaactcatgttcttgccaaaggccattgctctaccatatgccttgctcacatctcatccacgtgtatctgattcatgcaattgatgaggaatctcccaa

SEQ ID NO: 73202 - DNA, 547 bp, Oryza sativa
ccagctattcttatgaactgtgacaatcaaacggtaattgtgaaagtgaacagttataaggataacatgaaatcatctaaacatgtgaaaagacaattgtagtctgtcaggaatttgagaaactccggggttataacattgaattacactgaaatagctagaaacctggcaaatccatctacgaagtaactatcacgaaatgtgatagacaatgcatcgaaggagatgagtttgaaacccatgtgagttatactatggcggtaacccaatctatatgatcggagatcccgtgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctaggaagcttactaagagac

SEQ ID NO: 73203 - DNA, 2275 bp, Oryza sativa
gcaattgattgctcttcatcttcataaacattggctctaatcattgccttctccatctctttataatattcatcaacactgaggcttccttgcttaaattctgcagcttgtcaaaaagatcacggcgataatgtttagggacaaatcttgccctcatttctctcttcatttcagcccatgaacgcacatcgccttggccagcttcttctctttcatttagcatttgctcccaccagattagagcatagccatcaaactctagagcatccccggcaactttcttccgctcagaataattatgcaaacgaaagattttatccaccttcaactcccatgtaagatagacttcaggatcagatcctccttcaaacttgggcatggtgaattttaatttgccaaatctctcttcattgggctgatttcgcccacgatttcctcggtgacgacgatcatcacgatgaggctgttcaacctcttcgtcagtcccactttcttctagtccatgttctcttccacgatcagcacctctaccaccatttccacgaccaggatgtggaggtcttcttgcatttgcaacaacacgatctctccgtcttcttcgttgttctcttgcaaggcgagcagcagcttctccttcggattcttcatcttcttctccatggtgacttgcatttgcatcttcaggaggaggctctggcaatcgattcataagtgcttgaacattggctgttagtgcctccatgctttgcttcatctcattgaattgtgccatggtgacacaatcctcaatctcaacattagaacccatcttcctgtcaagttagtgatggcttgcaacaaatatttgtggaatatgtggaataggaaaatatatgtgcaatcacacaacctcacctctctaccgaagctcaagtgagttccctgcagattacagaggaccaatgcgaggtggtaacttgagaatgatggttgggagaatgcaagatcagcgttcctatgacggtggattacttgtggagcttggtggggatatattttacaaggaatgcaatctgaattctcgctattgtaaagttaaatcacagtccaaaatgcttagtgctgaccacaagatatgaataacgtaaatagatcaaacacacacgcaaagataattcagttttgatgcaaacaaggagtatgcttaggatgcaagtgttgcaatcagacctaagcaaaattttgcaccaaaagatagataacaaactgattgtgcaacttgatataaaattcagaacatgtgcacataaacaaactgatctttcaacttttctttctcaaactttcctcaactctttttcttctctctttttttttgtaacttttctttcttctctttttttttgataaacttttttttatatatataactaagaacaagaacagatatgaaacttatacacttttctttttgtagaaacaagacacgaccgtcagcgttctaacttgataggatcaaagtttacgcgaaggatgataccggtttctgaatttttttttatatatatggatttgcagatgtatgaaagaagctcaaaggacacgcaaaggagaatatgatcagcaactaaaacaagactctaatggactgaaaattaactaaactcacaagaataacagattgaaacaaagggctatagcagaatatttttatggctttttcagtggataggacgaacacaaatatatatgtagctaagggtaaaaatcctaccgttgcaaccgaggctctgataccagatgatgaggttgttgtcccgatcttcacgacgtaagattgatcttgataactagccgaagaacgaccgataacttgctgcaagcagcgataattagtgcaacctgacgacacgcacaaggagccaaccaccgtctctatacggcagcctgaaccaaggattcgcccaaccacactctcaaagaaccaacctacgcaacctaaactcgaggatcaggagcacggattgggtgccgatgacgcggccgcttctgtaatctccgcgaaggaaaacacaagagaaaaggggtagagaatctctctctggggtttgttagcacacagctgaacaaagggttccgaattggattatcaaaagtctgagtttgcaatggtcttaggggttatttacactagcaacagccctgctagataggtgtgaattcgagatggaaatgaaaagactaaaaatgtgaaagggcctccacgaaatggcttctgaagtgggttcgcgaggct

SEQ ID NO: 73204 - DNA, 693 bp, Oryza sativa
ttttgggacgcgacaatcttctacctccagccgccggcacaggccgagcccaagccgtcgcccgagccgctttcttctcctctcaaatccgctccaatccggcctcttttcttccggatttttgaggggttttgatcctctcgttctcctctatcttttcccccaagttttggagcaaatcgttgtgtatcttgttcgaatcaaactcgttttcgagtttatctccaaaaccgagttttgattttctcggatcgattcctctcgtttggagtctgatctcttcaatccaaggctatataaagcatcccctcgtcgccctctttcgtttgccccctctctcgtcctctcccgtgcaccgtagcgccgccgccgcgtgcacttagccgccgccgtcgccggccggtcttcagtcgtgtcgcgtcgtcgcctccgccgttaggtgcgccgtggtgaggagaaccccggccgccacctctccttcgccgccggccgccacagctcgccgtcgccgttcaaccgagccgccgccgtcgcccttctcgtcgccggccgtcgtcgttcgtcgtttgtcgtcgtggtgagtactgtcgggtttgtctcgtcgtcctcttcgcgtaggtgctctccaatcgcccggccaaggtccctagctccggcgaggttgccgcccgagtcggccggccatggatgacg

SEQ ID NO: 73205 - DNA, 3439 bp, Oryza sativa
tttttgtacttgcataatggttttttttttgccagatacttcctcctaagcatattttgccacagtccatcctcattgattagtttaaataaccatgtacttaacatacacctattttggatttctaagttttgaatccctaggcccccgcattccttagagcaaggtcaatagtgtagccagctactagctccaataatatccatgtcattttatagccaataccaaaattaactagtacaataggttggctattatatcaacatgatctcattattcaaacaataaactttacatgtgcatgatcagaaacgccctcaactctgtggcctatatggccatttgtattatgcaataaacatgggttatctactactctacctgaaaaaataacgaataacaacacacttgataattcacatagtatatcacaacccactgccgcccaactgcataatctatacatgaaaaaaggagaagaacaaaagggaaaataaaaggagctataggaagagattagaacggactagatgcaacagatgagacgaagaatcggtagaacagacatagacgacaagcattcaacagaccaagggagaagaaaagaaaagaattagaccaagccaattcaaatcaagaagttgcttgttgctttgggtgccagctgcatgcccgcaccaagcgcttctcaatcctcctctcgctttctttgccgctgagaactgggattactaactttttgggcgcactggagctttcacggcggagtttcacgtcgcgggagaaaattccggcgagacaagggtgagcggaggcggcgtgaagcggagcaaaatgcgtcgggcggatcggaagaggcacaacaaaaacaaaacgatacacgggatcgcgtggtggttgcgggacccacaaatgcatgcgtatctgtgtatcgcccggcgctacatctagcgcccgctctgttccctctctccagttatactctcctccacataagaatagtctgagttggaatattttggagcctgctgattagacttattgtacctgctcttaggtctgcaaagcacactccatttggctaatctgtatttctttttatgctcgtcacattgctaaaagaatctggacctataatagtccagttttttaaggatacctttagggatctcaaagaatgaaagcatatacattgctaaactactcaacacggagttaataagaattaatcttcctccggtcgatagcaacttccctttccaactactgagtttcttttggattctatcctctagttccttccaatcttaattggccaatcttctgtaatgcattgggaggcccaaatatctaaatggataagatcccattttgcatccaaacaagctttcatatatgtcttccctttctttagccttgccataacaaaacatttcgctcttatggaaattaatctttaagccggataacttctcataggcacatagtatcatttttaagtatctggcctctttcaagtcattctccatgaagagaattgttcttcagttatatttaatttcaaaaccttatgttgttgcagcaaatcagtaagaaacatcttagcatttgtgtgaaataggtactcaactaaaataatatgtttttttgaagaaaccacaaactaaaataatatgttactgtattaataaactgtagtgaataaaacaaccttgattaatttccttcatttatgttgtttacatttgttgttttgtgcagtctaaaacaagcagtttgtccccacttgtctcaaatttgcactataatacgaagtgactttgaaattttaagttgcttttaagaattcttagtatcacaaaaagagtgcttgccaacagaagtaatcaaatagtcttattcgtcacttttaaaatctgattcagattgtaatccaaggattagccaagcacatatctaagtagtgttggctcaatacctttttagctacttcatcatattactgacacagattatttgcttcacgcatttaaaaatacattttatcaaaaaaaaaattcttctactcctttgactagaccaattgctctaaccatttgtgttaagttgatttttcaaatattgaatttgtccctacaatcaagtaaataatccacagcaataatccgatgaataatttgattaacgtaaatttgaatttatgtgctgattttggcaagtaggtgtatctttgttctgtatttggttatactatgagcctttatttataggtatactataaaccatttgatgtaactgatgattgatacaagatagtacatttcatcccctgctctgtttaatgttttccgcgttccatttactccaaacttatatcatacagttttttcgtccatcaaatacaacttcctccaagttcactctgtcctaaaaaaatcattatttcaagacactatttcatttgttattcatattaagatatgatttcagaccaaagaagaggagggaaccgggatgtggacgaccttgtttctgctgaaaaaggcatgttttaacttctgtcagtggaggcagcttggacgcttactagttcgtgctgtatcgttgtggtttttgctgttgtattcactattattttcgtatactttattgtcattttattcacactaccatatatggaaatgttgtgcctgatgtgtaatatttcggtaggcacaccggctaaaacattaaatggtcttaaataccatgggaacacatctgcccttctatgttacccagataaatacattgttattttgtgattataattgtaaggccgcaatgaagatttgtgctatatattctgaccaaagagtaaaaaaactatttatagtttcctcatgtttttgcaaaacataatttaaataagtggattgaaaccaaattgaccaaatctatacttgttgtcattgaccacgacagtaaactgcaaaccatgggttagcacgactcacacaattggccttacccagtacccactgactcatggtgcccctgtgggtgaagtcatggttagtagtttcagatgcgtaataagcattaaagcagacaaaccgaagtgctatggcataagatgtgcaagcggcaaacaggataaactgaaatgaactctctctcccaattaacaaatttagagttgtatcccttttaagttagctgaaatttttatattttggtcctttttgaaaacttattttacaaatggacccctggaaaaacttaaaccggaaatggtccttttttagggcccagagtagctgcgccgtcctccaacatggcggcgccagccacaatggcgccgcggccgtgccaccgtggcaccagggcctacatgggcttgctgactcggcagagcggggcgccagccacactggcgccgcccctcataccacggcgc

SEQ ID NO: 73206 - DNA, 17438 bp, Oryza sativa
tattgttgaagaaattttgatgatttgatatggatctaatggttgaaattgttagttagggtgtgtgtgattcactaattaaagtagtttgcaacacttgagttagtcatatttgatacttgatgaaacccgtgctgcaggagttttgtatcatttaagatagctagatgacaactttatatactttatacaatattcatctttgatcgactatttaaaaaaaactatgaacggtagtttataacaaaactaaggtggtgtggctcaatgagaaagaaaagaagggagataatatacatttatcatccaaaagcaaaactaagttgataggagaaaaaggagggaataatttatatatttttttatctttggttgactattgaaagaaaaaacctaaacattataagatgatatggtttataacaaaactaaggtgatgcggtgcaatgagaaaagaaaaataagggagataatatagatttatcatccaaaagcaaaattaaggtgatataatttaataacaagaaataaagaggaaaataaatttggaccgtagatcaatcatccatgtggcttcatgacgaaagagagaaatagcattaactacacttagtggggatgaactggtgtttagtacctagaaacaaaataatattcacttttagatgacttgagctaaaatgaaaagaaatacacattaaaggaatcaagatactatttataatatttagaatttcttatgatagttttaatttttctttgttttttttaaaaaatagatggttaggacaaaaatatgttgatgattagttatgcagatgttttaatattgtgagaacatcgtcaaatattgttggtaccatcctaatcacaataatgtatttttaccaacacaaattcaagccacaacaatagtatgatacattcataatgaatatcttaacctttgtggaccatggttgctcaaaggaattgacacatgcatggggaggtaacattttagggtcataaatagaaatacttaaaggaatttaatttcttagttacacaggaagataagagtcatctctctcctaaacaatccaatagatatcatgagctacatgtgcatttcaagaatgatccaattgttaaggtttaaacggtgacgtgggtcaatgtatgttgatgagcttgcttagatgaattgacacatgcattgggaggtaacattataaggtcatgaatagaaataattaaaggaatttaattcctcagttacacaagaagataacagtcatctctctcctaaacaatccaacagatatcatgagctacatgtgcatatcaagaattaatgatacaatggttaagatttaaagggtgatgtggctttatgtatgttgagcttttggtcccaactatataggatatatagatatataatttgtagctagtgttttaatcatttactacaggttggggtttgccataatttcttaattttgatctgactcgtcacatattgtttgccttgtttttttatgaaatattgtttagcttgttttaccacaagtgtggccaccaattttggtgccacaatccatatataacttaaacatgtcgtggttttgctacaaaattgtggcaacttctggaagtgaccaaacaaagccccaaaattaggctatttggggctaatgttctgttgatggccatacactaacctgtagattgtcatcttgttggaaatgcaggggtacatccaagccaccaattatcgggcgtgacgaccagcagcaggaactagaggcaatgcttctcagctccgcaggatgcctcgccgtaatatatgtcgtcggcgatagtggtgttggtaagacgatccttgtaaacagtgtctgttcaaaccctctgtcagagaacacttcaaagagcgaattggagtgaaggtcggaaaagatgtggtatatccaacatcctgagtttgataagcaaagaactgaagaaagaaaataacgaaagtgacaatgagaatcctagaagcaagatacaaagacgtcttggtgaagagtgctacttgatcatcatcgatggcaggcagatgtccatcgctgactggaatgctgtgatccatgctcttccgaagaacgaaagaggtagtcgggtagtgctcatcacgaaaataaaaccacagtttctagaccacccaatgaatgatgtccatgagataaagctgacatgcctcaatcaaacggactgcaggaagctgttccacatgaggctccatggcaaagaggaggatgaacaaaaccaaacctacctgccaatatactaccagcgtgtgtatgacattaccgggggctcgccattggcagttatcctgcttgctggactcatgcacaacaaggagtatccacatgaatgggatagggtgttaaaatacctcgagtcagccaaagagaagcggctcaacaggatactgtccctgagcttcgatgacctgcaccatgagctcaagctctgcttcctctacttcacagcattcccggtcagctacaaggtgtaccagaacgtgcttgtcaacttgtgggtatcagagggctttgtggtgccgcggcacgggaagacggtacagcaactgggacagctatacctgaggcagcttaccactaggggactagttactgaagcatcagctgatggtgactacgacatccgccactttttcctccatgacagtgtctacttgtttgcacggtcagaggcacatgaggcaaacttcatggagctgcatgatggtgactacttcccatcgccggacagggctcgacgcctcacactacataacagtatggacagatacgcggcactagataacaagatgcccaagctacggtccatctttgcaatcttcgaagagataccagccagcacagcagaagaaagtgtatcatctcctagctgcttccccacctgctgttcatgcgagcagcacagatcaccgaaaatttcaagatttgacctcaccaagctgctgaaaagatccaagttcctacgagtaatcatgatcgaaggcctgaatatcggcaccgagttgcctgaggcaatcggaggcatggtgcatctccgttaccttagcacgcgttgccgatctctgaggaggatccacccgtcgattgggaatctcaaaaatcttcaaacaattgatgtcagacaaagcttagtgcatgaactgccgtgttccttttggaagatcacatcgctaaggcatgtgtttggctctgagctgatcgtgccaagatggactcgtgaactgaaacagctaaatacactcaagtcggtgagagcattgcaggattgggatggctctatgttgagaagaatggttaacctcaagttactggatgtgactatccaagagaagctcaaagaggagaaggcgcgcaagttatcagacaaccttaacaatctcaacaaccttactacactgatcttgaaaggagttgacctcccaatctctagcatttttacggcaccttccctgcaattcctcaagactatagaactaaccggaaccatcctgctcacaactccatcaccagaaatagacaagatgaccacttcaccttctgatttccagctgccgaacttgagcaaattgtcattgtcaaagacgtgtctgcaacaagggttcattggaaagctaggcaagctgccccttctttccaatctcacactcaaggatgtttcttgtgacggagaagagcttgttttcaggcctgatgggtttcattgcttgaaaaaattggaagtaaacgacacgtccaaacgtgttgtgatagaggagcatgctttgcctgtattggtctctttgcatatcattgggaacagtagaaattaccaacactcgatccatcctactcacaagattatcaacaagattagacatgaggacataaatctttttcagcgtatctgcacttgtcatcagaaagagataaccaaaggctaacaagcatatatccttgtaagtttgtcaaattatatcgctttagctctgtatttttccatcatatgttgtttacatgcatgtaacaattggatatccttctttttgctaatttccagtgttaggaagagtccttcgaagtgaaagttgtacgatgtcatcgacgaagagtcagtttcctcttcaaaatgtcatcgacaatcataaaccaattctgcaatatgacattgcgaaagtgatttccttctgtttgcaatttttacacaatgcgcaaattacctgtaagtagacttgtacttcgttttcttgttttcgtttttctcaggagtcgggtgttgacgtgttgtagttcgtcattaatttcgtttccttgtgcgcggaaatgcgacccgcctcctggatcattctgtactattgcaacttacacaaccactgaataaactcgattagtgatcatatgaattgtttgtttggatctggagcatctggaaagttgatagctagaaatatggcatgcatggactacgatttttttttcgctactttgtgcgtgcctcttcatcagggttatttttttcgtggaatatttgggtgcgattccatctttaatacatcaccaaacatattgaggtcgaatataacaaacttgattaagcaataaattttaatcaaatggcttgtttgtttacatggctcgcaaagttaacggaattaattcatctgcagcctttcatgtgcaaaggtattgcgaggtacagacttgcatttatttgcttcccatagcttatgctccccctctcattttcttgtttctgttatgagtggcaatcctgttatttgtcatatggactaaatgcaaaccgtgatcaccctggattaggtatggtaggcatcaatgcctgatttttctttgatgtgtctccttgcattcgctggtaaatgagtatttattagggttaattgatccatgccattataaattcttcagttttgagatatgccattactattcaactatttaaggtcatgccattataatttttcaagtattgaaaatatgccactacatactcctttgatgtgtttcacaaaatttttagactaaattgccctcgtcgtcttctctcgttcatcttctacctcctatttttccctaagccagatttggatctgacgatgggagaagacgacgatgaggccaaggaagaagatgagggcaatttagtctaaaaattttgtgaaacacatcgaaggggtatgtagtggcatatttccaatacctaaaaaagtataattgcataacactaaatagttgaatagtaatggtataaatcaaaactgaagaatttataatggcatggatccaattaaccctatttattatggcacatttttcatgtccatgacgtcatcaacaaggggaatattatcgtagaagtctagaaacctggttgaaatataaaagttttctagtgtggcttggcatgtgttctaagagcagtacgataatcctagtcaggaggctccaaaaatttttatattgtttttttcatagatggaggagagagaatcaaagagagaacaacgcaggcccggcgatagcacgcgttttcacgcgcactcgcgattaaaaacatattttgtgggtcccatggtgacctatccgatcccgtgcgcatcctccttcgttccgccctccggtgcttcgtcgaccgacggacgatgtcttccgcagttccgctagtgttattcattgtcagcgagcgagaaaaccccaccgcccccacaaatcacgcagtctcgtcctccatcctgcaccacgcacactcatcctcagttcctcatcctcgtccatgaagtcttggcggcgcaattgctaccgacgagaagcatctcatgcgtgcgccaaatcctgataatttgggtacgtggtgaggtaagtagcggtgaccgtccctcgtcttgtgctgtcgcataatctgatcactgatcattcatgaagacccggtgggatcgatgtatggatggagctaatccatcgcgagcttgctttgttgtgttcaccctcatatcacaacaatgaccacaagaataggatccacttatgatcatacatgtcaatacctgtatgcacaattaattgtttgattacaaaattatagtcagcacaatagctaatctattgtaatagttggctttagtagtaactacgaaataatataagaatggttggagccagcagccggctaactattgaccttgctctaagcgccggtcgaccggcagtttccatgcttgatatatataatagttgtatgcaatattatatgacgcagagactgtgacttttatattattattgttatcttaaaaatgtgtaacccatagaagaggaagtgctgccttcctagtttgcatgctctgtttctcgtctttaatttgctttcatgcatgacaacatgttctaactatcaactacacactgtaggcagttgatgacatgtaaaagtccctgcagttgctgacatatatatcctcacttgattctcattccctattacatttgaattaagagtgctctgtgctcatactgggtttcttcctgggagcaaaacaatacaaatacctgggcatcgaccaccccagcgcaaacccatcacaattataccccccacctctgtatttaaaatgatttggtttgcgcctcggtggactgagccttgtcagttgtcactttggtcctgtttggaagattagcccagggctaattttgagagctaatatttagtcttgaattggtaggctaatgtagggtgacatgtttggatccttagactaatttggggctaaaaggtggaaagagagaagagagagggagatagggctgctttttgatggtctccatagaaaattagctccattagcaccccttggaggggctaatgttttgaggggggctaattcactttagctccaaactagcccacctgtttagatcctttagggctaattcagggctaataattagcccatggaaccaaacaggacctttgtcagcctcataaaaatatatagtacaaaaaaacgaaatttctaaacaacaattgactacaataagagaattgttcactcaatttttttgaacagcaatccaacaatgacgtagtcgatttttttcctctattataagaaataaaaacctgacggaaataatgaactaaaacagctgagtttcccttcatgcatggaacttaatacatattatgggtcaacttgtcattggtcaaaaatcgactgatgttcgagatgaaataaaaatagccgagtaacatctaaatgctccaacaacattttttttttgacaagagctcccacaacattttagaaaaagagcgagagaagaaatgcacatatgttagaaaaaacaataaagttgtatcatgaagacaaaatataaatgcatgtgctaatttcctgtaatccgaaacaaactcagaagaccgaaagtgtccaaggaaaaacagtatgcatttcaagtaacgaatatcttgcctagcagatccacatatgatgatatgcaaacaccatgttctatttaattatcgtaacatcaacctagaggactataattcccctaagtaaactgctccagattcctagacagtcaagaatgacagcacagtccaggggtccttgattagaaacacgaaaaacacttcagcttgaattaaaagagaaattgatataaccgcattgcagcatactagtggatgggaaatctggagaaacattgttcataatttcatatagacaggaacttaaaacacccccacaaccaagagtgcgaaagcaactaaaaatccacttgttcacataggtacatgaaaacaaattaagtatgcataagtttttctactataaaaatcagtgcttcatacattaagactcagtaggatcggggttgatatgcagcagttcattcaggaggaaataaccatgtcgaattcatcagtcttccatctggtgtctaaattttgtcctctgacatgtctgcagtaattggtgtcattgtaccatctttcatgttgtacacagatttatcaaaagagcggtcatgcataaaatagataagataatctttgactacatcataatgagataaacgaaaagacttgctgctgagttggctgataaagttgcagtcgccatccaagctcttgatctcagtgaatgtggcagggtttgtgctgcagtccacctcatatactctaatctcaataatgttgtgcccaaattcaccaaagtatgtcacaactatcagtagtttcccgcgccactctactatgctccaagtctcattagcggtacccatgaccccaggcagtttgatcacacaagactcaacacgagaaaccatcaagccattgtcatcttcacagatctcaaagactaagaggttagtggtgaatttgccgaaactgagcatgtggaggttcccttggcatggcagaagacaatatcaatggacctaatgatagtatcaccatcacacacgctccacgacttcatcccaggccgccagagagcaagcttaactgcatccttgaccatggaggtggcggccacaacacacttggagccagagtcaggcgacgaggacaagacgaccttccagaacaacatcacgcacttcgctgcgttgatcgtgcaatgcaagacaccagagccattgatgatggggagagacctagtgtaggcatcagcggagcgggaggctcccgaaggtagcgggagtcggataacatcccgggagaaactgttcatcaagaaacgccggcggtcaccgaagtagcgacctttgttggccttgacgccaacgagccatccctcgaacgagcccacgcagcagacgctgccaccagccgccatctccctctccctctccggcagcgggacacggccacgcactcccatgatggtctctcctgcgcagaagctggagaaggagaagtcggccatcacgagcaggggcagcggcggcggcgaccgctggtggaggacgcgccacgcgcggcagacggagcgcagcctggcccggtcctcgacgagggggaggcagccgacaacgaggccgaggatgtccgccgggaggtccgcccacggccggcctcgcgcgtcgtcgagccatggcgcctcagaagccaggacgcattccgtcgaacaccttgcctacgccaccgctgtcagcggccgcgacacctcgacgccatcctcactgacgcggacaggcaggggcgcgttcgggctctgatcagccggggttcctgtcgcggcgtccatggccgccggacagtgttgtggcgccaggggctactctcgcctcggggagaacagcgcctggagctctcacgtacggggtcggcacggaggcggcggcggcgtcgatcagcttggcgaggtgcctatctccatcgagcagccgctcgcatcgcgcgggaggaatgagggcatgagggcggcgtcgctcaggggaatcgcgcagtcgcgtcgcacctcgcggagtcgagtcgcggtcgttgcagcggcaatcaggattcggctactttactataggacttacagatttatatatgaatatatgtcaaatataaaaattaggatcgttttatattaagatattataagagttatataagaaataattatttagcatgtttatatgttataatttgtagatggtatcccagtttagtagtctttctagcatagaaatgacaaaatatagtgttgtaaaaatgaccaatgtgcctttatgttaatcatttcaatgcttaaaatttgacacaaaactagtattacgcctaccattacatgtctgcaacaaacatggagaaaaaaattaataaaactattcatgctagtggctcacctactagctgcccacgacatggacaatgacttaaattcccagcgacaagtaaacagggatggagggagtagtctagttgcaattaagttttactacgtactaataattatcatgctagtatatgttaagtttttgtgtgttagtaggttgatgtgccatgcttgcatactaataattgcgatgcttacattttgtttaatgtgtggtagtaatgggttttgctcatgtgttgtgatgagctatacttgcatccagccccatgggtgagtttttagttcccatctccgatccgcttaaggttgttttagttgcttatctccttagacccagctctcttcttcaactccaaatttcaacatcctcatttttcgtaagtacgttttttaaattgttaaatgatacgtattttgcagcaaatttctatatagaatttgttttttcaagtttataataattaatacttaattaattatgtgctaataggctttgcgtttcgcgtgagctgtaaatcttcctctaccgctatgcaaagaacgcagccttagtctagcccatctttttcgtccaggctgaggttgggcacgataaggagatatgtttggttccttgtgctccctctattctaagatataaaatacaatcattttttatgtgtcataatataaacgtatatgcatctatatatttaccatcaagcacctcaattatattgcacgcattcatcgatatgatctaaccgataaggtgattaaattatttatttgtattcatgttggtagtgtttatgccttatattttagaatgaaaggagtattggtttagcgtgactagtatgagattttgtttgattacttacatatgagatacacatatgagatacggtttgaaatatattttgtttgattgattgtatggatttgaatgtactagttaggtgatatcacctctaacaaaaaaaaaatcagatttaactataacgtgatagttaggtgatatcacctctaaaaaaaatcagatttaactatcacgtgcaaagaacaataatatatattggtgttcaggatcggtgaaaaaaaaaagaaattagcacaaatatgatcggtctatagtaactatccttagaggactgttttcttttgcctctgaacagtcaagcttacaaggagtatctcaaattggaacatgaggtctctcttctcaatttggacgagggcaagggagatgaatggagctacatatggaattctactagatatactgctaagagattttacaagcttatattcatgtctttgcagacgccaaggccttatgtttggatttggaaaacacgtagtgttatgaaaattaaggtctttgcatgacttctttttagcgacaggttgaacactagagatatgcttaatcatcggcattgtgcaaaggaggatgatgatcttacatgtgtacttcgtacaaatggtcatagggaaataagaggacatcttttcttcttttgtcctttcagtcagagatgttgacggcacctaggcattctttgggatcctaatctcaatttctttcaaatggttgtggtagcgtgactgcgtttccggcaaaagggcttcttggaaatttctttattgctgcccggcatatttagaaagaaagaaatggaaagatatttcagaacaagaattcttcctttgaggcctggagaattttgttcaagaaagaaggtcttctgcatatgtgcggaatgaaagatcatttaaagtaaagagtttttgattggttataaccattataatattttcagtgctctctttgtaattatcttttgtaaatacttttccttttaatgaaaatcacactgcgagacaaagttctagcagtaatttaaattaaaaaaaactatcctatagttgtcataccactaagccaattgtgtcactgttatccaaaccttactaacaaaaactgcatgaactaccacgcatgaccgtgcaaatagaggtttcttcggtttcaggagaaggcttggtttttattttgaaccgcttatgtgttcggtttatatctcacataaactgaacttccgataaaaccggagacgttgttcttgtggatggagcatgcaacatttcgcatcttgtcgcgtactatagctgatgctagctgcacttaaaggatgcgcggccgcattttggtggagcgcccggtacattcacaagcccattgtgtatataatatccttatgaggtctatgctgacaacggcctaacaacccaacacgtaaaaccacatctttgtgttggaattaatatgtgggttaagacctatatggagattaatttttgaaatcaccaaagcccactgtttgagaaacaagaactggggtcctcattcctccgaggccctaggacactgtgggcccacaagatcactttctcttacatatagaggtcagaaaccacggaagtggaaaatgacaaatggtgtggagcaggaaccaaggcccctatagaactggggctgggggtatcgacgccctataaggtttacatctacaaagtctcaagaagagtattgagacatacaagatcgacatattcaaggtactggagtagatgcatctggatattggcatatcgtccaaggtcatgtccatcatgaactccttcatcaatgaaatcctcgagaaacatgtcaaagttaacaagacatctcatcaagcagcatgggagtgtgcaaggccccaggagtacatgtgggccctaggcgcggatcgtgctccgggagtacagtctgccctggggatacagcggttcatggcacagatattgccacaaagtaagacttaggcgtatcattatcatcttaaaaggcgagctttggcggtgcttgttgcttgggcgctcaacctgaggactccgttggcaacgctcgctgccccgggcttagcctagcccaggatctcctcccagcgttctacgcagggtggtgggcccggtgattggacggcgagcgatggcattaagccgtagcagagcaacatccagagaattacaacttgagattacaggtcaattacatgcaagaaggaggtggaaagacatgaagtaatcaagctagccacgtcacccaaaggaacaagggcatagtgacatgtacatgactttgccgtgaagtaataaggtgggcggccaatccaccatgccctcatctgggcccaccatgctcggtttcagaataggtggtgcaagaagccttctctagctatcctaggccccttgctaagccttttcggggcacaaagcgtagccccgatcaacagcaatgatcacgttcaaactaatgtgacaggggaacgatgacaagaccaagcatagtgccatagtcacttccccgtgcaagaatgtaattgtaggctccccttagggtataaaaggaggagtcaggttactttgaagaggattggatgtttgaaagaactaagcttgaatagaactttgtatcacattcatcacacaaagtcccaaacacgagaatatgttgttacgcttccaagtggtccgaacctatatatttgattgtgttctttgtttaccgcacgaacaagctcgatctaaactcaccccccggctgaatatctcaacagggagtacttgttcccagctagaggagatccactctttgacaccctcctcatgggaaggcatgcttatgaaccttcaataccacctttgcttattctaaaagattgagacctccttaaataggagagtgctctcctagccacttgagacatgtataatggagagaactagagggacacacatgcacttgcttgcctcgccaggctcggcacgggccagatcggacgcggagggctcctcatgcttgtgcaaacgtggtttccttttgctgtagaattcagtttggtttttggaaacacatcgaataatttgatgcatggagcggcgtggagtttggataagatatgcgcgatttatccagtttgattacgccatgtggagatcttgcaagtgtcctgatcacgcgttctgatatctctatataaaccgtccgccgccgcctcacaacatacacaaaattaatctagggtttgcctcctcctctgtaccgtgccgtcactcgtagtctactccgtcttgcttgtcggcatgcactggcgatcgggagagcagatctccagaacctttgccctcaacgtcctgcactgagagaaggcgacaataaggtttttggcaagtgcttcacgcgacggcttgctggtcttccacgatggctcatcttcctctacgcttgagggttgcgcgatgatgacaacacccagcaccacgcgttgttcctatgatgcgtgctactctttgtcaatccgatccacagcagaagcaaaaccctcggtacgtgttcaccatattccatttatttgacctgttcatgatttacagcctggtttacatatatgtatcacatgatgtggttgtactagtttacatgcttcatatcatttgatggaatatggtgatacatgatattaaatcaatatgcttatagttcaatataagcatatattgatttaatatcatgtatcaatgtatgcttatattttcaaaactttgtagagtactccgccggtttcttcggtagaaaccgacaccgaacccaaatagtgtggttttccttggcttggcttcctaatttgttactaatgaaatcggttagtgtttataaaaagccgaacatgcacaaaatagtacaaatcgaaacgaataaaccaaacaatcattcctaattccgacaacttgctctgtagcagcaatggagggaggagggtgggtggtgccaacacgtcaggctgaattgttatttccgtgctactctctctgtcccataaaaaataaatctagaatatgatgtgattctaggttcagattcatagtaatgtatcacatcttgctctatgtttgttttttttcggacggatggattatttgggagtgacgctggcaaaaaaaaaacaccaaagttcatatataagcccggtccacatcgcttaaaaagaattagtattccctcccatcattaatatatgacgttagtgtaaaaaccgtcatataatgaccaaaatagaattagtaccatatgttcgtgaatgaatctgccgtgcaatgcaacgacacgcggtccacttgtattgcacagcccgtccccgcggcccgcggtgatggatgatggtctattggtctggtccccaagccccgcgtccccaacgcgttcttcgtccggttcgccgtcccccgtcacgcattcattcccactcccaataatcatcctccctgtttctcttttataaaaaaaataataataatcatcctccgctccgcgacgctcgcgcccacggggaagccaaacccagccactttccccgtctccttcctcccctactccggcgccctcccctccttatccatccgcacccacctcctccatcctgctataaaccaaccccaagatttgtcaccctccggtaggtagtaccactccaatcccaatccaagcctgaatcctcttttgatgtgatggcagtggagcgcggcgagcgccgtggcggcggcattgggtgcctctcctgctgcttcggcggcggggacggggacggggaaggagaggagctggggcagcgcgcggcgagggcgctgcggacgtcgtcgcggtgggtgcgggaccgcgccgtggagctgccggagatggtggcgctggccggggggcggcggaggaagccgcatctgcagcatcatcagcagcagcagctggccggggagttccgctacgaccccgtcagctacgcgctcaacttcgaggaggacggcgacggcgaggcccagccgttcaagtacatggccttctccgcgcggctgccggcgtccccgccgccgccgccgccgccgacggcgctgcccgtcgaccggggttcttgaattgattgttaggccgttcggatgtacatacgtacgggagattaaagtttgggtttctttctcttttttttttgttgtttgattccttcgatttttgttggcgactacgagcgctgatatgtgtacaggaggatttgaatcgtttcttcttttggtttttttaagcagagatttccttttctattacaagttatcttggctctgaagaacgttgtttttttgttttagtgctagtatatgcttctgagaagaatgttgtttattggggtagcaaaatctcaagccattgccttgttctttgaaaatactaagttatccatgtgttatattgccagcacctggaccaatagattcggtagattcatatttaaaagagttttagtatctaacatatgttcacatgcttcagctgtcagaatcacacaacctactgcaactgaaactacagagtacagactacagtttgtatacagatttaaactacaggttgtatacagatttaaagaaggctttaaagaatcacagcatacggttagatgacaaacaaaccattagcacatgattaattaaatataattattaaaaaatatatgtttctttgattttaaaataaattttatataatatattaaaaaatacagtttaatggtttaaaaaacataatgtaaacgaaaaggttgcaaaacccagactctaacgaactcggctcatgtcatcccagctctaaagtaggcaaaagaagcccaacccacagctcactagcccagaagcaatcagaatagaagggtcactcaacattatttatgtttggaaaaagtatactttggctccctcaactatcgcccgagtacgactcatgtcctccaaccacaaaaccgggtatatcgattcctccaactattaaaactggtgcagacaatatccctcggtggttttcgaggtggtcctacatggcggtcttgaccaagtctttgtcctacgtggctcttacttggcattagaataaaaacaaaaaaaaaatgtgggacccatatatcattcacacaaaaaaaaaaatgtgggacccacatgtcatcctccctctccttccctacttcctccccctctctcccttctctctctccccctgtcctttctcttggccggagcggctgcggggatggcagtggcgagcggcggcggcggcggtcgggacgatggcggtgggagcggcggcggcggtgatgggaatgaggatggcggcaaccaaggagtgcgacgtagcggcagcgtcactggccgagttccacgcgtcgcccgccggtgtctgcggcctcgtcgagtctggcgccaccgccgtgccaccgtcgtgccaccgctcttcctttcgccaggctacggccgtgcgcgctcgccgccacctccaccgctgcgaccgacggccttcgacagcagcggcggcggctgttggatggggatggtggagtaggtgacgcctcctacgggtgctagcgagtaacacagcgagcgggaggcgatggggggctgcagg

SEQ ID NO: 73207 - DNA, 7498 bp, Oryza sativa
agtggtttgttctttatatcagtccatccatcagacacaatagaaacaccttgtgtgcacctgcttgatgcaaaaataaagaagtgatagtcaataactcaatattcagttaaaaggttaataaatttgcacctatacaaggatgaaaaaggttagcaactgaaaattaccatgtacttttgactattgccaaatcatgttctacgcttcttttgcatgcatctagcagagttgtccttgccttctcagaggatggacctttgtatccactgggagctttgttaatggctgtgaccatttcagcaaattgtgggcttctcaatatattaaacggaatgccgttagcacataaaaatttaactattttcatatctgcatcatgtcttttcccttctccaaagcaatcagccaacggattgccctgcctagtaccaactgatttcgaaccatctccattttgttcagcttttttaacctactcaaatgacaaggatgccaaaataagacacatttctacttgctaagaaagttgaagagtaaagggttaaaggaatacttttgtaccttatcccgcagagctttgcacttgataggatcttttagtagcgcaacacagcgtgctacctctgcttttttgccaggtggaggcccaagcaaatgaatacgaattctcgttaagctacccttcaatttcttctggcaatgcttacactgccactgttttgttccactgtcgttctttccttttggtgccttaacgacagttacttcatcgtaaagagggtttacagtaccactctttttagatgatcctgcatcttcttcctcggagccatcagccccaagttcatcgttcgtgttactgtcatcttcgtggacgacaacgtctgcatcagctcctcctacatcttcatgtgctgcgatctcagatcgcctgcgtttcttggaaccagatccaaatgccattgtatctacagatggtttgtatgaagattggagaccttatatttttctaaactgaaacacggtacctgggttgagtttgccggcggccggcctgacgtcgtgagcgcggctgagcgcttgacagcttgaaccctggactggatcagcagcagcaaacaggaatgcagtaatgcttgatctcctttgaggtgactcttcctgtgaccaacaagctctcctattaatatagtgcttaaggtgacgcctcgtatttcaattatttcttggtttcagtccacagtccacactcatattaagagcaaggtcaatagtgtagccagctactagctccaataatatccatgtcattttatagccaatatcaaaactaactagtacaataggttggctattatatcaacatgatctcattattcaaacaataaactttacatgtgcatgatcagaaacgccctcaactctgtggcctatatggccatttgtattatgcaataaacatgggttatctactactctacctgaaaaaataacgacaacacacttgataattcacatagtatatcacaatccactgccgtccaactgcataatctataatctatacatgaaaaaaggagaagaacaaaagggaaaataaaaggagctataggaagagattagaacggactagatgcaacagatgagacgaagaatcggtagaacagacatagacgacaagcattcaacagaccgagggagaagaaaagaaaagaattagaccaagccaattcaaatcaagaagttgcttgttgctttgggtgccagctgcatgcccgcaccaagcgcttctcaatcctcctctcgctttctttgcagctgagaactgggattactaactttttgggtgcactggagctttcacggcagagtttcacgtcgcgggagaaaattccggcgagacaggggtgaggggaggcggcgtgaagcagagcaaaatgcgtcgggcggatcggaagaggcacatcagaaacaaaacgatacacgggatcggcggggtggctgcgggacccacaaatgcatgtgtatctgtgtatcgcccggcgctacatctagcgcccgctctgttccctctctctagttatctctcctccacgtaagaatagtctgagttggaatattttggagcctgctgattaggcttattgtacttgctctaatgaccaagtctaggaaactgaaaatacgaagagacaccatcttgtgatcctgtcacgttctcaacaacatagaacattagcacgtacagatattggattattgaaccatatttacatcattttatagtttgcattctttgagtcatactgtgcgtagtggtgcacaatgacggatccagaaaaatcgattcgttggtgtctatcagtgtcatagtgtgctaatctggggatgcgggtggcaatctgggccgtacgatccggtgatccgacggtttggtttcgctataggttttaccgaaagtcgttgatgtcactatatatagtttgcattctccgagtcctagtgtgcatagtggtgcgttcgaacgttgacgttaggaatttatcgatggttttcatctcttagagtgtgttatagatgccactaccgctgatgtatagatgtgttactcaggtatagtggagcatgatcggttaatgttcacatcgaacatagcctatcatgtactccctccgtccaataaaagggcaacttagaattggatgttgacacatcttaccattgtccaatattagatgtgtcaacatccaatactatgttggttttttataggacggatggagtacacagtgaggctagagatttgccattgattgttgccagctcgagcgtgttacaaaacacattcgctgatatatgcatgagttcgtgagatttgggtgatgggatatggtcgccacattttgtatggtgtttggttcatggtaaaggtggaatatggccgcccacataaaaatattctataaagatgttggataaggctatcccatgattcctatccaaccttatcctccaagtaaatgggtatattcacggatatatacacatgaccttttttttttattctaaagcacaatacaaatgtagttgaccacaacactcacaccttatttttatgagcatctccggaagattgggctagtatatatcttgatattgaagaagtaacaacgggcgttttgctgtcataccttgagaaaaatttgccataaatactatttttttatcattttctttattaacatagttctttgtttacttaaaaagtattattttacaacaatattaagtaaaacttgttataatatcataaaaaataaaaaaactaaaggtttaaccaaaaattgttaaaaaataatttacacgtttctatttaagttatttaagtaacatacacatttcactcaaggtgtagttgttagcacactggtcatggcgcctcataggcgaagacgacgtcgcgtggtcgaccctctggttcttttttttttgccattcatgtgacagcagaccatttttttttttttgccattcatgtgacagcagatttttttgccattcatgtgacagcagaccagcctagaaaatttttgggccatgcgtgcaaacaagcccatcaagagaacgtaaaagtgagccctagcacttcgttcgtcctcaactcctcgtcagtggtccctatcccccagccaccgccgccgtctcctgtagtccaagtctccaataccacaagctcgatgcaacgacgacggctgcgcgatggcttcatcagccgtggcgccatctgtggagaaaagcggttgtggcgcgccgcgccgccgctcgctggccggccggcgcccctctatttctccaacggtccactccaacctagctgcgtgatggagggagaaacgcggctgcggcagcggcgcgcggcgcgccgcttgccagcgcccttctatttctccaacggtccaacctcccatgttcgacggcggcggcgagcagcgaaggaacaactgcgctgctcgccctgtctccaccaatgtagatccgggtgagtctccactctccactagcttttgctcaacatacctcgttcctccatcgtaccacccttctcgttcctccattgacgtaccaagtgttgggtcgacgatccttccgtttttggaacgaagttccgcttcgttcccgttcctcgtttcgagacgaaattcccggaacgtagaacgcacccacgttccgcgtttcctgtgacttagaccggctccaccagtaagatgtccttaatttctcattagccgatcatagtcgatattatcttacacttatctttttgtagcctcttcctcctccctctcctgttcagcaaccaccaaacaatcaaactccatcggctgcagggagtcaccatgttgaggaagaagtacaaccagctgctcctgctatcccagtaagtctcttttaaacaccaagtcttggatcggctatatctgtttgacatctaactgtcttcaaatttctctattgtaggccttagccgatctgttctctttagatattaaagattactttgatgagacagaagaagaaaccacgagcaaggctctagcccccttggatgacactgtcaagaaaacacttgaagacatatccattcggctagaatcttcattggataatctggtggctgattgtggtttgatccgggcacgatttgctgaaatccaagcctcaattccggacgatctggcaaacaccattactccagccgtgtaccttgagcaacaccaattcaagctggagaaggccaagcaacggatagccgattggcgagaacagaaggacattgaagccactatccaagccaatcggcagcttgtgcatgaagagaaggctaagttagatcaactctctgttgggcctattcagtcgaatatagatcggcttgaagctcgcaagattgatttaatagctcaactcgaggaatgcaacgccgagctggatcttgaaaaacaaaagctagccgatcttccaaatgttgttgaagaacagaagtccagattgagatcggctatcaagaacgtggctgacatgactaagtctctcaaggtcatccccggaaccgacgcccaagacatccaggccatcgaagaaatagatcaaatcaggcaatgagctttgtcggctatccaacgctatctgtgtaatagatcttaggaattttttgtaatcggcgaagaaactctgactctttatgtaactcatcttaataacttttatgccgattcaatataactccatattttgctcaaaaatttttgcaacttttgcatatatgtgcccccctaattttacaatgtcgaaagcatttataaaattataatatgaactaagggcgatataacaatatcggctattgtacatcagcaaaccacaaccgattacaatagaaagacaactaagggcgatataacaatatcggccatctcaaagcgatgtaaacacatcagctatcatgtatcggcaacaccagccaatcatgcattaacccaaacacttgggtaatatttcttcaggtacttgccatttagcgctcgtccatagacttctccatcgagtccttgcaacatgtaagctcccttagacacaaccttatagatttggaacggtccttcctaattcggcgaccacttgccgaatttgttatcccgagtcccaatcggcaaaatcaacttccatacaagttcaccttccgaaaaagtcttggacaccaccttcttgttgtaatgccgagcaactcgttctttatccttggtaaccttcgcaagggctcttaatctagattgaaccaagtcttccctttcatcggccatgagatgataatattcatcggctgtcaaatcattttgtaactccgttctccttgagccaattctaacctcccatggtaaaacagcttcatgttcataaacaagcttataaggagggacttggatcgatccatgacaagccatccgataagaccacaatgcttcggccaatcgagtatgccactgccgaggataatcagaaatctttctcttaatcaatttgatcaaactcttgttagatgcctcggcctgtccattagcttgtgcataatatggtgaagaagtcaacaatttgatacccatgctatcggcaaactgaacaaactcatcggacacgaagattgaaccttgatcggttgtaatggtttgaggaatcccaaatcgatagattatatgctcttgaacaaattgtatagcatcccccgaatcaactttctttaaaggaattgcttccacccacttggtaaaataatcggtcgctaccaatataaacttatgccctttactcgatggtggattaatcatactgatcatatcaattccccaacctctaaacggccatggtttaatgataggattcatagccgatgccggtgctctctgaattgctccaaatttctgacaatcttggcaccccttgtaatgtttgaaacaatcttccagcattgtcggccaaaaataccccgcacgttgaagcaaccacttcatcttatgagccgattgatgagtaccacaaattccttcgtgaacctccccgattgcaaccttagcttgatcggcactaaaacacttaagcaacaccccatcaatcatccgataatagagctcatcatccaacaaagtatacttcaacgctttgtaacgcaattttcgagaagccgattgagatggattatgtaaatattgatgtacatcatatctccaatcatcggctgttaatgcagcaacctcaaccttgacatctttgatcatcggcttatatctcgacgccccttgggccaaatcattagcttcaatattttgctctcgagatacatgcctcaaagtaaccagccgaaattccttcattagctctcggcacttctcattataaaccattaatgtatcatttttgcactcatattcccctgccaattgactgatcactagcaaagaatctcccataatttcaatagcatcggcttcaacttccttgaataattgcaaccctttgagaactgcttcatactcagtctgattattagttgcataaggtttaatagtataggcaaactcaaaacttgccccccgaggggaaattataaccaagccgataccacaaccataagaggatattgacccatcaaagaacaaagtccatgggacaacctcaaccgagccgattgaatcatcatgatggtcaacaataaaatcggctatagcttgccctttgactgccttcggtgactcataccgaagatcaaactccgttaaggaaaatatccactttccaacccttcctttcaaaattggagccgataacatgtacttgacgacatcggctttgcatatgacagtgcattcgttggacaatagataatgcctcaaccttgtacatgacaaatataagcagcagccacttataccagggggatcca

SEQ ID NO: 73208 - DNA, 2314 bp, Oryza sativa
cttctgcttcttgggcttggcgctgttcttctgtctcgttgtcgcccatgaaaatgccgaagtagagaggtgtgtagttatcttcgtagccttcatcgaagtcgtcgaggttgcggtggtcgtagcggtagccgaagtcgtcgtactctacgatctctgtcggtcgagagtcgacaccgggggagctaaggtagccgtccaattgttccgtcgaaaccgtgccgagaggctggagtatgatgccgacttccctagagctagactggatcggggccgaggtcgggtcccgcctaggcctacggggagaagacgcccttatggtgaagatggcagccaagtcatcggggagtttcatcaggattggaggataggcgccatcgtcttgatcgggtcatgttggagtagattggatctcgtccgagtggtttggggccggctcggttgtgatgatcctggagtagatctcggccgacttcgggataccgaacggggcggagacctggcctctccccgactgtttcggatctgagccgaggagagaaatcttgccgaagtcgttggtgacaaagtcgaggctgccaaaccggaacgcctgcccgggagggaagacgaagtcgtcgatgccggagatgaaacccatcgcactagtcggcgaagaacttgacgctacccctacctggcacgccaactgtcgaaacgagatttcggcaatactaaaagggggtggctatcaagctggaaaagtggatgggttgagagacaaggaattttatacaggttcatgccttcttaataagaagtaataccctactcctgtccggggattgatccgccgagtatgttattgaccgtatgatctgggagaaaatcgtgcccttagaggcacccggacccctccttatataggggaggggtccgtattacaaagtacaatccatatccctaacggaataggtagttacagataagttacaatcgtaaccgactaggatcccggatatttccttgacatacaagtttgaaatttaatccgagtccctttaaaagatattctatctacagatggcaccccatacccagtcagactatatatgccgtgtgggtatggggtatccataatctctatacatacctcaagatatggagctcattgtactgaaaaaggcaatttgatattggctgtataggggcagagatttgcagtccatactgactactgaaacttaagagtgcctctagaattccgcagcaatgttgggtgagtaaattgtagggcatggctaccagaatgaagatgttgacatactgtcccagcactatttcgaacaggtccaacgccatgtcatccaatgtgtacataatactatacacatgcaaaaagagggcctaaggcaccacgggcatcttttatggaagtattctccctacatgtcacactctcagaatcgcttaatttaataattcattctttaatgcattttttagaaattattttaaaaacctacaagataaaccctaataaaaactagcaaaatcgcacataaaattgagatagatacaattttattaaatactttgcttgtttatctatttcctggatttttatgtgaattatttgagcaagggaagtatttttattaaatgaaatagcatttcacgaattattttaattaggaaaatttttaaaatcctatcctaatctgttgggcccttttccggcccaactcttcccctcgcgcgcgcgagccacgcggccctgccggcccaggccaagccgcccctccccctctctctaagccgccgacatctggggcccacatgtcggggccatcccctacctccggccagtcaagccgagcccgaccaccaccacctccccaccaaatccgccgctggtcgtcgctcccgagttcgattggatgagggaaatttatcccctcatcgtcctcttccttttcccctaagaatcggagccgaatttcgtgtagtttatccaaatcgaattcgaattcgagtttatctctccacctaaccctatagttttacggctttgattcctctcggtgtgggatcgatctcgagcttccgtgcctatgtaaatgatccccttgtcgtcctctaccattgccctgaagccacgtcctccgccgtggtccatagcacagccgccgcgtccgtcctagtggtcgccgcaagcctagccgccccacgccaccgttgtggtcgccgccgccgctcactattgtcgccaatcggttcgccgagtggagccgcacccccgccgcttcttcgtttgcggcgagacccgccggaa

SEQ ID NO: 73209 - DNA, 502 bp, Oryza sativa
tggtgggccccacccgtcagcaagggtggcggacgggcccgcccgtcagcggcgcgcgcgcgggtatagtccgagtggcccgcggggagaggagagagggggaggtagatgggccgaaccggcccaagagggggagggagggaaaggggacctttagggtttttttctttttataaaaccattttaactttgtttatttcttaataattattatttgtgctctgaaaattccactaaaatttatttacgcattttaggcttttaggaaatatacaaaattcctccaagccttatttgacttttaactttgcacattttaatttttggaggctttcacacagattttaattattctaggtataatttagaggatgcattttagagtcgttttgggacgtgacaatctgcacgttcacggctggttcacctcccgccctactcgatctcatcatgggcagatctgtggcaacagtttatcaccaacttccaaggtacatacaag

SEQ ID NO: 73210 - DNA, 529 bp, Oryza sativa
tagaatcttttcttatatctgcaagccctacattggggtagagcccttccttgatctctaccgcttttactatgacttgcgtcggatggaacccaacagtgtatctggatgtgtcggattccgacttcgggattgcctgaagtcgcgttacatccccttccagtgcccctcttcttgcagcaaatggcgggcgagatggttctatcttcagatagaaaactcggatcccgtccttgttgtccctgaagaacaactagacaaaatcccagagtggactgccaaacccgccctgactccctctctccggtctttcatcgacatcatcgatgacctctgaacacaggggttgccagggtacgaagtcgttgccgactttgtaggtaggcggatccaaccgctccaggcctgcgcccatccagcctttgactactctgtgccagaggacgcgatccgagtttctcctcggggtattttttcttgtatttcgaattttactccgagtgcgtctgtttctcctgacttaccgagt

SEQ ID NO: 73211 - DNA, 12446 bp, Oryza sativa
cacgaatcttcgagaaaaccacgatcaacgaaaatccggtaaccgcaactatacgcaaacaattaaaaacctacacaagacccaaaataaagatcctatttagactaaataatagtgccattagatagatctcaattttatggaattactggaagtggaacgagatcattcggagttacggatcaagagatatgaattttggcaggtcaattggttttctggacaaggaaatgatttatcggaatttttctggaatacgagaaatggtttatggaatttatagaataatattcccaagaatattattgacatttcaatggcatttgggaccaagggaatgaattattggaatccctggattaagaggaaggatttatggaatttggaataaagaattgatttatggaacaagggaaaaatgatttattgagttttctggattaaagaaatgatttattgaatttgtggaaaagaatactcccaagaatattctttaatctctcatagacatgtggggccaatcaaagggtgagggagaggagcaagttggggggggagcaaacatggactttagcttatgactgtggtctcagggtttaggggagggagtacatataaactttgcctgcttttaagaggccgaggaggggatgggccgatgggccaagctcataagcacgggagagagaggaggaggctgactaggtggctgacagggcaggcgtggacttggtcaagcccatgtggactgccatgcaagcgcgagagagagggaggcctggctcgcccagatcggacggctcacggcggccgaggggcaccggcgaacggcggcgaatcggagtgaggcgcggacaccggtggcgagaggaggagatggggaatcggctcaccggcacggattagagagaggagacacgacggcggccggcggtggcggcgaagctcgccggatgtccgacgtggatgcgcgagggaagggccaagaacgcgcggggtcgagcttagccgaaacgattcggcattgcgacgcacacgcgacggcacggagaccgatggttgccggacttgggctcgcggcggagctccgcggcggcggaagggggagagaggagtggagtggccaaggcgatgtcccagggaggcttctagggacacggggagggtgatggcgatgggattcgacgagcggggagccgacagcgacgcacgactgtctgcggcggcggcggaagcagagcatcggcaggggcgcgatttggaggacgaacgcacaaactaccatgtctcagtgctgtttaggagtcgctagaggatgcagacgagaggatttggaccaggagctcaccgacgagcgggaacggcgtcggcaaacggatggcgtcgcggcgagacagtcgcgacggcggggcggcacgacaccgagagggcgcggccggggaacaagaggggagtggtggcgcccggagctcctcgtcatgtgcccacgcacgcaccggttcctccggtgctcggcggcggacggcgacgatgagatcaggtcgagcggcgacaaggcggtgacggtggttcggcggcaatggcgcggtgggtacgaggcgagtgaaaacgagagaggaagggatttggggcggcttgggttttatagtggaggaatgtcggtttgggagggggaaccgacatagagcggtcgagcgctcggccggcggtcacgggcgatgcaagagcggcggacgccgaggatgcaaggagcggcgaaggcggtggatcgggcggctgaaatcgaaccacgggagcgcaggctggcgcggtcaaggtgggggcggcgagctggcgtgcggcgtcagcggtgctctgcctcagcgcgcagagtgacaagggtggagagagaggggtcgagcccgagggaaaaaaggaaaaggggagggtggaaaggaggggttcgaccatgctgctttggggagggagagaaggaggagggcgagctctggctccgtgttttggacgcgagcgcacaggggggggtggggacgacgcggcaacagggcacgggcggcgaccgagcggcatggcgcgcgcgcacggagcggctgggcgtggccgaatttcgaatggcggcggcgggaagtcagcgccggtgggggagcttctacgggagagagagagaaacggagagagagagagagagggagcgaggatgagaagagagtgggcgatctctctctcgagcgcggcgcacgcgcaacacacgtgcggagagaggggaggggaggaacggctgagagaggagatgggccgaggggagggggatcaggcccatccaaaattagaaggaggcaaaatagacttctgcagagagatgatttggaagggatttggatttggaatgaaatttcgaatatgattacttggactcggggaaacagggaggagtcaaggaatggattcaaggtggactcggtatttttggaatcgggacaagtgtttggcgaggattcaaaggaggcgattgaatttcggaatttgatttcggagacttgaattggaagaggaatttcgatgaggatgattttgatggcgacgagagggatcaaggacggatttaaactgagatccacggcacgacttagactcagcactcaaagaacgaaattttcgcaattaggattttgccgaattagtttttaacgcctcacgaaaagcggagcgttacaactgggtagtggtagttgcccaccacggcggtcgttggtgagaatcgcccacggtagcttccgcaacacctcctacgtgaccatggccatgactgtcaaagaaggagaggtgatgctgagccatctcaatttgaagtaaaggggaaagggatttgagggaaggcgttggagtgtcaacctttgtaaggacgacgctcgatctcctgaatttggcgctgcagctcgacctcagcgatgaggtagcacagcatgagctcgacaacgaggcggtccaacccatccctcttcctcgtccatccaatccttctctactaccacatatagtcacccctcctcttcggccaaccaccaccattgccgccttcctagacatgagttgacgagctcgagctcccaaattccctcgcctccattctctcctcctccgctacaccaatggattcccctccccgtcggccactcaccactgctgccacctcccacggaagggctagcaagcttgagctcgccagagccaccactgctgactcctcgtcaggacttgggagaaatggaggagaggagaggagaggggtcgggaaggaaccattttttttaattcttttttctaattggagtgcgacataagcaccttgtagacgccacgtcgagtgaagactggatcaatgcgtccaataggtgccacgtcaaccgaagttgttgtctatactactgagcgattcaatctgcaccagttagggactctctatttctaattctgtggttaagagatatgaatagaactcgtctcacagttgagatatctaaagtggaccttttccaattaaggtttaagaaaaaaaaacttatttgtaacgggtgtagtcccaaatttctaatggtttgtaaccagtgttacaggcgatgggttagtgcttcgagtccaaatctctaatagtttctcaactgttagagattaatatatatcaatcgagaatttttacgatgtttgcaagctacgtagagatgttgggaggtggagactattgattaatagatgggtaaggtactaaataaattaacggtttcgctattccacttacgattgatttttgagcttcagtatcgatttttcgttcgtaggttcttgcatcaagatttgtgtttaggtagatcttgcagttacagctcaacgctttcaagcttgacactatggtcgcggtttatttttataatagattggtcactgtcaattcatgaaataagtttttcaaaaggattaaattgtcaaaattttagaagcatataattctgagcccattctcactcacgcaccaactcccatacctcactaaaatcctattgcactgtcaattctttttaatattagtttgcatttaaatttttaaatcctaatggttagaagtgtgcgcctatgactctactacgagcacaccaacggtgcttatccccaaagcacaacttagatcatttttaaaaagaattatatctataattaaacaacacaagttattaaaaagagatgccataatgtcaattatagtaatatagctttcatgtgtccaattttgctgatggcaattgataaaaactttagatctctaaccccacaccaattataaagtgtggaataaaaagaatgacagtactctgatagttgtggttgtaggtgcatagctccatccattaaaggttcaaattcttgtcttcataaatataatggagggtaattataagttggtgcagagactaaaaattatattttctttgttatgaaaaaaaaaagagtttaggaaagaagcatacagctaattcggagcaatttgcactcaatatggatttgctgaaacactaaagtacagacttaccttcttcagaaaaaaacttaattaaacaattccactggcaaggttagctggttaggtaagagctggaatatctcagttactatcagtgggcgagctggtcgtacgagccggaggcaacagcgttggctgctgatttcttttcaccgctgcgttgctatcatcaagttgggctgtccaccagaccaccaccactcagcatcgcgtagccgattctgtctttgacctctgttattaatttaaattgttttttgctcccctctgaccagcacagcgtctagctacactggtttcaactttcaactcattcttttgtatacaaaaatacggcaaattttgtcatgatccgatcagagctcacgtacgtacgtacgcgcttgataacatcaccagaaattcagaattaattcagaaaggacgcacgcgtgcacagtttaggaatgtgcttcagttgcttgttcgtgtgcaagagtggacaacactatatatgttgccccgtacctttcgatcaagctgtttttaatatcccgatctggactgttgctggtgcagggcaacattttcttctatgaagatgtgacttggctgctgctgctaggggccggagaaccgagaatctgtggtttctgtactcgactggtgatttctttggcgatggttttctgtcaccaacagggagctaggtggagttttgtccttgagaggaccgctactcggtttttacatattacaaaatgttatatttttttcttaaaagaatgacaagatatttagtatattatacatctttacaaacatgtaacttcatattccatctatatgttatcttatcttaactactttaaaaaaatgataaatttccaaacatcacattgtttttcgtttgttcgtccgcttagtacgcgcgatccgattttcttagtgtactggaaaaaaatacccgtgcgttgcaacgggtgaaggctattttaatcatgttattgttatgctagaaaaatgcacgtgcttcgttatgggtaaaggaacagttaaatgctataaagtctagagttaacatgtatatagtaatgtttcaagatagataaattattcattaggctaatgataatcacgatggataaaaacacacactctctctcaacccttgtgtgacaaactgtgatatcattgcactggtaatggttaggtgaatgaaatttaacctcaatgatttatcgaagcaccttcatagttatcacaagtgcatatttgtgcttggacaattaatccgctctacgcgtgtaggatgtgaataatgtccctaacacatggtcccaatgattgtagcattggagaaacggacgtccgagcaatgcacctttacgtataagtaaataatgaatattttgggagttcattaattattttaaactacatttttatggcacttttataatcttttttcataattgataattgcaataacattgcattgatttataatcacaatgcaacagtatacagctatgctctaacctacaaaacctgaacagtgccagccgtaccatgccgttcctttttcttttgtagaaaacctcttagcgtatgattaattgagttttattattacaaaaattaagaaaaaatatctagtattttatatcaacttgtatatagaaagtttaaaaaacgcgctaacaaagaccgagatagaaggaaaggatgcatggtgtgaagtttcacaccatgcacatattcaattttcatgttttaaaaaaatatcggttggttcacgtgtttatactgatttttttatataatataattataagatttcagaatcactaaaagtctgttgaagaaagaggtgctgaacttttgatttttcatccatcggatgtgcatggtccgtgctagtggttgagagaaaaaaaaatacacgcaaatatgatttgagagagggaaggaaagtagacttattctagggcctaggtaaacatatatttatattgatttttgtgtacataatctaattatttttaattttcgaattaaaaactaattcattagaagataagatttcataataaataaaaatctgtatgatttgagagagggaaggaaagtagacttattctagggcctaggtaaacatatatttatattgatttttgtgtacataatttaattatttttaattttcgaattaaaaactaattcattataagataagatttcataataaataaaaatctgttgaaaaaagagaaaaaaaatcgaaggcaaatataatttgacatgagggaagcaaactgtgcaagtaataatagatgtacaaatgagagaaaaatgggagtcgaacccgtgtggccgaaatgaaaactttcatccctcaccaagtgggcagactactacatgtgagaagtgattacatggcaagtacatatcccgtatcaaacgtggctttggagtatgataaaaaaatgcccgatcggactgttaaccggattaaatccggatttagcgaagcgcgtggtaatgacggacgaaaaaaacacccggaaactttacatattttttaattactagcaaaaatgcccgtgcgttgcaacgggtgaaaaaattctaatgataatatacgtttttcataaataatcatgtcaatgacaatgtttgtattttaatgagcggcttgttttttacaaacggtgtttttttcttgcgcgattttctcaaaccattcagaaatgacgcatttctttctaaaagatttttctaacatgatctttttgcttttttatttacaatgaaaaccatatttttctccattttttgcttttcttttctcgtgtgttttttgcctttttttgccaattattttctcgcgtgtttttttgcttgtttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctaacagttttttccttgcatgttttatttttttaaaaaagttaccgatgatggaaataattttcctcgcgcgtttttttatttatttatggaagatggaaaacctttttagcgagtttttttcgctttttctgacttttttctcacgcgtttgtttgaaccgtttctattctctcgtgcattttttttaaaaaatagttagattatattagagatagagaagagatatatattgattagaaatttcgccctttccatttttttcctgtgtgcattttttattttatacgaacaagcgttttattttttacgaaccatttttttcgccactttcttatggaatcgaacaaacttttttagattttttttctgttttttttcgcctttataggaatccgactttttttcctgtttttaacggaatcgaatctagtatttttttttcacttttttttgccttttataggaatcagattttttttcgttcggatctacgcttttttttttgccacataggggaaacggaacttttgttgttgttgtttttcttttttttttcagctttcctttttctttttatgcacctttctgtttttggactctcttttattattatttttaacaaaaacggcctcaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttctgtttctgagagggaatcggataggagtccgacctttttttttaacttttttttttacagacgaaggaaacatcttttattattttttaagtagtacagacagagacagatatagagattttttttcgcttttttgacatggaatcagattattttttcgccctttttttgggatcagacatttacggttttttttctcgctcgtccgtttttttggggcggtttttttgtcgccctttttcacagaatcggacttttttttttgcccttttttattggacagttacggtttttttcgccggttttttgtcgccctttttttcacggaatcgaattatttttttcgccggacagttatggttttttttgcccggtttttttcctcgctcgcccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttcaaaggcggttaatttttttccgtgttgaatagaaataggacttttttttttgcatttttctgccctttttttaaattttatggtacgataggaataggaatcagatgattttttggggcgcttctttttttttttttgccttttttacgttttttttgccgcgtcggaatcggtctttttttgccgctttttttttctcgccgccctttttttcacccttcctattttttttcgcgctggccttttttttttttacagtcggactttttttacacggacgaaggaaacactttgtatttttaacagttccggtttttttcatccggtttttttcgacggttttttgtcgccatttttttcacagaatcgaattatttttttcgccggacagttatggttttttttggcccggtttttttcctcgctcgccctgttttggtttttttcctcgctcgcccggttttttttcgccggtttttttgacggacgatggaagcatctcttattttttaagtagtagagactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgcataattaaataaatttacaagtaaagcaagtgtgagaaataaaatgacatggttaaatttaatttttttttaaattctccatgattagttacgctctttgaaattatatttgaatttttcagagcttaattgttaattttattaatacaaacgtcatttaacaattatttacttggaaaaaagaaagaaaatacttccttttaggtttgcttcgaaatgaacacattcaataacttataattgtaatgcttctgaaaaaatgagcactaaaaagaaacttattctctttttttggcctgagggacctaaaatagacttatttccggcccttgccggtcggtccacggccttttgtgcacgcgcaagtgcacttcccatcccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagctgccgaaactctagcccatttccctccctcccatctcacatcgccgccctcccctccgcgcccccgagcggcggcgacggcgcccctcttcccgcgagcggcggcggcggcgccctcccccacaaccaacggcgcggcgccctctccccgaacaacggcggcgtggaggcggctgcggcccggcgggagcgggaggggcggcgggccggacctcgcctccgccagatctggcggcatggaagcggctgtggtccggcgagggcaggagaggcggcggcgtcgtctctttctctctctctctctgcatggtggggaggtgcggcagtggtggtggtggcggacgtcatggaacgccggtcgggcctcgcctccgccagatccgacggtgtggaggcagttgcagcccggcgggggtgggaggggcggcgggccggacctcgcctccgccagatttggcggcatggaggcggctgcggtccgacgggggcgggagaggtggcggcgtcgtctctttctctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtagtagtagattaggtatatatatatagaggtatagattttgtcatcgcgctcatgtacgtctagaagtctaggtccgtccggagtaggccatgagtccagctccgtccacaagcccaacctacgtcctggagtgcagatctgtctacgtcgtctcctactccgctctttttcacgggattttacagatatcacttgctaggcaaaatatacaaatatgggcgcatgcaagccaaacattacatatcggaacatacaaatagtagaaacacacaagaaaaaacatatcgcagcacaagacaaaacaaaccgcaaggctctttctttatgacgtcagtttaccttcgatcagtatcgatttcacgttatcattcaactgaactctaaatgcagttacaagtacattagatttatataagtcaagacattctattagatttataattacttagtgtccacacaagctagaattactgtttgcataaatcagtattaatagttaaaataacattatgggaagggttatgaaataactaatacaaatagaagaaaaataaatttaactacatattgtttatagtcaaatttgtttttcccctacttatatgtgttacatttaaacatacatgtttatggagtaatatatattaaattaatttatactattattttcttaaaagcatttttatatgacatgtaaaaatgaggaacagacttcccaccaaacactataattgttgcttactccctccgtccaaaagaaaattaatttaggactggatgtgatatattctaatacaataaatcagaataggatgtatcacatttaatattatgttggttttttatgggacgaacatagcagtagtttgtttagaaggacgagtagaacgatgcagaaaggaaaatgctcatctgcactgcactgcaggggtggcggcttcttgccttcttgttgtgtactactagcaggctagcagcagtagtactttgaccaggcagagacgacattatgaaactcatatgtcgtttgccgcgctatatgaagccagctcggcgtgcaccagttcgccgcggacaaggaggagccacggacaaggaggagctagctagtgaaataggtgtgttccgtgcatggcggccaccgcggcttccacgatgtccgcagcggcggcagtgactcgccggatcaacgctgccttcgcgtggacgccaccagcggtgacgtcgcggccggcgccgacgggcagaacgggcgccggtcgcccgtggccaagcgggtgaacgacggcggtggcggcaaggatgacgtgtggg

SEQ ID NO: 73212 - DNA, 17282 bp, Oryza sativa
  unsure (1)..(17282): unsure at all n locations
cgagttgannggctgattcggcttctactgcaagtagctcatcaataaaataatgggtccaccaacttaaatgaaaattaacagtgagattagactgtgccacgtggcgatctaggagcgtctgtaggagcgccatatggcggtttgagagcgtttgtaggaagtttaatggacttttagtatataatagatagatagatagaagatagatagatagatagatagatagatagatagaagatagatagatagatagataatagatagatagatagatagatagatagatagatagatagatagatagatagatagatagatagatagatagatagatagatagatagatagatagatagatagatgattagtgcccttttgaaatgtttacatcaaacataataacatttttattcatagatttgcatggagatatatttcataataacgtaactttatcggatataaaacatggttgtgaaattaatctatttcagtcttcagagagcatgtgttgatatccataaaacacaattgatcataagtaaaaaagggtgaagtgtagcatattgtgtactccattggcccaaacaattcagatttgggaaagtttaattgagataattttgatctcacaaatataacatgcatatgttcctaattaaataggaaaagttttagtttgagaaagtagaggcggtgtgggacgcagttccatgacatgattaatttctcaactactatcacataagccctgaaacatggtaagaaaagttgatagtgttgttattactctgtctaaaatataataatttttagctataagtctagataaatatctaaattcattgctaaacttgttatattttaagacgaataaagtataaattggtataacatggtaggtgtgccatgtcgttctattgatcggatgagaatcataacatgtaattcttacagcctctccgcgcgacaccgagcggtctcgcgtatttaccccgcgacaccgtgcatattgtgctaataatattgtatcctgtatatttttgagaaataaaaaaaatgagtagtatatttttaaacttaattcctctgttttcgcgatcaatcatgctgatctccaatggaacagtgccttccaccttttgtgctgcaagtcacatgacacgatccggaccagatacgtgcgtacgagagcgcatcgatcgatcgcctttgctagatagatccgcccgttgaaaatgcccgaacacccgcgcctacccgcgcgccccccgcgtaccagttcatgcgtgcgcggcactacgtttcgatcgtacgcgcgtggcttagcacgtcgcgacgcccgcgaggccggccggctagcggacccgcccgctgcgcgcacacatgagacggtgggatcgcgaccgcgacgcgtactaacgtctctcgatctctcggtctctcgtgcgaatgcaggatcgagtggcacagagcgtggaggcggggagaggggggatcgtgattcttgccgtggcccgtggtcctcgcgtcgcgtgaggtcgtttcctgcggttgcgcgcgtccgtcgtccggtcgatccggtgccgtcgcgtctgcacgtcccaccaccggattcggtcgcacgcgcctcgtgacaggggccactgcgctgccagccagaccagccatgcctctacgtggtacgtgtacgtccgtctcgtcgacgattcaacacatatcgtcgagccatccagatccagtcgcagtgtgtactggagcatatatgtgtgcgtatcagtgcagtatatatgtgcctcttaactttactgtactctagtacacgtacgttggaggtaattatgagacggttgggttgggcatcgtgtcgtccgcgggcgggagaaaaagccaggaaacacggggatggagagaaaggcgcacgttacgagcagcgctccatagcttcgcgttcccgtcgcatgcatgctgctacgctataccacactgcccctgccctgtgctaagctaacctcgcagaactagcagccactgcgtacgccacagccttacgcgcgctcccggggtggtgggtgggccgcggccggtggagtggtgtggccatgcgcgccgtgtcagcgcccccccggtccagccaacacatgcgccgcgcgcgagatcgtgcattcgtgcgtgcgtgcgcgcgcgcgcgcgcctgtgccgctgtggccaacccggtaacccgagcgagcgagcgcgccgtggcatccatccgctgcggcaactttaactaccaccagtccaatcccgcggcctgcgcggctgcgcgacgtcatctcggctgccctgcagtgcgcagcgcgcggcatgcagccggtgtgtgcgagctgatctatgcgcgccctgtacttgggtgtccgggccgcgcggagtccattggccaccgccgattcgccaatcttcgctgccgcacgcctgcaactgcaacgcatggacgtacgacggacaccatccccgacatggccggtctccgtccattacttcccttttattactcgcatctccccttctcacctgatggaggttttgattggaccaatttccctttcagctttggagtgatcgaaaactactgaacctggttttccttgcactggcagtaaaatgaaccaaaatgcttggcaaattaactagagggatgttacatttttacttatgtggtcatatatagccggggcccctgtcatgtttgtaaggatccatctgacggatgtagcagctgatactgtaagatataccccataccccagtactgctcttcaaggactcaagcatgagttgctgacaagggcggagcaacttgtgtctaggaggtaccaggaacccgattccgaaattcttttaatcgatcagttcttctattttcatcctatcatatgtacacctctcagctaaaacttagatacccgtatcaatttaaactcagtccaaaataaagtaaaacaaatgattagaattctctccatttgattctagctccgtacctggttgaagggaacatgtgtttgtgctgctgagcagatgttgatgatgttggaattaatgaataggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcattcatgctagttttcatctgtaatgtcatgatttatttatggaacagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgataaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcagtaagtctgtgaaccatatttgtggcagtgtggatgatgaggctaatgtttggcattcacgtttatgtcatattaattttggcttgatgtctcggctttccagcatgtgtttaattcctcagttttccattgtcaaaggttctaagtgccatagttgtgtgcaatcaaagcaacctcgcaagcctcacaaggctgccgaggagagaaacttggcaccactagaactcctacattcagatctttgtgaaatgaatagggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtgaagagtttttctcgaacgagtttgacttattctgtgaggaacatggcatcatacatgagatgacgcctccctattctcccgagtctaatgggattgctgaaaggaagaatcgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctatcttctttgagagctttttcccaatgaaggatacacatagtggttcgaaccaaccatctaaaataattcccagttcaatcacaccaccagaacaaactgaacatacacatgaacttgtctctgaggaggatgtcagtgaagctcctcgaaggagtaagagacaaaggacggctaagtcttttgatgatgatttcactgtgtacctcgtggatgacactcctaagtcaatttcagaagcataagcatctcctgacgcagactactgtaacaaggctgcccgcagttaaatggattccattatcgctaacgggacttggaggtngacagagcgaccctatgggtgtaaacctgtggggtgcaagtgggtgttcaagaaaaagcttaggcctgacggtactattgaaaactacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctaaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtgcctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgttaggaaattaagaaactccggagttataatgttggattacatccaaacagcgagaaacctggcagatcccttcacgaagggactatcacgaaatgtgatagacaatgcatcgaaggagatgggtttgagacccatatgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctagaagtatgacttatacgctccacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttacttattctaggagagggggaccttattaaaagggaggatgccctcctagtcacttgaagcatgtgtggtggagagaaaaggagaaacacacgcgcgcgctcgctcgcctggcctggcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctccaactctgtattgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctagcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagatgaagggaacatgtgtttgtgctgctgagcagagaacacagaacacagagacacacacgcgaggcatgctcaggcacaggcacagccttaagtgataatgaccttacattcatggcattacacaaagatgtacggtaacaatggtggctctaaaggctccagggtgcttttaggtaagttcagccctttcggcaggttttcgtgtattcttctaggcgacaagcctggctccgaactgctcatcagtcatcaacggaagttttgcttcccatttctcctgcttactgtcatcctagatttggtactttgtactacataaatttcttataagatagactaagaccaaatgtctatctatagatcactcaattattgtgattgtctgcgctatcatggtgtgaaagaaattgaagagtaattttaatactcgtcgttgaaggtagtcccttttaatcaagaaaaacatcttcaatctttgctctacagcttataaactactgccaaatttagaattttaaaacttaattaatttggagacttattattgtagtttttatattgactctttaaattgctaagaacatatatagatataaaaattttattcataaattaggtactgacacggcttattaattagctttaggccaaacgattgattagcaaccatcacatttttatttagagctgtaaatcgaacaaggtaataatggtaattcaagatacacactttgcgacacaattctaaagagatctccaacacaatcattcatacacggcgccactcaaacataggcatgcatgtccatttcttacgtacagtatctacagcagaacgtgccgggcagcacgagcaatagattgcactcgagcaaaaagcccctcccctcttctcaccccgtctaacgaagaaagaaaagggaaggaggaaaaaaaaacatgaaaaagaagcctcctccgcaccgcacgtcaacgattgctacgaaatctcgggtgttcacggagcaggcaagatgggggaggaaagaccacatgttacacgtacagcggcacatgcgacacggcactcattgtcactcataggagtcaaatgtcatgtcgtaacgtatgttcagcaagggcccttcctatcattttggatgcactatggtgagacaaaaatggtgacccttcggagaaaaataagatacgatattttttttcatttcaattacaagaaatatagaaacagagggtacatagacaagccccacgaatacgctctaacacacgcccaatgagataaaaatcaacttgttaagtttcttgtgatggaatatactcaaccggattctaagtcttacactcgatatggttgcttacatttacatctaattataccgtcaacaatgaaataatcatgataactccatcaatctcaaaatatatcggatcagacttttgaaggtctgatcattaaggtagattatgtgggcatacgtgtatccaatggttatcgtgtgtgcgtttgtgttgtgtttttgaaaaaatagacaaaaatcaatgaatctctaacctcactaaattcctactccctccgtttcataatgtaagactttctagcattatccacatatatttagatgttaataaatctaaacacatacatatgtctagattcattaacatctaaatgaatatgggatatgctagaaagtcttacattgtgaaacggaggaagtacttaacaagactacccgtgtgtgcatatttatggacaccaaaatttaaaacaaaatagccgaaagtcattcacccacaacttcttctaggtcccatgatattgccacttgatgatattaggtgatacccttaatctagggagaaagaattttgggtgggagagagggtcgtgatgagaattttttttttatggtgatgaaacaagacaacatcgaatgggttaggacatgtagaaatagcacgttatagagctttgtatgtttgaacttgtatatcaaggtgacgttagcatttagaaaacgggtgctactacacatttcttcactactgtcgctcgatcttgccaactggcattttgtgcagaaaatgtgcagcgccacgtcaacctactctgctttcctcttgcctcacaccacacctacgtgaaatcaacccaccgtgaaccaggccaacaaccccctagcgaagccagacatgcggggcccacatgtcagcgtgcctgcgctttacgtgcgacgtcaggtgggttcgtgtgcacattaatgcgtacactggatggctacgtgtatactggagtatatataccagtgtacgtacgtagtattaccagggaggggcagtgtacagcaccatgcagggcgcatgcacgaggcgggagcccacgtggggacaaggtgggaagggcgagatgcggccatacgcccacgtggcgcgcatccagcggctggtcacgcgggaaaggtaaagtacaaggctgcctccctcgggcctgacacgtcgcattcctccgtacctccgttgaccacatctcgttggatttttctggttttattattttatttttctgctgtaaataaccaagataaaatggtgaggcccctgatgctcgcaggtggagctaatttgtctgttctacctccgacgttattaggcctaacactggattacaaaatcgcacagatttcacttcgaaatatttatgaaggttgcaaaaggatttgttctgtaatacaaaggacaaacgattttactttttttttctcgaagtagaatgcttctgacatttacatttacaattttctctttttttttctaaggaaaaaagggtggtactatattcttaagaggaattatgcaaccaatacaaagaacacaaacaatgttctgtagcatttctgaagcaatgaaaaattgcattttaacagaaaaatccaaaatgcaccggtaatgagcaacaacattttttttattttccgcaatatcacattatccccctctccctctcaccacaatatattcatcgcccttaacatccagtacttctgaacaaaaacaaaactagcctaaaaaaagacgagcaaaaaaagcaattaaaatgacagctaccaccaccaattatctccattcctgctttacctcgaaaagattaaaatagagggaaaaaagaatcggaaagaaaaggaaaggtgaatgaaagaaagagcagggcaagagcaaatttccagctcttccagctgtcgtccgagtcgtcaccctatctctcgctcacgttgcctcatcactcatcagggccgcctaccccccactgccgaggtgggcccatgcagcgcctcttcgcatcggcgctgttggccgccgatccgacggtggtggtgcgctcgctctcggagctcgcgctccggtggtggccgagcaccgtcaccggcgtctcggcgctcgtcgccgccgccgcccagctgggcccgacgccgcaggccgccgccatcacctcgccgcactcccgcaacttctcctgcagcagaaaagtccaagcaaaatgattatagccagcttccaggccacggggggcattatgagtggttctaattatgtgacaattaaggtatgattaattaactccacaaatgagaaaacaaccaaagtttttacagtgcggtcaattggctgagcttgctccatatcacgaggtaaatcattttttaaaacgtaaacagtattttttttttactccaaaagtcgcctctcacagagagccgggctatgtgtgactgtgtcagacgtgacaggggttgtttcgtaaataagtggtgattaagggggtaattttagatgaaacaaaatttattaaaaaaaaaagaatcatgctcacgctatttacaaaggggcaagcggcgacgccagcttcgaagccgaggaggtgggcgccggcgacctctccggcggccgcgaggagggccgcggcggccgccacggagggggagaactccgccatcttcacctctgcgaaatgcaccggaggcaaaaggtgagcgctcgctgaatctaacggcgaggacggtggcattgggcgtggcggcggcttggacgtacccggctggacgcggaggaggaggtcgacggcgcgggccttgatggcgtcgagcagcgccgggtgccgcggctgcgggaagcacgcggagagaaagaagccgaggaaggcgagcggcgtgacggagcgcgtccgccactccagcgcgttgagcaccatctgctccatgcgctggattttcgcctcgtcgaacatgaactcctcgcccctctgcaacagaccgacgcccacaccaacgacacgaggtttcagcaaatcggatggacgaatccccccccccaacgaaatcgcaaccgcgcaacgggaaatggcattcgtcccgtacctggatgtcggcggcggagatggcggcggcgcgctgcatcttggcggcgagggtgaggcagctgatggcgagcagccgcggcgcccatgggttgcgctcgcactgcacggaaccattggggaatcagatcagaagcgaatccctgcacaaaatccagccagagaaaagagcccccgtatcacgcgttcttacggccaattggcgcttggagaggtagcgatctacgtagttgagcgcgaggtaggcgacgcgggggtgcacgtccagctcgccgtcgtaccgcacctgggcgcgccgatcaaaaacacgcccgatcagatcaagaaaacaggggaaagaacctcgaagaacccccccaaggaaacaaacccaagaggagaacgcgtcccggataccttggagatgaacccggcggcctcgcggcgggcggcggaggcggcggcggagacggacggcgagtggtggccctcggcgtcgaggaggctggcgatcggctcgtcggcggggctggtgaacgggttctcgaggtcgaactcgtactcgtacgcctccaccaccaccacctccttcgcccccgtcgccatgtccatggccgccgcccgccgccgcgtagtacgaggaaggcccaggaacacgccaagaaaccaaccgcgcgtggtgcgtggctttatgggggagagggagaggaggaggaggaggaggaggaggaagccaccattgctgctacgcagtgctactactagtactagcctctgtctagttgggagatggcttttaataggaaggggtcggggacagtggtacaaaaggtgtggatttggggttctttttgtgaagatcgggaggaagaggaagagaggaggaaaaagttccctccgggggtggggcccacctgtcagcgggacgcaatgatgccgccctgtgagagggagacctgtacccgtactgcgtcaatactccatggcttcatccggctttgacagctcacaaccaacatggaacaggggaattggtaaatttcctgctggaaatgtttctcctcttgctattttccccccttttttttttcttgtttgtctcatgggttgatggaaaatgaaatcaatccccgagaataagatcgataatctttttttctctcttttgattacactaaaatagcatacatacactaccgaacatacgcactacactcacacacctacaagtacgctgtcgaacactagttcctttaaatttattggcgatatttttagtacagaacgttactacttactttcgtatccagctaatttacatcttcaatagtcgacaaagggtctgttcggcaggccgactgcgacggctgcgactacggctgtagctgcgcacagtgactgtggcactattcgtgcgtagccgcggcgctggacagctgaacaggcccaaaatttattaacaaaggtgacatgaaacgctaaaccaccaaaagatttatataaagggaatgataaatgtgaaaatattgctacattaaccgacaatataaagtggatctcactactcaaatttccaaaggctgagaagtggcagctcgtatgaaatttctaaaccactcatcacactgtctcacttcattacacagaacgtccaattttcagaaaacccttacaaagaaaaaaaaccaagaattatcttactagagcagcaaacaaatcttgttagttttttcctcgcaaaagaaacaatttctccagaattttgttggatctttgtactgtagtggtggcaggtagagcagggggtaacatgtaaattcctggctgtgtggaaacgaacccgagtacgcgacatcgacggcatctggcgggagaaaaacggacagcgctgcatcccccgttttgacctgcggccgtcgctgttgcaaagaggacagtggtcaacagtgctgcccgggcccacgcgcgcgtgtttttaccgaaatgccccctctccatcctcatcatgctgtttgctgtgtcccgggcccaccgtgcaaaatgtcagattcaccccctggcacgccaaagctcatcctagctctctcgtgaaccttacctctgttcgttcttcggagacgagatttgtgttgaaattttgaatgaatttcagaaatggtaaaaagaaaaaagaaaggtgattagctcggtaaaaatcgcaacatgcagacccccttcagctggctggtcacgattcgatcgtgttgttttgcttgcacgcgtcgcttcctggagtattatttctgaaccctatggctacacatacttcatctcctacactaataatctataggttttccagatcgtttagttgattatcttgacaaaactgaactgtggccatgttaattatgagcacttaccagttacccacgggatacgagttaaagatcaccttcttttggaagacaagatttcacatgagtttttgcagggttatcaaagaaaagttcttcagttattgccggagcgatcagttgattggcgtaattttgggcaggattgcccgttcggaaggaacagctcgtgcagctgatatgaaatggatagtactggcctgcgttgaagggctcaagattgatgtgatgattgaggggacggatcataccactcagtcactccaatgtctctcaactcgttaatttgttccatgtacagtatacatatatatggacacggtagccctggttgtaacccatgttctacgtataacatatcggagtccttttcttgttcatcacatctcaacgtgtctttgacattaggccaaatctaaggtcaagtgtccatatacacatatcaagattaccgtagagtttgatgctataactgtgggtgtataagtataaatctattcaccagtagttcaagcgtgtgttactacattcgtagacgttcaataaaatatgaaatcttgatcactgctcttgactacaaatgtgtagtgcgctcccagaaacctcgtggcattttcataatcgttacagtttcacctcaaaattctctgttttcaaaaaccaaagcctcaaattaaactttcatgtgtctgcagagtctgcatctgcatgcacctgtaaaaaatctacacgcaacaaaacagctagtttaacgattaccaagcgagatcccggtctcccatgcaagtgtaacagctacggctgcacattaatccccgttttcttttctcccatgaggcaaccggctcagtacggcgctacatatcgtgagcatatatgtatccgtgcttgctcttggaccagagcgcttgttcttgtactacctcaaaaggctttgttttttttttctctttctaagatgtaccgcctcaaagatctatgctcgt

SEQ ID NO: 73213 - DNA, 638 bp, Oryza sativa
ctattttccgtccctcctctttgggctgacatatgtatacctaaaataagtctattttctgtccctcctcttcggctgacatatgtatagataaaaaagtctattttagatccctattctttcgttcatggcatataatatgtctatttttacttccctattttttttgtaccgggcctagctgccagcccatcgtgccgggccgagccaacgtgccggtggaggggcccaggcacggcccgatggtcgggccgggccggcacgggcccgacctccgtcgggccgtgccgtgcttgggccgggccaaaataccgtgccatgggccgggccgtcgggcctcgggccttttggccatctatacttcttcctcctccctccctccctctctctttctctgccctttctcttccctttcgactgcagctgcctgtgcgacgctggcaatcagccggagtggtgtggcaatgggcgagagggtgggcgttggagcggcagcggtgggaaaaccatggacggcatcatggccgtgccaagtatatacggtagggaaaaccactgtccaggagctgtactggcaatctggagctcaccggcgaggagaaggaaaccgtgcggaagctgatggggtaccgagctcg

SEQ ID NO: 73214 - DNA, 2354 bp, Oryza sativa
ttgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatctggtggcgaatggcggcggcggctcaaccctgttgggttggagcaagattatcctagtaaaagattgcctaaacacatctctgttcttcctgagttgttcgagttcttccacttttccttttcattttccttagttgtgttgagtccatctggtgacgctgacagtgagcaacatgtgtgatagcatgtcgttccaggcgtcaatggcgccgggaacacaccagtgcacgcagtcattgaagatggtgaagtactctttcatccattccttacgacgcgtccatcccctgtacctgctcgggtgcgcgtccgcccgccgtatcatcgcctccgtcgtgtccatcagcatcattcttaccccgccgccgctcgccgccctgtttgcatgcctggaactcgctccacctacgaagctcagaacacacgtttactagaaagaacaagataattgatcactagatcaatggagaaaaatcaagaaattaacctgcagcgtgtggaagtcgagctcgaagccctgcagcgtcttctcgccacgccggtacggccgcgtccggacgcagttgccgtccttgttccactccccgccctcgtactgcgacggcgacacggtccgcagcacggcggtgacgccgccgccgtcgctgctcaccacggcgcggagcgcggcgcgggtggccatgcggagcgcgtaccgcagcgtgaggtcggtgacgttggggaggaggcagtggtggcacccgacgagccggccggcctcgtacagcatcgacggccggtagaaccagctcgacgccgacacgacggcgtagtcgaacgccgggacgtgcggcgcccacacggcggcgggctcgtcgaggtagaggttccacaggcccgtgtgcgccggcccgtcggcgtcgacgagctcgctccggaccaggaacggcgcccagaagttgaggacggtgaagttgtagccgccgccgtagtggtacaccgtgtgctcgctgctcggccagctcgtcgttggcttggcaacctgcaggccggccaataaaacgtcacaccctttgctgctggcccatttctgaccgtccgatcaagcgatcaatgattcagatcgaagctagtactgtagcaaatccggcacgttttttactttttaccctggtcaggagacagatgagggagttcatgtggttcttggcaagggaatccccaatgaaggccaaggtcttgcccctcatggcagagaggaagcgcaacgggtcgagacgggggagatcacaaccgtcgggacgccaccgccactgcacgaagccaaggtccagcttgccgtacttcatacagtcatagtgctcgtggatgaacgagcaggtgtcgttggtgtagtagggtgcatcagggtctggcacccattcgcctctaaatatgtcgcaggcctcgccgtcagccttccggccaccggaggaggtggagaaggaagagtaggacagccaggcggacagtgttcacggcataaccaccgggaaagggaagtatgtgtcggagacggcgatgacagcgacgagtaggaggatagagatggcgggaatcaagcacctgccgttgtagtactgcgtcttgacaagaaaattgcagagattattaagaagcgccatcgatcggcactaggagaaaactaagaatctatatttatgtgagaattgggtgtgaaacaccggtggagttaattcaggtgtatatataagaaggtgttcataatctcaatgtatcggaattttggttttttgggggtccactgctactggcctagtaatataatctccgcagcacacacagtctgtacgtagtatggcgtcgcacctcatggcaccgcgagtctctgttggcatccatgttacttcctcgcagcaaagctcacagatgattaaattgttggtaagttatgggatccgagggtctcgagcatgagcaaattctctcggcgcgcacatggacacatcacacatggttggtgtcctctacagaaagacccattttgtcttctatcgaaagacccattttcactttatgtctgtattgggtagaatctccca

SEQ ID NO: 73215 - DNA, 9774 bp, Oryza sativa
acactctctcgcaactcaagcatatcccaaatgcaaacgtacaaatagcctagcagcatagaagacatctcaacagaaaaccactagttccatgaagtttgcaattaaatagaaggatcaaatattgttcaagtactgtccatttctctccgtaataacatcgaacaggtgatgtgcaagcgcggcaagtgcgttttcacaacgcagggtgtacatgacgtgcgtaccgaagacgatggtgaccagattgagcaagacgacgctcctcgccttccggggcaccaacgaggccaccttccgccacgccgcccgcgcccgccgccgcgccgtggtgcaaggcgaggcgggcggttcgtcggggacgggggcggcggattcccgcatcccgggcggcaccgacttccacctcccactctcatcggccgccttcttcttcttcttcttcttcttcgacggcggcggcggcgaccggttggaatccttcgacggagaacctgaattggaggcggcggccaaaggcgcgaggaggcgccgccgtctcgtcggcgagggcgccgccgctgggaggaggcgggggagggtgcggaggggaggggcttctagaagggaaggacgccacgggcggggagggttcggaagcttcgagaggaacatctcgccggtggggaaggttctagaaggttggaggctgcgaccggcggctggaggaaaaacggcgaggtggaggaggcgagcggcctacgattggcctgtttgggtgggccgaaatctaggcctatccacgtgtaaggtcgagattttagctcgagtactcggcccacgaatgtgtgtgggcctcgatttcggtccatccaaacaaagattatggcttctcttgtgatttcggattttagtttgcgcatgtcctaaacttctaaattgtatgttttatatataattttttataggaattttaaaatagtttcctaaatcaacttcaactttgtgtcactcatttataccttcaagtagttatcacaacatcagattatctattgatttcagctatctcaaataggacctatatggactacggagtgattaagatcccctaactttagggggggttaaagtcagatgaacagtatcatgactttggggtgttttcagccatccgattcacagcaaacgaacgagatcaatctctaaagtatgctacaatactaaagaaacagtagtgcggtacaatacaattgattgttttaaactgtagctataaaaataactgcaaaatcacttttttctactgtggtgttagactcatttattgtgcgtctctatctttagcgcccgaagtaagagcaggtacaatagcaggctattagccagctataaacatattttaataagataaacgatgagagagaagagcagcgggctacagatctgtagctagctgcagcacggactccaagacacactgtgtgtatgacaggtgggaccatatattaatagtatagtaagcaattattatatgaattggctattagattaaatatagatgaattggagctagtagtgagctgtactattagacttgctctaagtggatatggatccctatgaagtgggattgaggtaagaaatgagtggcacaaactacatttgcggtgcaacgtacactaatgcccatacggcagccagaaggtcacggcgctcccacaaaacattaaatagataaatcaatgtcataggagcatgataagaaactctgatgtgtatggcaaccatataacaacatcaataagaggtgtggttacatggactgccattgcaatcaggagtactagagggtggtggacaaacataataacgacattgatagaaattaagaagggcatgcatcatcggaatcatttcgataataactaccccctccgtccctaaatatttgatgccattgacttttttaaacatgtttgaccgttcgtcttattaaaaactattaattcttttcttatcatttgattcattgttaaatatacttttatgtatacatatagttttacatatttcacaaaagtttttaataagacgaacggtcaaatatgtttaaaaaagtcaacggcgtcaaatatttagggacggagagagtatatggtacctcgcacgttgttacgagaaaattatgataaaaatcaaagatatgagttgtaaaagtttcttacttttttactatatgattttctttcatgtgcttatatattttatatcttgatcaattattcaaaggttgtaaatgattaggttgtatgggatgtcttttgtagagaggagatgtaatttgcacttttgatgaatgatccaaaagctaaaaataattaaggtgatgtggctccataagagagagaattaacattaactatacttagtggggatgaactttatagatacataggatccgtttgatatgtgttaccaagaaggtcaaattcttatagcctaatataccttttttagattttaggaaaatagttaattaagttcagaattgtatttcataactgaattcaaattaaaagaatactttgcaattccaactctttcaaactttgtttagggttagctctacaatgttctatgtcaggtttgtttccgccatatattttcccatatatatacgcccatctgagaaaacattcttcaacccatccgtgacaaagaaaccaaccaaaaccacaaaaaaaaaaaaacttgcgaaatgcccagtattgcacattttgctgtacaacaattcatcaaaatgctcactgcgtggcaagtccagtgtcagtgtcttagagcatccataatgttcatacaaaatgagtagtaagaagtcttcgtactactttacctttagagaaaatccatgaaatgccattgacaaacaccctaatccaagaaatgccatcgacgaacgcgacttccagcaaatgccatcgtacgagccattttgtcccaaaaatgccatcgccgtcactttcactctgttagacaccgttaattttgtcaaaatgaccaaattaccctcctcaacaaaggataaatccccttctcttccatcccatcgccggccactattcctcccctccacttcaatcgccagctcccgatgggcgacagcggcaaggcgacgctcccaggcggtggcacatcagttccaggcgtcgacgcgacgggcggcgaggaggtggcaggcggtggcgcggggctcccaggcggcggcgcggtggtcccaggcggcgcctgtggcagcggtcccaggcgtcgacgtgacgggcggcgaggaggtggaaggcagcggagcgtcggtcccaggcggcggcgcgtcggcagcaggcgtccgcgcggtggtcccaggcgttgacgcgacgggcggcgaggaggtggcatgcggcggcgcggtggtcccaggcggcggcgcgtcggccgcaggcacggtggtcccaggcgacggcgcctcggcagcaggcatccgcacgacggtcccaggcatcgactcattgggggaggttggccggtgatggcgaaactgctcttcttctcttgccgcgcggccgccgccgtgccgggccactttgcgagcacgcggtggccgtcgctagtggcggatccacctcccggacaggtcgggcggccgcccgtgctccgtcgatgtcgtcttcactacgaatagctgtcaacacctatcaaaattagtcgatcaccgaaaaacgctattactcgcccgggctcaacgatgccgctagctccgccactggccgtcgctggcgcagtgtacgacgacatcgtgggcgcgtaccgcgggttcatgccgtcgcggacgcgcgcgttcctcgtcatccaccatggcccgctcgagccgcacgtccgctgcccctactgcggcgcccgcgtctggagcatgaccgccgcggggctcgcccgcctctcctcctcttcctccagcgacggcgagcgaagcgccgactccgactccaaccacagcgacgacgagtcattcgccgccgctgacgtgagcctcccacttcctctggctagccgcgtgtcaggccggcgccttcgaggcaggccggccatgtaacgcatcaagcattagcggtagttttttttttaccggtggattgggatagtattatttggagtgagggcaatttagtcattcttgtaaaatgttttgttctaacggtgtggactaacggtgtgatggcatttctgggagaaataggcttgtacgatggcattttcaggaagttgcgtttgtcaatggcatttctaggatcaaggtgcttgtcgatggcattttatggattttctcttacctttatggaggtgggtagttaaggatgcagtgactcctagcaatagcacttctacctggtaagaagcagtagataaaattaaactctctcctctctcacactctcttttttaaccattgctttagatatggttcatcctaccttactatctacacattgcgatttgtaataactagcaacaattataacctgttttgtaggtcacaccttattacacactggatgaatatatagtgatgatgtccttaaggaaattagcatggtttatttggatttctaaggattataattcttagaagtgtcattcgattgtaaaaatgagtatgcactactgaagaaaccatctttggtcggtcgacccaaatccacaatagtcctagtttcattgaaaaccgggactaaaaagcatttttagtcccggtttataggtgtaaggggacgatgtgatctttaaaaatcctaactttagtcccggttgttgttcctaaccgggattaaaaatctatataccgtatataatcccttactcttatcctcaaaaatttctatctcttattcctcctctctctctcacacactcttaccctctctattcctcttctcttctctcggtaacttctcttctcttctctcgaagtctcggtagagccagcgaggccggcggaggggtgtggcggcgggggcccgagcgtggacggcggtggcccgcggtgggaggcgttggcagccgcccgcggcaagaggcggcggcggcaggagctagcggcggccggtttcttcctttttttttcttttttttccttttttaaagaatctgtgattcgttggatctgtgatgtatttgtatttgatctgtgatgtatttgtgatgtaagtttttttagaatttgtgatgtgaatattatgatttgtgatgttgttactttgatctaggatgtaggggcatcttgatttagaatttgtgatgactagccgtcaacccgtgcgttgcacgggtcatatttgatattaatttgttatcatgtaaaacttgaatgggttaacagattaattattcatatatatgtatataacaaatatgagagtttttaatactatgttgaatatcctggtcattttcttagttcatatataatttgggcaattaacaatattaaaatgagaatctaaaatatacataattcagaaatttagaatatattattagatttttaaaaaatataaataaatggtcatatatttctagctattgcggaagcttttgaaaatataaaatgtctgatttgtatagatctaatcgtcaaaccgtgcatcatactgctaatattcatagtattttaacaataaaatttttttatcttcgttagcttgctaactgtggttttggtcaaaagatctacacatgctaattttaaattttgaatttcagaaataagtggatattgatactgtaaagatctgtaaagacaataggaaaaacatgaaagatacatggtaaagcctattggttgcttatagagaacatgggagaaataaacttaatagcaaacgaatataccttgcaaactccctcaagattatgctatcaagatcacgaaagctgagattaatttatacatagttttagatgaggaacctgtaaaaaaaaatcaaatcttgctttaaaacggagttgtagtagctgcagatcaacttgaatcaaatcttgatagataaagtaataccagaacatgagaattgagcagggtctggttgacagagttcttcgggtgcagggtcaaggagatcgacgtataagatactgatctgatcgccggcggagtcgaatgcggcagcagagatcgatacgacgacaaggggacaatatatagatgcctaacgtacattggatggaggcccagataagtcgttgggcttttaaaattccacggttacaatatgtaatctatggtcacgatttgatgatctagctaatcaacggttagattattctgattaacgtgagagctccaaaaaaaaagtatccaattagtataggtatagattttgtgattttggtgggattggtgtgaaatcaatattcaagcaataatgaaaaaagaaagaaaagagagacgtggcgctaccctctttagtgaactaaaattcctctctttactcccggttggtgttactaaccaggactaaagagattatttgaaccgggatctggattcataagggttccaaaccgggagtaaagagcatttctccaccagtgatatgaaaatcaaaagaaatttttctttccctccaagttatagagagagcataagaaaatttccatccactcgaaccccttgaaaaaattatatagattgatgtgtgcatttcttaccattccttcattttcttattcctaattccctatgaattaaaattcctctaaactgaaccagcccaacaactagactaatcaagctcagaggagcctgcggcgcgtgcacgcaatcccaccagattccgtccacctgggcgaatccccggcaagctgcgcgatcaccttcgcgccgcgagcgaccgcgagcacgcgcgcgactttcgagcccgccggccatggcctccgccagggccccgccgccggcgcagctggggtcgctgtggtcggcgctggaggaccagcgcggcggggcgcacgaggaggagttggtcccgttcctgctgtcgtcgtcgtcgtcggcgtcgtgggggggcctgccgggagcgcgggagagggagaaggagggacttctccggcgagccggcgcggcggtggagcgcgggtggggcgccgcgcgcgccgcggcggaggagctgtgggcgctggcgcgggccgacccgcggaaggccgtgttcgcggcgaaggtcggcctggcgctcgccctcatctcgctgctggtgttcgtccgggagccccgcgacatcgtcagccactccgtctgggccatcctcaccgtcgtcgtcgtcttcgagttcagcatcggtacgtacgtacagtacagagctttgggaccgatttcttcttctgcttcatcttctttgggtttcttcgcagtaaaagtggatatgcttttcgatggtttttgtgctggtcctactgttcactagccttttaggtttgttctaaattagacattttcaaaatttgatatcaagttaatagaaaaatatagtatcatttttaacacaaaatagatatagtggatggaataaatgtaattttggtgttatagtttttatagtttttgttatgtttttgctcgctcagcctccttgttgaaattttgatattaaggaagccataatttgcaataggagctctaaggagctaggcttagtgatgtgctttctgtggtcatttcaatgactcaattggttggctcgactgatctcaccacttctcctaggaccgcaatgacaatcataattaaatttgaacaaaaattaacttacgataaaataacttataatatgaaataggagtattcatctgcagaaatgttttcactgtcttaaaatgcttaacgaaccactatattttcgaagcaactccttcgacataaagttagaagaacacaagtccctaactgtcaccattgaccgttggcctaggcagtggcttggctgtcgccatttgccatctcgcgatgctacttgatgtcacacactgtgaagctaaggtagccctagttgttccttcttaggatacacttctattctggacgtttaactatttgttactttcaaccaaacaagtacaatctcattaacaatatactctctcacaaagtgacagattatttgccactcacgatcctctgaagtggcaaaggttaaaaaaaaatatctcttcctcgtctcaactctcaacctatatatcttcccactcctaccttacgttagaatccaatcttagtttgtcgtctaggaagaaggttttggttgactaaaatgagaaatgccatggttattgtagttggtgggcacaggttaaacattgggagttcaacgaattagtgtacagagaagaggcatatggaggttgaacatgttacaagaaaccaatgataatatcagttgcctaaaaaaaagctataaaaaagaaaaaaaaatgaggagatgaagataagggtaaatttatcctagtaagttgattagtacaacctatagttattaatgctaatctactcatgaaacattggtggtgttatactggagttgtgctgtgcacgacttcatttaataagtgttcaaatccttatacctattaatatgatatatacatgttgatacgttttaaattgaattttagtggggataggaatttgtcaagtctttacgtgttaaggaacgaattcatcctgaggtatgtcgtgtgtgcgcaggcctttttttttttccgtgtaatgaaaacaaaaacactaatatactcggctcaggagctgactgttaattctagtggtacttgaacagcgatatggttttgtctgaccaaacaccagagtaattaaaagcgacttatactttagatatataaaaataaaaaatatagtactccctctgtccctaaatatttgacgttattgacttttttaaacatgattgaccgtttgtcttatttaaatacttttgtgaaatatgtaaaactatatgtataaaaaaaataataaatacttaaaatttttaaataagacgtacgatcaaatacaaagggagtagtagacatggaagtcatgatccatggaaaaacaagtcctgaacggattcggttccagtgcagtggccactgtgactgcaagttaagcagtcgcaggagcatcattggatttaaaacagatggctcatatgcctcttagtactgtagcattttttatatgaaaattgtacggttctgattttattgtagtaaacaatttggaccattggatcaataaatatagggcttagattgtgtgcagtcacaataccaactgctttggatctcaattcgtcctgaacccattcgctacgaaaaaaaaaaaaagaaaaccggcaaaatctccgtgtgccacggccatactcctcgatacaactgctctacgggcagagacaagccagtgtgcgcgcgagccgcggcaaccgccagctttccgggacacgcacactactccactagtacactagtgcccccccggccccacacgagattgagattccatcgtcagccaccgaccgaatccttcgccgcgggaaccttctagagcgttccggatccaccggccatggcggccgcggggagcgcggggtcctcgccgccgccgccgccggggcagctggggacgctgtggtcgacgctggaggaccagcgcggcggggcgcgggaggtgcccctgctgtcgtcggcgtggggcctgccgggcggcgggaggggcgg

SEQ ID NO: 73216 - DNA, 2039 bp, Oryza sativa
ctaaacaatgcatttcgtgtaattttattttattaaaatacttttaataagcaatttttttagccttgtagtagttaattcatcgtttatacctcaaatagaaaaaaaaagataatctatcaatctttcaatttcagctatctcaaatggggccttactagctagcatcatttcagggaaaagccatgcaatattttccacatcatcatcccatcaaaacatgatctgttattttccatttctctgcctgttcgatctaacatacatgtgaatacatgttgttcgtccattgtttcaaagaaaccagataaaatcggttatagttattttttcttctagcatccccaaccaatcatttcactaatagtttgctaagctcactccatactccataggaaaggtatatggacactcctaagtgaacactccattttttaaaatacatatactccctccgtttttttaatatatgacgccattaaatttttaagatatgtttaaccattcgtcttattaaaaaaattatgtaactattatttattttactgtgacttgatttaccatcaaatgttctttaagcatgatttaaatatttttatatttataaaaattttgaataagatgaatggtcaaacattgataaaaaattaacggcatcatataataaaaaaacagaggtggtattaaatatagtgtatcagttctgacttctgagctttctttgatgttaaactataacaaccatctctccacttgggactcagcttcggtgacatcgtgtaaccatgtcacagtgtaacattcggtggatctcagccatccaaattgaatccaacgcctgttttggttgggcccgcttgcaggtaaaaaaaaattccccaatccatccatcccgacgggggacggcgccccaatccatccatcccgcgtgcggctctcctctcgttcgcccgccgacgcgagctgggaggcgcgccactgccgtgactcgccggcctcgccgcgagtggggagggctacgagcgtccgccgtcgtgcctcgctgggctcgccgcgagcgccacgcgaggtgtccgcgctcgcatcgtcctcgtcaggccgtcgcggagaccgaggaccgcctcgtccgtccgcgtccgaccgtccggatttgctaactcgcgcacacacgttgccggcgagcatgcccggccaacaaggcccacgcgcgcgcgagattttttttttctctaaccaatctctaacgccggtttttccgttttttcttccgcgttttttcttttggcgtttcttttcgcttttttttgcgttttttttaatcttttagcacacgtgttttttcaaatgttttgagttgaaagtttttaaatattgacttgaaaattttttaatttggccttgaaattttcaaatctcaagtgaaatttttcgaatctgagttgaaagttttcaaatttttcatatctggacttgaaagttttcgaatgttgagttgaaagttttcaaatctcgacttgaaaatttttaaatctcaagttgaaagttttcaaaattttcaaatccggatttgaaagttttcgaatcttgagttgaaagttttcaaatctcgagttgaaaattttcaaatctcaagttaaaagttttcaaattttttaaatctggacttgaaagttttcgaatctcgattctcgagttgaaagttttcaaatctcgaattgaaagttttcgaatctgagttgaaagttttccaaatttgactttaaaatttgaaacttaaatcaaaagttttcaaatctaacttaaatttttctcaatttgctagtaaaaatatctctcaaaaaatcttcagaatcttttctaattactactagtatcattagtattaagtgttaactaatagattaatagataatagatgtagttaaactactttaagggaggtgctcgcagctaggaggcccccccccccccccccggggcgtccagccgaggccctgccgtcccgccgcggacagggaggggtcaggggcagctcggcg

SEQ ID NO: 73217 - DNA, 12360 bp, Oryza sativa
  unsure (1)..(12360): unsure at all n locations
ttctccgcgacctccagggagaggagaagatgtcaaactccgacatgatcgctgttctttgggtaagtctcgtcttcgtcgtaaagctcgagaaggaaacgtccatggcgttttcatggattggtttcttgttttttctttctttaggagatgatctttagagggacggacacggtggcttgagcaatggcagccgccggcttccacgcgcctccctggccgcgccgggacggcagggtgccacgctgccgcctccgcccgcagccgcgcgacacgctcctccagctcggcgccgcgcctcgccgcattcgaggcctccgcctccttctccctccggcagtccggcgcagcctccccgtctgcaacaagcaagcaaaagcgacgccaccaccatagaaaacgcatagtcgaacaccaccagcagcaagcaacgaatcaacacgatcgacgacgtcgacgatcctcacatgatcctggaacatacgcgccatctcgttcttgtaccggtcgaactgcgtggcgagctcgtcagagaggagagacaacgcggaggaggtggtcgtcgtcgacacgtgctccgacccgccgtcgtcgaagtcgaggcggagccccgtcgccgccggcggccgcttgttgtgccgctgcgccaggctcaccaccttgtgcccctgcgcctggcgaggaagaggggaggaggcagatgctgctggtgctggaggtgggccggtgctgcttcccgttggattagttttcaacgccccagatcgctccaatgtcacaccgtgacatgccatagtaaagtcaccgaatccgaatcccccatagaacataaacgagtacctttacgatactctccactagtattattctactttcagtattatctctgttgaagtgatcttaactataaattaatttatgagtcctaccgctagtagaaaaaaataccagtagttaatgtgatagtgtaaatagatattatttattgaattagaaaaaataaatggcttacatcttaagataaacatacctccattcaacaagactaacagtttatgaaaaatgaaaatcaatcctaatttttttaaaaatatattattgaaaaatctaatctagcaatatctatgctcacatgcctaatccatcttactataaaatcataacccactaatcttaaaactcaatatgcaaacatgccatctgatcatccactagcaataattatatacaaaacttatacaagcatgcaacatcagactgagtttgtatgttgtagttgggaactaatctcgtgcgcacgtaaaacagagcgactcatagcacacaattaattaagtattagctatttttttaaaaaaaattgattaatatgatttttttaaagcaactttcttatagaatttttttgcaaaaaaagtactatttagtagcgtgcacacgaaaaaacgagagggtgagatgggaacacaaacaaacgaacacagccctataatttattgaattctacaaatcaacatccaatcatcttcttcaaattatttttcacaatatttttaacatatatacatccattatttttataatacttaatatatatccatccatataatcaaagtgcgggatatcatatttcatttacaatcttatacagagtctaataaatttatttctctctgaacatagtttgacaaaccagttttatttgttgttaataactaatataatttttacttttagcttgattattaaaaaatattaaaagtagtaattttcgtagcgaagcgcgtaaatcacctagtattataaaatcctaagtctgattttttctcattctccacaactagaggcgaggtttggctcctaattacaacgtgcagctcgttcgtgcgctaggaggaggtggagtctcacgctagagtaggagtgaagaggattgattctatttgatgtgtttttatgtggtctacttttttgttctgagaagtcaaattaatctgtaaaagcatatctaagagtctctccatttgcttctctaaaccaaaatttaatcaactttagaaaaaaaaagtagccctccaacattgccatgaggcaggccatgaggcatttggccagccaaccagcaattctcgtggtccacttccacttatgttgccccatccaccgtcgatgagagggcggcgagccagaccaagcaccaacggcaacgatgacacggaggaagcccacgatgagccccaggtcgacgcggcggagaaggctgcggagcacttcttgtaggggcaccggaccttgcctataatagcccgcgctccagaactacgcaacccagcccatccgacaagcaaacccatttacacatagcacctcacttacacttttatatactcgcttcgtgtatattgattaccgtgagcggtatatagttggagggaaaaataacttatatggtttcactcttgctcaactcgtaaggtgatactaataaaatgcacacaacatttaattatgagtcacataggccacatcctaattgagctaggatgtcacaatgccaaagcctaccgccatccaccgccttcattacttatcgttgtctactcaagctccactctatttccttcctttccccaccctcgttgccaatgatgtgatgtggtggccatggtgtgggtgggaagggaaaagatgtattggagaggaagaaaatataaataaagattgacatgtgaagcccacaattggattggagaggataaatagagaggatgttaaagttaaaggtaaatttcgctctctaattttttttaacaagctaactaaatagacatttagagagtcatatttaaagatgttgttagagacacttcatggaaggatattttcatgctcttagggcaatagcagtgcagctaccgtacttgagaagccaaagcctccagctagactaggaacggtgtaagaaacaccctccatagtgtatgtggtattaaataggttccttcacagtacatgttacttattatagtgggtctcaaccgtctctctcttctcacttttcatctccccctctcatccctttgccttttcccaccagccaccaagcaaaggaagtgagacactaggcggcccaagcggcgacgcgttaggcggggaacggagaggcggcgggatggcaccacctctccaggcgacgacgccaccaaactcaccggatccgaagtcggctagcagcggggtggcaccacctctctggacgacggcgctactgagctcgctgaacctcgcaataactttggcctaagccgccgccgagcttcacccccctgtctcgaatccgcggttatgtttttggttcatgcgaggttgaggtgagctccaacgagggctacggcgccgacaaaggcgagctctgacgaggtctgtggcatacgtgcttttgcctcccgtcccagtccttgcatcttgtgaccatcggtgggtggatcgagcaccggagctggagctcggtggtgcaagctggagggagggtcgcaaggggctgccaccgccgttgagctcctcggctgcgtgcgatgcggcctcctcccctgacagatctggccacttccttctcattatcctcctcgccgcctctccttcgatcctctcactcttttacctggtggagctagagtacgggacacgaatgtgtgggtctagacctgcgaaatctaacgaggaacctatggcaatatttggctctgcgttcttcatgtagcaatgcaataggtagacatggagtggaatctccgacgtggctagcttgggctaaattccacttcagtgcactatgaaaatccttagacacccctttggaagaaaattctatgcggcagcgtcgcatgacgcttctcgtgtgacaccgtgcgaactggcgacgcgtgtccggctgccgcccgcgtgagagtttcctggcctgctagctgctgctgctccctgcagacctgctagctctcgcggcgctgttgttgctcgcacgcagcgcgctcccgcgccgccgccgacgacctgctgcattgttgcttctactcgcgtgctcctgtggcaccgcgctgtcaccgacttgctgctcgtggctgcgctctgacgctccgctgcctgcctacctacctagggatgaaaacggtcggaaacgatcggaaaacagcctcaatcatttccgtaaccatatttttcttggaaatgaaatcggaaacggtaaattcggaaatgaaaacgatatcggaaatatcggaaaaccggaaacggaacaatacagacggaaacatgtcggtacagatcgaaaacaggtaacaaatacggatacattaaactataaaaacatatatttaactttacataagtatgttatatgtatacataaattcaagcttatactatataaattataaattaacttcattttagccatgtacaaaagttagagatttgattgaagagtcagtcaatatgtaagctgcgggtcaagtatagacatgctctataaatatcgacatatttagaatatggtaattaccatattataagaaacggtaattttcacaagaatacggtaaatacggaaacgatcggtataacagtaaaaccatttctgttttcatttccatattttttaccatttccatttttgtttcgatcgattatcatttccatatggctcggccggtagaaagtcgaaaacgaacgccggtcggccggtaattaccgttaccgttttcacccctatacctaccggctgccacaagggagcagcagggcccttacagaagcagcagcagccgctgccgtcgtcaccatagcagattagagcgatggctgcctttaagctgcggcctgcggctttgactcgtcccaataggcgtcgactcggctccagcaaaaatcgcgataggcatcggctcggctcaaagaaaaatcttgtgcggtcggtagctgtacatacgtcaccagttcgtacggtgtcgcacgagaagtgccatgcgaaactgccgcacagaatttttttttcccacccctcccccccccccccctctactcctacccctgaaatcacccacaggaaaaaccactcggaaaccgtagctaaagcccggaaaggaggataggaaaaccgtgcaaacggggccagcgagcagtaatgacagcggcggcactgcagcagcattgccagcgagctcctccactccacctctctctcttgtctctttcacgctctccctctcctctctctctctctctctctctcgctcgcttgctttaccctctctctctctcttcctcactctcactgtctcactgtctcactctctcttgcccacatttttttcccccggagagcgacaactgcagggcccaaaaagaggccggattctttggtgttttctgaaccttctttacttgtcctcaaatggccacctcttcctcctcctcctcgcatttcctcccatagctcgcattcgcattcgcatcgcactcaccctctcctgcaagcaaagctaaagcttcggtttggttatttcctttcctcgccgcttttttctttgcttcttgcggtggccatggcggtaaggaggaggaggaggaggagtagagccgcggcggttctggtggccgcgctgcttctcgccgcctccgccgccaccgcctccgcggcgtcgtcttaccccgcgagtaagcgagcgagcaagctctcggtttcttcttggtttttggtgttctactgtttcttggctgaattcgtgtgtttttttgggatggttggtggcagaggtggtgaccgggttgctgtccagcacggcgtcggcggtggtgaagcagctctggtcgctcaaatcgaccgccacaaggacgggtaattcgtctgctcctcctccttggagaaaagaaatttcagttcttgtgtgtgcgcttcttccggtttcttgaccggattattgacggtggtcggcggcggcggcagggtcggcggcggcggggaggtcgatggtgaagtacgagggcgggtacgcggtggagacggtgttcgacggcagcaagctggggatcgagccgcacgacgtcgaggtcaccccctccggcgagctcctcgtgctcgactccatgaacagcaacgtctacagggtccagctgcctctgtcgcgatgtgagcattgctagctcttcttccttccttccttcctactactagcttttcagctctgactcacagtcttcttcatgggattctgctaactagtactactttatgatgattgtcaactcgatgatgtgaggctgtgagtttggtttggttggtcagtttgtgattgatgatgtttgcatgctagattttggtccaggctagtttgtttgttgattgcgaaatgtttgttagtttcttgtttgcaattataggttatgatgtgattgtgctttgctacttggtcactttcactcccattgtttagggaaagatgacactggagttgtcctctatcttaggatttgactaaacaggaacctgaaaaatcattggtgaaatgaaatacatcgtaatttgtttgtccaaattagtacaaaagcttcactatctgatgtttttttttaaggcactgtacgaaaaatcggtgtcgacattttacttatcaattgacgcatttgagatcaccagattctgatgtatcttgtaaaaaatggatcaaacattacagatagcagaccgaagcttgttgctggttcgccggaaggattatccggccatgtcgacgggaggctgcgggaggcgaagatgaaccatccgaagggatttacagtggacgataggggaaacatttatgttgcagatgctatgaatatggcaataagaaagatcagtgatacaggtaagctaaagtgtctcttatatggggttgttgcacatgatactgtctggtccccaagcatcctatgtttgctatttggttttcattgtaactcttcagcacttgtgtccaaaggtgcatttgaaacaagttgtcagagtgcatggaaaggtcatacccacagttttaaatgccaaaatgatagtctaagtggggtgtgatccatggaagtgtttgtggaatcgtggttataaaactttctaatcagcatttgtcttatttacaatgtccccaagttttcagaaatcatgacatcctaacagttatgtgactattgatgtcagaaaattgagtatcacttgcttttgcaagttgcaacagtggaagagatgtcacacattgaaatgaacctcaaagtggacaggaagattacatgattggactttatatactagaatgatctcactcttgatatatagtgatgtctgtaacccatgacatcatatttactcattgagattgggtatgttatgagtgtgttatagacttgtagtgcacttataatgcacttatgcacatgcagccatgcacaaaacattttgtatatttgtaaggtagatttctttttcgtatgaaaatttatttatatgcttgcttttaatatctctatccattttaaattcttcaagtatacattttttttcttttaattaattaatttatctgttctgaaggaacttcatatttgagttttccttctgatgaactttgtttggacttctggaagggcctagcatgcatattattcacttagtcatgtaaatcaaaatgtctctgacaaaccgcttttatatgcaggggttacaaccattgctggggggaaatcaatgagaggtgggcacctagatgggccaagtgatgatgcaaaattttctactgattttgaaattcgctacatcagcagtagctgctccctcttggttattgatagaggaaaccaagcaattcgcgagattgcactccacaatgatgactgtgaatatcagtatgaagctggttttccactaggtgcatctacattacaataagctttctattagtacttcttgaccagacaatattgttgtcccattttctttttaaacaaaaatcgtctcagatctacacatttagtcgaatgacctacatattatatagataagggcatgttaaaactgtggacattaaccatttgagtttgaattcacaggcattgcattgctttttgctgctggtttctttgggtacatgcttgcattgcttcagcgacaggttttagggatggtatcaacagcagatgtaagtgcttcattttgttgcgttattatgcgaacaaaaatattgtttacgttttttcgaagcacaagaaatgtaaggccaagaactataagagcacagtccacagttgtactataaacaatgaatacagacctcaagtagatcatggtacagctttaaaatgaaacatggattgacattgactatgaaatagcatacgagcgtatggtcaaggacactgaaaaggtaacatacaaaataaagtaatacaatcaattttgttgtacctctagagtgtagactctagaccaatggtaaagcaaagacgaataccatacatgttctcttgcccgctttgtttttatttctaatttcatcgccaccttattttgtatggaaatttgaccatacaggaacctcagactcctccaagacccagcattgcaagcatccctccatatcagaagccactaaagccttcgcttcggcctccactgatcccaaccgaagatcaagctgggaaacatgaggctgaagaggggttcttcacctcaatcggcaagctcatcggaggagcaaaatcatctgcggtagagatattctcacgaaagaaacgcccaacccatcagtaccatcatcaccttcagcagcaaagagccaacccttggccggtgcaagaaagttacgccatcccacatgatgagacaccgccaccattggacatgagagcagctactcctcggaagaactacgccttcatgacgaaggagcctgaaaaagttcaccatgtccgccatggccggccttacttcaacggctgggacatgcagcatgcccctcagcaacagccagagcagcagatgtaccaccagcagcacctgcagcagcacaggcagtactccgcaggcccgcaaactttctacgagcagagctgcgagacgacaaacgagatcgtctttggtgctgtccaggaggtggacaccaagcggcgaatggtggagatcaaggccgtgaactatggggacacattctatgagcagtacgggatgcggtatcgcaacaattacatcggctacaacaacagcagcaacggcaacaacaacagctactactattaaacaaccaacccttctgccctcaattttccccctctctctttatccctgtttctttcctatatgattagatttaccgctcgcgttttcgcttctcctgacctccgcgacgcctgtaacaaaagaaagaaaaagcgggggggaagtagaggcactaatcttcttcagtcctgacctgtgcaatgcaatggcaaacacctggggaggggtttttgtactacaccctgatgatgatcagacactcttacactaccatcctgtacatatattttgttgttcaccagctcagctgttcctcaatccatgttggttgcagcaccaatcagtcatgctgtgatgatctctttgcactactgctgtatcctgtatggctgtatgttgtgttgccgcacccaccacctgatgagcagctcagctgcatcagtggagcaggcaggcaggcagctgccgagaccacctccactgtcaagaaagctttgggagtttagtggctgcatcatgtagcgttcgacctcgacacaggaaacttgcgaaaagcaccgcccttttttcagtcgatctttgcacatgccgatgcgcagcgagacgaagctgaatggcagcttggttgctgtttgcaaaaaaaaaaaaaaaaaaaannnacacactgcaaacagcgttacagcaacagtagcttctcactcactcaccttgcctcgtgacgccagtgaatgcactcaccgatatcaccgtctctccagtggaggaggacagccaggggacacagtcctatgtgaccgtggtcagatcagaagttttcagatgtatgtatgtatgtgtgtgtgtgaccagttttactgcgatgaggggtcggcacaccgctgacatgtatgtggacctgacatgtcggatcatggtgaaatgaaattcaagagtgaggacaaagcaatgaggcgatgaaaataaatcagattgtccatatctgaaaaaaaaattgagaagtttgtgagaggagaggtttactatggcacacaggtgatggtagatgctgtcgttgtagcaatggataatgtttgcagggatacgttgctgagaagccttggagggcagtgggcaccattgctggaggacagagtcgtacacttgtgcaggctctggaggtgtctctgatgtccatgaaagatagacatgtttctggcagattgctgcgagacaagcttgacgatgaacggtgacatgttttctgatcctctgctgcgagacaagctcgatgacgatgaaagacgacagggcctgaaggaaagacactcgatactgctactgcccattcattatcatgtggttgaatttacactcaaaacaaatgttgtcgatataaaaaaaaaaacaccctactacatccgtcacaagagagttcacttttcaacacgaatctgacaggcacttgtccagattcgtgtataaaagtgaattaattcttttgagaacaggggtaatacattatatcttatcccacccgattagtcgaatgaagcctcggcatgttcaagtcaagctatgcataccaaaattttgcttatctccagccaacaggtagttaatccaaggcaccttcttgctgctgtcactactaagccacctttatcttcgttgaggcagcgaactttgattcctctgtcatgctagctatttacttttcgttgaggcagcgaactttgattcctctgtcatgctagctatttactttcttattaggtagcaacacttcaatcatcactaataagagttcgctgaattatttatgaaaaaatggttcatctgcttcttcaattttcatgtcaactgtcccctctagatacatcaggaaatgatcccagtatctgaaccataaagctaccagctgaaaaagaaaaaaaaaacaagaaaaaaacatatcatcttcttgttttgagatcttccccaacgaatgatccttccatttcttggatcatggctaataactatttttttggtagataacatttctagtccagaatgtcagagaccatcatgagtaacaacataaaaagattagtagtaagatgtacctatgatgaagatagctccaacaaatcctgtcatgccccatctctcaccaagcatagcccatgcaaaagctgcaccccatacaggttccagaccataaattattgcagtttccgtagctgatacatcacgcatagcagccacctaagacaatgaaaaggtccacacaattaacacttcaaaatgttgtcctcaactgaagagaattgatgcagtgaggataaaatgttacctctgcccataaacaaaaggtagttgagaatatgcctgtgtatagtattgacaaccagggaaactgtatcatcacaccaaataacttcatcggtgactgtaattgtgaagtccactggtgcacattcttggcggagcatttaataaagaatgagactgcagatacaaatgctacaacaagcacctgggtttacatttcctatttagcacctcatctgtaacagagtaaaaaaaaatatcatgatataaattgcaaaaatggagaacaaacctggcatccaacaagagctggaaaattctctttcttcatatttcgggaaatatgctcagtcctgagcatatgaattgcaaaaccaaaggcactaaggaggttcagaagatcaccgacctaatgatattaccaagaaaacatcagtactccagaggaccgaaggaccaaattctaacaagaacgatatttgacagagaggaatattgtagtcataagtaaaatagacaaaaagtgcagacaaatttgttaacctgttcatgtggataatctgacttacacatggcggtgaaccacttaactccagaataccaaccccaataagggataaaagtgctccaatccatgtataggcaggtatttctgctccaaggatcccatccaagaaagggacaatgatcacctgaacatatttgagtaaagaaccatgaaaatctatatattctagggaggaccttattggactaagcttgagaaacatgtt

SEQ ID NO: 73218 - DNA, 1065 bp, Oryza sativa
aaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttcttttatcaagcctttgcagcagtcctttcacactagaattccatgtagtcattatgctagaagtatccgcataaaggtttgatggttataatctgacaaaatacaaactatctggtggcatccaagcagttattcaaccaaatatccttaaacatttgcaggtcatgaactcaataggtcaatcttcccttgcagacagatgcctaatgcctctgtagacatgtaagtatgcaacccccaggccccatcacatccaccagtaatcgctttgatcgattgtgaaacacagaggtgctgaatactcttcaaatgaatcaattcaataagcatatcttgcaaccaaggagatgaatagagtcacaaacaaaactctgcacaaacttatcagcggttatcatcattaaacagcaccttgtaaaaactcctcctctctctcctcttctcagcactatccaaccgcgctgcttcctcatcgtcctcctcctcttcctcctttatctcaatctcttctctccttctcttcttctcaaattatccgaacgccggcgctgattatactcatgcaggcccttctgcatcaacttcccgagcctatccttcgccgctaccaccggatcctttctcctaagctccgacccctcgtaacccttccggagcaccaccgtgtgt

SEQ ID NO: 73219 - DNA, 1656 bp, Oryza sativa
taagtcctcgtatctcttttgtcatcaagatcaaggaaaaattaactcatcccctcatgtatcaaaaccaagaaaacaatatacatgcatacaacctataaacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaaaatcatctttagtcccggttcgaatgctgtcagggcctgtcaggcccccccgggatctaacaccaaccgggactaaagatcttaactttagtcccggttggtaataccaaccgggactaaagatcccggtgatctttagccccggttggtgctaccaaccgggactaaagtcacacccctacatatatgtcttcttcctcctccagctgcccgagcaagcttcaaaatttcttcaaaaaagaggggaggtcatgccaaaatttctattgaatttattttggtgattacatacaaatcggagctgcctaaaaggtttacaacttcatcctccaatgtttttttttgtcatactacatttgcacctatgttttgcacactttttttgtctccaaaatttagttgtaagttgatgagagagaaaatgtgtgtgggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttataactttacaaatagcttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctagtaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccagggggaaacaaattgcccgagacaacgtacgaggctaagaagatagtctgcccgttaggactggaagttcataagattcatgcatgtccg

SEQ ID NO: 73220 - DNA, 10325 bp, Oryza sativa
ctaaaatctttccacttttggcagcagtgagtaagtcaaaaattggaccatacaaagctgtcaggttagttctattaggaggctgtgggaaggttttcaagctttccctgatccaatagcattgttcctcaatagatagagcaccaggtatgaaatagaatcctacaaaattaacacaagaaggatatcattaagtgtcacaaacattatgattttttttagaaatatgaccaataggaagtgcaatgtacgatgtgaagaatcaatattaaattgagcaatgtattagttgaattataatcaaatagactacataatatttgttgcagcttgcgcaccatctttctttctggatttattctaaatgaccaaacttatcttaaatttcagagtgagctctatgcctccatcaaaggtataataacaatacaagtctagcatatgttacataggtagtaagatggcatccaggaatgaatcacaccaaggatttggtatcttgctgctaccagagcaatcatgacaaaagtaacacactgttgtgatcacatacaaatcaagcaatgttgcgagtataacaagcaaagtagtagtatacccaaaacaatacttgaatcaaaatacattaggtgctaaaagagtatatataaaaataataagcaagtagtatgccaagaaagcatctatggagtatgatagggtgatcaaaaatccgaagctcccaaactagccgccatgaacaatcgagaaatcgaactgtgaagcgaatggtggagctcccagattttaccaggtcggtccaagaagcagaagaggtcgaacccggcgacgtcgcgcctcccgatcccggcgggcagctcccccccgccgccgccggcggcagcgagcagcgcgtggaagtcgaccaccgcggacaggtcctccaatcctccgccgccgccgccgcctcctggcttgctcctgcagcgctgcagaggtcagggcggctagatagatggatggatggatgcgtgtggacagggggagagagggggaaggagagggagagggatcgagaccttgccctcccgcccttgggcttcagcggcttgtagagcttgtactgcttctcggctcgccggaacgccgtgcgctccgcggcggcggcggcggccggctcggtgtcgccgtacatcgccggagggagaggttttctgacgggtctgtctgtgggcggtggcctaatggctgaccggtgggcccaacaagcgtggtcagggttttgacctgggaatttcctgccaccattatttttcacgaaaccaggtactccctccgttacataccggtacataatacaagccacaactattttttaagttacataatataaaacatgatgtatgcatacaattaattagaacatcttctctattaaattattacttttttaatcttctaccctcaagatctctaattatatttattaagatgatttaaattagaatatgataataattatttattggtctttgggttaagagtggttgtgccttatattttggaacggagggagtaataaactcctactatcgggtaatctatgtctcatattataagttgtttagctcttagtcaaagttctttagatgtgactaaattattgaaaaaactaatagcatttacaacaccagattagttttagtaaatttagcattgaatatattttgataatgtatttattttatatttaacgtattagtatatttttctataaacttactaaaagagtcaaatgacttataatataaaacagagtattaagcactgtgaaagtgatatataactacacccgaatcgcaacactactgccacaagtataaggaaataaaatatgcatgtacacggtattttctgatagcaaaatttaaaaagcaggtgcccgttgctcctcccaaccattgcatgccctgcctctcttgccttttgtatgttgcatctttatcctctaaaaaacatagatgactcaggattttatgaacatgttgaatcaacatatacacattttgtaaaacttcgctagctgagatggatccattagagaggtttcgtgaacttgttgaactaaggcttcccaagccaatattgtagccaaaactccactcctacccaatttccctccactttctcctaatcacagtttccataatcctcacaatttacccaatccttaccacctaattttcaaaccttccacccttttggtcctccagccaactatcacctatatggtagttctcctaactttcaaggttttcagtagcaagtaagttgattataatctgcgccgataagttttcaagatttttgtcctcaagaaagttgggtgcactcaccaaatcaagttgtcgggtctgtctcttctcattgattagaatcaacctcttagcgccctgcaagacaaaaagagaacaatctagttaacatcgaagaatcaagtgataatagccaagaggcaatgagttgaggaacacatgtcaattagactggagaagaaaatttacaactcctcagctcttggttcaataacaacacatctagcaataaccgtaaaaagagagtcatgcaatacaagacacattggggtggtgttaagaaggatattataaaattttgtcgagcttattcttgagctagaagcacctggagcagtggatactctgatgatatgataatgaagaaggcccatgcggtgtataaatcagaaaacaatgagaaaactttcacattaaagtatatgtggagagaattaaatgatcaagcaaaatgacaaaggattcttgaagaggacagcaagaataaagaggacgaggatgtacttcctctgcagctatgaaatccctcgtacgaaattttgtggtttgaggataattgtaactgtttctttcaccagatcttgtttatttgacgacaattataggtatttgaaatgtgcttcctacaaagctgtgttttaaatccagctcctcctgcagttcattgacgtgctgttcttgtagcccacacaaattcttcatcaaatttgcttcttgttctaatgtgaagtacagaactcacagaaaaccactttatgaagaacaaacatgattaattagaacatagcatttcatcacagctgcaagagctgaacctctggatgcatcaatctcaaacccaatattttttttaaaaaaaaatgggattatcacttcattattgttccaaacaaacaaaagaaaacaaacaggcagtgaaacaacaacaattcggtttactagtatacactttacaaactctctgcttgtctttgcattgcatcaaccatcaaggaattcagttcgagctatggaattgcatcaatccagtacctaaagagtagaaagatcaattcttcacattagctcagctcacactagctatgaacaaaccaactgcgcggtcgccgtcgccgtcttcaagaacggctcctgtctccggcgatgccgatggaagggggatctgtgtgctgcattgccaagaaccggcgatgtctccggggagcattggttattggtccggccatccttacaagatctgggcggggccggtcgagcagaacgcgtccggcgggccgccgccggcgacgcggaagtgccagaggcggcccttggcggcggcgaggttgtcctcgcagaggtactcccaggcgtaccaccgctccaccgtgcggtgcacatcgtgcacggcgacgtccaccgcctcccggcctcccgccgccgaggcgcgcgccagcgccgccgccgtgtagatggcgcccatccggccgggctccccggcggcggcgccgctcggcccgtccacgacgagcacgtcccacctcgcgtcgagcacctcccgcggcagcgtggtgatcagcgccaggtggcagccggacctgcgcaccgcccccgtcggacgccggcacgccgggctgtcccgcgcgcgccgcagcagcggccacgcctccccagccgcgtcgcggacctgacctggtggatcttggccgccgccgccgccgacgccgccgagccgccgcggagcgagcggccggcgctgtcggcgtcctcggcgctgtcggtgacgaacgcggtggcggcgccctccccggcgttgaccgcggcaagcgcggcgagctgcggggagaggccgaacacgagcagccggcacggcgcgcgcgcggcgaccacggaccggagcagtgcggcctccttgggcgcgaggccgccgtcccccacgtccgtcccgttcccccacgccgaggcgcggccgcggcgcgcggcggcggcgggcgacgaggagccggtgaggagcagcagcttgacgaaggagagcgcgcagaacacgacgaggacgacggtgagcacctgcttcggcgacatcaccttgctccctccgccgccgccgacgccgacgccgccgctgctcatctgcatcgatccggatgctcctcctccgatctggcctcttcctgtgaacactctaccgatgatttcttgatctggtcttcttccccattgatccgccagattgccacccagatctcctcctccttctctggttcttggattgggttgcttgctgctgttgctggtgtggcttggtgtgtgtgatggtgatgtgtgactagcttagctagctgcctagctaactttgtcctctaagcaattagggtttggttggtgttgacttgtttttgtgtatgctgatgtctttgtgccattttccagaggttggagaagctaaggttgttgaacagttcatgggggtggggagtcactttgctcaactattttcttcacaataataactctcataatacccgtgcgttgcaaccgatttattttaaaaaatagttcgtggcatataaattttaagtattcatattgtctaacatatagcgatgaaaaaattcataataaaaatatttgattctcataattttttatgtatctgattcatggggctaggggaaaaaaagcaaagtctcttctcatttttttttcccacgtgttagttcggagtggtggctgtcaccaccactactattttttaaattagtttttcttcacaatgatttattaaattgacattttttttgtttttagttctttcgtttgtttaattagtattattttttgtttgctttgatttgaagagatatttttcgtgataatttatttccctttgatgtgataacatggatctgttgagctggtggtacggtgcgatgggagtagtgtgctttgcaatgtacgagtgacttcagaataggagaatataagacatttttgtgttcattattttgaataaaatccgcagtatgttattttgtcgcgcttcttcataagttttccatgataattttttgggtaaggtaacaagcatatttagggtcaggaaacaagcaataaaatacgctttatgttacaatttttttccttacttttccattttaactgaggtgaataaacttgagtaattttttttataatagtgtaactttttttggaggtaatacattggaaaaggttaatgtcagattcaaattcttagggtacctttgaaacacaacaattgaaaaacggcggaataggaaaaacacatgattccgataaaaattcaagtataaaacataggaaaacatagaaatgactgcttgattggatcgcaggaaaaacgtaggaataagataagagaaataaattcaaagaaaatttccgcaggttgaagctcttgttaaatttcctccaaaatttctatataattgtcctttccataggaattttaaaatataggatatgattaaatcctttgtttcaaaggcatttatagaaaaaatttctatacgattcaaattcttcaaaattcatatatttttcttccaaatcaaaggcccatagatcatttaaggacagccacccatccacaaatctcctgtcagatccaggcccaatattataattggagaaaatgattcgggccgaatgttggtgggccttgtcaattgggtcttgtgtacctctgggcttgcatttctttttttttttttggaaaaagtatactggaggtccctaaacttgccaccgagatacagaaacgtccttgaaccgcaataccagacacccggggtcccccaactatacaaaaccggtcatccaacgtccctcggtgattttgaccccggttttgatctacgtggcggctgagttagtgtgggacccacgtggccccacatatcaggtgtccacatcatctttatttcccctcttctctctcccttcctcccctctcagctctctctctcgcaggccaggccgacgggttagggagcagacggctgggcggtggcgctgcgacggcggcctgcggccggcggcggcggcgtcgccctcttcttcttctcccgctcccgctccgtccttatcgaaggtgatcaccgcggcatcgggcacgattaggaggatgctcgaggagggccgcggcaacggcggcggcggtgaggacgacgtcgtcgtcaacctccccgaagtcgtccagggcgctgccctcgcccgcgtcatggagtactgcgaccaccaccacggcggcggcgccgacacgggctccgcccggtcctccttccctcccgccctagcaagcgcagcaagcgagggagcgcggcggccagctcctcgcggtggccagcgcgcagcagaggacggccacgccggacgccgacgctccggcctcgccggagccaatgaacgccgcggaaagcgcggcagcgccggccagcgcctcgccgtggttagcgcaccgcagaggatggccacgctggacgcccacgctctggcctagcgggagccgatgaacgctgcggcgagcgcggcggcgcaggccagcgcctcgccgtggccagcgcgccgcagaggacgatggcggcggagtacgggatggtagcagagtgcgggatgacggcggcgggcgggacgacggcttccccttcgccgtcgttgagctcgtcgtcctcgcgaccgtccgcgtcctcgctgcactccaccgccgcgccgttcgaggtgggcgctgccctcttcttcttctcccgctccctcctcatctccctagacgcccaactcgcggccgtctcgttctcggcttcggcggcggcggcgaggggggaggagttgtcggctttggaggaggagcgcttgcggtcggggtcggggacggcggcggcgagggagcccgggaggcggagggtgaggtcggtgtcctcgaagtcaagccccaacaccgcggacgactggagcggctgtgtgcgcctggtgcttcgactcacggacttcgccggcgttggtcttcacggcagcgtcgggtgcctccccacgtgagcggtcgacgaggcgcgcggcctcagcgaggtcgtcgcgggtgatgcaggcggcggacctcgtgcctcggttgttgggggacgacgtgctgggggcctcgggcctcgtggcggcagcggcgaggtgggcgtggtgtgcgcggccatcgccggccgccgtcacagcgccgccgctcggccgtctaatccctactcatcggcccggcctgtgagagagagagcagaaaggggaggaagggaaagagaagagaggaaagagagatgacgtggacactgacatgtgggacccacgtgggtcccacgctgactcagccgccacgtagaccaaaaccggggtcaaaaccactaaaggacctcaggtgaccggttttgtatagttaagggacctgcatatctggttttgtggttcgagtacgttttttatcccgatgacaagttgagggaccttcggtgtactttttctttttttttttctctttcaagtggactgggctgtactttagcttgcaaatttgccatgaaatgcaaaccttttgctcaacatttttatagtgacgagaaaaatgaaaagaggcaaggtagagggggggggtggctgatacgcgatcagccgcgcgggggtgcgcgcgcggtcagtcgccccctcctctagcctatatctaatctactactatacattatatgtatatacgtatgtatatgtgtatatatataaatatttttaatgcataaaaaatatatacatatatacaaagtttatatacgatgtatataaagtttatacaggacatatacaaactttgtatatgataaatataaactttatatacatacgtattaaaaaataataaaactaaaaactacacaacatatacaaactttgcatacgtatatacaaactttgcatacgcgtatacaaactttacatacgtgtatacaaactttgtatatatacaaatacaaacttaatatacatacaaatacaaattttgtatccatacaccttaaaaaaactgggaaaaacataacagaaaccggaagaaaaaaaaggaaaaaccaaccgaacagaaacggaaaaagcggaaaaaacaaaaaaaaacggaaaaactctctctcccttctcctccgcgtggcacgtccgccacccctctccgcgcgcgacacgtgtccagtcgcgtggggagaggcgcgtgcgactgttcgccaactagccttctcgaggtagaagaaccaaaggacttcgtttgggacagggaactatggtattcgtctggaactccgggcgaacctgaggtttcgggcaatatactatggcttggtgcctaccaaaaaatgcctattttgcaagaagtccattttgataccctcatagagtataacccgagtctaatatttgaccgtaaaaccagaaaagaaatacgtcaatcttcacctattaataccggatcaatttagctccatctattttggacattggttttgtcctatgcaacatattgaccagatcaacccgtgctaacgtggcttctacgtggccatatgtgtggtattacaaggtaaaaagatcatagtgagatgcacatgtcagcagcatcacctctacccactctccctcctccaggcgacccggctaccagatgaggcattgcagcgacaccagtgctcgatctccgccgcaaaattgcccggcatgtcagggtcttggtcctcttattcattctctgacctaagataatttatataatgaatgaaaatcaagctagatgcctagattattcaaatctgcaaggttgatgttggttatatcctataaatgtgtgcaacatattaaggaaaacatattctatacatataactttgggatacacataacatacacgcgaactaacaaatgatattgaaaattttataaaaacattgtcggtgtattttcaatagtattatacatatttttttacgtgagtagtattacacatattaagtctcaattttaatttcaatatattttagacttaaaacttttttgacaattttaaggatataagtatgtcaaattttttgtcttttttctctcttcaaaatatgattttgaagatgattttgaagataagactttatacataggtgtaatactattagaaatatatatacaatttttttctagatttttctgtttgacatttattagttagtgtgtgcatctgaagtttatttgcataagatatgttcgatcataatatgtatttcaattcagaacacgattaggagccatgcaaatatgaccaaaatttagaacgtgtccatgctaatggtattttctaataatcttaaaactatttgcatctgaaatgagagatatttttgtttctccatacataattaggttcattttattttgacgtaatttttttcctttgggatactagaatcatcattagtttaccacatttttacgatttaaatatacacataaatctaacatttcttattaggaagacatatagttatttgtcacaactggctcacaaaatatgtcccttcaaatacctggggaccaaacaagcaaggtgacaaaagaaactagctagatcttcatacgtgtggccagatcgactgaaaccattacaaaacttaaaattcatcagtaaagcttcaaacaagataaactaagaaaagtagaggagaaaacgacctgaaaaactaagaatggtagttttgaaacaaaacaaaatgaaggaataacttatagctaggagcgaaatttaacttgcatttgccatgcatggtaatgatcgccatggtggaggaggcttcggcgaagcatagctaggttgaaggcgatgtccttggactatcagtcacatatacacttcagctctgagagcaaggataataatacagccgatctgttgactataag

SEQ ID NO: 73221 - DNA, 515 bp, Oryza sativa
caaccgggactatagatttagtcccggttgttctcaacaaccgggagtaaagatcttttctttactcccggttgttctcaacaaccgggactaaagatatctttagtcccggttgttctcaacaatcgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagtgccgccgccgccagatctcccttcatgcatctcgatctctccgatctcgatctctctccgtcgcgccgcccgccacgagacgtcgcgccacgacgacgacgcgccacgccgtcgtcttcgtcgtcgcgcaacgccgccggcgcatgccaacgccacgccgccgc

SEQ ID NO: 73222 - DNA, 12261 bp, Oryza sativa
tcctgcacccctgtccagtgattatatacatattgcatgcaatggacgataggatcggctctctgtcacgtctgatctcgatcttgttgttacaaattattctcaacacccagagaagtagaggtaaattcgactttaatgttcacttgattgaagcaagttacaattcgtcatgtagggttataatatctaccatcctagctagcttctcttcgtcaattcttcttccttgtttgaacattggatcttgaaacgaagataaattagttgagaaacatgactagaagcccaattatatccatacatttgacccgctggatagttttgtttggaagcaatgatatgatatgcaacatgtgggatccaatcattatttgattttatagaaaaacatctcaattgactatatatattgatattattcaactttcatatggtttaaacagttacatgctaaatctttggatattaatttgtcttcccaattactacataatcaattattagtaattatgacaggaatactcggtgaaactaattacctggccatttagtttcattgaaattagttaaattagataatgccccgcgttttgttgtgggatatatgttagataatggagaaatgatgaaatgatttggattgaaatattatgaaaatgatttgagaatgatgatttaccatatgtatgtttagttttagaatgaagtaaattatagatgtaattactatatgcttgcatgttgagctttgtattcttaatgggttgatgtggtatgcttgcatgtaggttttatgagtgctaataaatactatgcttccatattgagctttaggtgtttagtggaacataaggtttatagaacgaagagatatagattgtatcgatagccatggagccagctagctaagtaatttgatttctctatgttcatcctagtgaattcaaattatgtcatttggagctagctttcaagttaaggatgctgacctagttaaggcaatcctttaaaacttattgcttaattgtgatgtcattgggagaccaaaatatgtaatcttggtttacatgtgcatatatatagtaagcagtttaaaactcaattttagggttgatttcgaggtttttttttctattatagtttatttttcagtattgacttttacactgctaagaacatagatacataagttttccccactaattatttcttgttgtttaactccaatttcaaccgcttctcagcatagatgaattaatccaagcatttttttaaaaaaaacatccttcatatgccttatacctttttttggaatgttgcaattttttatgattttaggaaaaaaaatccatacttgagcaaaaacataaaatatatatactccttttctctgcatatcatcaatcaatcaatcgtcactctatctcagtggctgtcctgatagctgattgggccacatggcgcccttaagtttgcaaatagatccaaaggaaaaaaaatgctaagaggaaataaacacttggtaccagaaggggctagaagagggttaggagggtgaccaggttttataaaatcacgtggttattatgcagttatcgagattattacatgcgataaccttctcaatttttgaaaccacatggtatatctcacagtaaccgccgaactgtgaagggggggggtggtaatcccatcgaaagcggtttggtaaaaaccctagaggcgacatagataaattgatatagacaaactaaatactgcatcaatatttttgttttagaaagtgtgttgcatgatataacgttgtaatagaaaattaattagattataaaggaaaaggtacgaattacccccctcccaaacttttgcggtcatccgaattaccccccgaaccacaaaaccggatatttttcacccccaactatgcataccggacgaaatacccccctcaatccaatccgcggtggttttagcctacgtggcgtacacgtggcagtccagtcagcattctattttaaaaaaattgtgggacccacatgccatactcctcctccactcttcctctctcttctttctctcactctggtcagcggcagccgggggacggtgacgcgggggcggcggctgagggcggcggcctgggcgcggagctgcggcgccgccgtgctggtcacccacgacccggcgctccggccccacgccaagatggagctcggctgcctcgtgcacgccaacatcgctgccaacgacgacgcccacgcctgcacgctgcagcgggaggacgacgacggcagcggtggacggtgacgcgggggcggcggctaagggcggcggcgtcggcacagaggtgtgcgttggcgaggtggacgaggcccgcgcggccgcggacggcgtgcccgcgcgccacgagcgcacggttgtagcatcggagctgcctggcgcgcgtgcggagctcgtcggcgtcggcctccctctccggcggttgcagcggcggagccgcccggcgcgcgcggagctcgtcggcgtcggcctccctctctggtggggcagggcggcgcagaggcaggggggcacgaagcgtcggcggcggtgtacgcgtcgcgctcttcgccgaagctgtcgtgctggtccactggtccgcatccgcctcgtctcgcaccgccgctcaccacccgcctccgcacgacgcatccgccttgtctcgcgtcgccgcctcgctcgcaccgcccgcctcccccacgcgccgccaccatcgcccgccctccccgcgtgccgcccacccatcccccgcgcgccgcccgtccatcgcccgccccgcgcgtcgccgcctcgctcacgccgccgcccatcgcccgcctccacgcgccgcatcggcctagtctcgcgccgccgctcaccgcccgcctccgcacgccgccacccatcgccagccctctccgcacgccgcctccgtctcgctcgccccctgcctcgctcaccatgagacggtgatagtgagagaggaagagtgagagtgagaagtgagagagagtagtgtatgacatgcgggtcccataaatttttttaaatagaatgctgactggactgccacgtgtatgccacgtataccaaaaccaccatggattgggtcgaggggggtatttcgtctggtatgcatagttggggggtgaagaacatccggttttgtggtttgagggggtaattcggacgaccgcaaaagttcatggggtaattcgtactttttccaataaatgaccgttcaactttatggaccatgacatttctaatcgtgtctagcatattattaaaaccaaaagagggcatattattcaggttgagttgaacattttagagtagccaaattgaaagtgattgcataatcctcactaaggtacgaaattgtttgtcaaccaattaatataccatacaatatattaatattataaggtagatgtaactatgtaagaaaccgtgggtcatgtactgtgtgcgtacatcgtcactgatacagataacaggtacatttctccatgtatggccataatataataaaccataattgacctggtaaaactatagagtttaaccacagaagcttaattagctgaactctatctctgattagttggggtagttggtttctttacttgcaagttcagtaagtgacactcctgtgaagtaagtaagtatagtggatatatccatatcatgcagatgcaccttaatccaatgtaatagtgtcaagaaagacattgccataaataaataaatattattaagcagcataattaatcaattggactgcatctgcttaagctggtcaacgcgataattaattgatccatgtctgtctgtcgtttttccacaaccaggcaaagatttctggagatcttgtccctccattcctctcacgttgatttggacagaattcatgaagtgagtaaattaacatgattaaattagcttattgacaacgctagcttctcgttaaaaataactctccgaagcatgcttggtcgacagtaacatgcaagaatagacagttaaaatagacattcatccatccttgcatgcatgcgtttgggatttgcaagtttccttcttgaaaatgatttatttatcatgatcatgaacacttgttgattttctattgtagtagtagttttttttttaccactagtagttttactattgtaatttgaccacaagtttatttatgacaattgacaaataatatatatataataatcttacaattttccaccttttatcattgtatatatgcatatgacaattagtccaatatttagttatctgaatgacagcaatttccatagaatttcctagctagtccaacatacacgctgccggatcagatcattaactgcttctagagagtttttgtctatttaattttctttgggccagaagtctaccagctgtaattatggtacatcagcctgcaagacttcaattatatgcatataggtatcgtcatggagagttgaataaatgaacataactgtatatatatgttacaaatgaaaaagaaaagtatatgttacaccatataaatgtatgctcgagtagaagaattttatctttttttcctcatggttttgtatcaaagcaaaggtcaacaccatgacaagttacttaaccaaaatgacaaggaaaataattcaattaagaaattaattaatttgtggtagaagtccattattaacgttaattgtggcaacttgcttttttttaattatttgagatgtatatatctgaaactgagtaaatcactggtgtcctagcattgttgctgcttcatatagcatatccagactaagtaaatttaagctgagttctaacttctaagttcaggctggggtgggctatcatatcatttttcattagcaccattaccaaactactaaacgctgcaatttttttaaaaatcaaataaatatattttcaaattataataactaatacttaattaattatgtgataattactcatttcatttcccgtatcaaattttttttaaaaaatcaaataaattatgtgataattaattatgcgccacgtatcaattttttttaaaaaatcaaataaatatattttcaaattataataactaatacttaattaattatgtgataattactcatttcatttcccgtatcaggaaaaaaaaactcacctctaaactcacatttagctttagaggagcaagtttgttaggttgaactctttctagcaactcaaaatagcatcttcctcatttcccattagcacaattcctaaattaccaaatgacatgttttgtgtcgttaaaaaaaaagacatgttttgtgaaaaatttcaacatagaagttcttttttaaaaaaaaatcaaataaacagtttttcaagttaatacttaattatccatacgcaaattattattcttgttttgttttgtgtgtagggaaagatcaacccaatttgccttgtcgaacatacccctgatcaagccacacgaaaaaagagaggaggtcatgctaatttggccaatcttctacttgtcataggaggtcatgattaatgatcattttcttttctgattaatgaccctaatattaatatactagtattttagaacaagctaagcttagtcagacggaaaaaaaaaaggaagaatctggaagatatttgtacttacagtgggacccacatggtgacgtgtacgcagtaactccaccacagcaacttgcagtccaagatgggccaagctgccgtcgccgagggagcacggcaacctgcagctgaaggaatagtccaacgtacgtggcgctgacgtggacgtttgccagcacaagaggctggcagcttggcagctgacgtcatgtaatctaatggaaaatttcatctttgtactgtagaacttaagtagcttcaattttattaaccaccttgagattataaacattgtctccctctatttaaaattatttgttattctaaatttgtttttaagtcaaacatttttgacaaacaatttctataaacttatataatttaacatcgtaaaatttatttttttaccataagaaatattttcataacataaattgaaatattggtaactacatggatttctaaaaattaatcatcaacgataaacatggttgattaacaaaactagaacggcaatcaatttgaaacggaacaagtagaatgcttgcgtgtcttgtttcacttgtacgtcagtgaatttaatcaaacaagtgatgatgggattgtttgatcttattggcgatactgttgttaattacttggctatctcgaattctagatacattttttcttatactactactagctctgtccgtatcactccactacgatgtcatttctaatggatgaaatctttacctacgaactttggcgggttgagggcccccgtgccgctccaggcgcaggggcgacacgggcggcgaccaccgccgccttcctccctcctccgcctcgccgccgcccgagcagaccaccggaaaccgcgcggctgcgaggaaggcggcggcggggccttccttctccctcgaaggcgtgggtcggcgcccacgaccctgaccagatgggagcgacgacggtgcggcggtatcggtgtcggtatcggggcgtcgggctgggcgcgcggaggcgactgggtgcggaacgggggtggcggcgacggtgccggatttggcgtccctcacaagatccagcggtttggccccctcccgagacgacggcggcacccaaggaggtggggaagggagatggcatgcggtggccggggaaggtggagcagcagcaacggcgctcccttgcgtcgcccacccagggcggctctctagatccgggctgggggagaggtcggtgccggggcggcgcggagaccggcagggggcggcatcgcggtgggcgggcgacggcagtggccatcgatcaagtcgaagctgctcgctgatgggggtgcggcgatgcttggcaacgatgatatgttgtagtctctttcaaggagttatggtgctggccatgtgaaggaagtggctcctcggtggcttggctgatgtccattgttggacgtcggagccgcttttcgctttggcaactttcgtcttcagtgtcgctacggttgtgaagtcgacgctgctgggtcgctagggtgggtagctcggcaacgataacacctcttctgcgatgtgggagttgttgtgtcgcttttgtatttagcttggcattgacgtcctgtgattgggctcctccgtcattgttagttgtgtagcggtgggtttataattaaccgtgcagttgtatggttttcaggcctggttttccttataaagtgggtcaattctcttgttttaaatataaaagatgaacaaagttccgccttaggtttcaaaaaaaaatctttacctacttaaaaaagcgaaatctgcttccaaccaaaatttcatccgtccatcaaatccaagcgccgcttggtgattcattcgcgtcactctgtgtgcatgcatccactaacacccgattcaaactcccacgtgtgtgtttctattccgagttatacagaaatggattgcgacattttggatgtggattcagtccgattttgggggaaactgaaagaggagattgagtgaatcaaaagccctccactaattttggaagattgagaaagattcgacctgatttgatagggagcatcggctccagtatcgtacgggtacgagactgtcgttcggaggttgaagacgctggtgtagcgcgtgggtatagtttggcaacgagaggaggtagccgagtatgctagctgggtctgcggctccacttgttggctgaaccggagaggcagactgagcggaagtaagagttgttataccgctgagaaaacgtttttacttgttgcaacacactgacattttttctagttaaataaaacaagaaaaatacaattaccttggtatccaattattcatgctttaggtgcatggtattactctctccgatgagaaaatacatgacatatgggtttttcccccatggtctttgatgtgcgactttgctaacaattttatattaaagtaagcttacataatctaataaacttaacaggttgtaaaagtatatttcaaggaagatctacaatcaccatttttatgttttggttaaaattaatttactaacgaccaagtttcaaaatttaacctgatattaccaaagcatcgaatatttattaccggatggggtgcatataggagtattgatttctgcgttactttgctgtatgaactcctctatgtgtactaatgtctgactttatattttaaatgtgggctttaatgcttatcacaagaactggtggtatatgtgactcttgttttaattagaaccaccaaatagtactacttcacacgtgtttgatatgtcttcgtgaagttagtgggaaatccaaaaatcaaataattacctttatctgcaatatgctaggtcttagactcagtagaaatatgtttttgacaaagctccaattaagtctcacatgcgagtgctctttagacctaccgattggtgctgacattggtcgttattgcaaagttgtgaagatgataaggacaagatgaagcatgtcgaactttagagacaatggcgacacaaagttttgcgctctaaggtttaataataggctagacttatttgagcaggtttaatagcagagcttgtcgcctgcagtaaatttggccatgtcatctagagctttagtttataatacttcatgcagtagggagctgcactatatggtctgattatttgtcagtactttggatacaccaattagtttgccttctcttgaagttcacgtatagccagcgacaatataagcgttcattcacactctctttctagctcattgcttttgctagactcgatattttaccaccagtttaattattctattgtacctgctctattatattaccaaattttattcgtagccttatgtcccgcaaaaattgtaataattggtcgtgaaattctcaaaagttttgctcatagaattttcgtgaaacatgctaaattgcagtctaataaaactagacaacataacgggctttcacggcccagcccacgacatacccaccattggccatttgggcctggattgggcatctccgaatgacccactcacagtctcgctcgtcggagcagaagcagccaagaaaagcggcggccatggcggcggcggcggcggcggcgagcaccacgagcatgatgacgaggccgcagctgctccacctcttctcccgcttctccttcctcacctccctcccaggtcagcctcctggcctcttcttcttctactacttcttcacctcctaatcctgtgtccccttttctctaacctgttgtttttttctcttcctcgcctccggcttgcttgcagaggtcaaggcacggatcgccgacgccgtcagggacaagcaggtgggggatttgctcgccgattcttgaacgaacggcattcgatgccttttagctgttgggggaatttatcggatgggggtttctttgtgttcttggaataaatgaattcatgacatgctggattttatgaaccagtcttctttgggggtgcgattggaacagatgagcttagctagatatgtgagtccgtggattgccagagattttgcagaaattgttgtacttgactgtgtgaaattagcttagctgcacttattagtgaaaattacagaatgttttgatgttcctgtaggaggctgtagcggtgaccaccgagatacaggaggagattctccgcgagatgggaatcggtaatgctagtgtgcgttgtgtttgagaaatatgttgcaacaatctctgatgcaaattagaggttgatacactttgtgatgaaattgaaaacgttggaacttcattcattagaagctctttttctttttttggttaagtagctacttatatttgttgagttaattcacttgcttgaattgtcgatttcttgtatgttgtaacctgtaagaggcactggaagaagtgttcatataataattattacagactttagggtaatagagtggttcaattacataggatgcagacctaggaagagaacatctgttattgcgataattattcgttctaaatagcactgttgtcacttgacgtgatattttgaacatcagatccaagttttggtattggctgccttggaaaggtgaacgttatgtatgaggatgacatggaattgatggttaagttctatcagtttgttgccaagtaagcacattccaagcctctcgataattttagatgtgtggtttcatgtattagttatatgtttccatggtatttaataatatcggatatactaattttgttaaataatcaaccatctgcatactagagatatatttgaacatggttcaaattgatgaatctatctggtgttacttcaagttttcttgtagaaagagaaatttgatcaatcaattagggcacaaatcataatgaacagctagcataataagaaactgtagcaatacaccaatgcctgccatatggcaattggcaagaatagttagtggatggcatgtttgacttcaactgttgtcaactactctagactcatgttaatttctatcattcaatttgatagagaagagatggctattgatgaagctgagcttgaccctatagagtttgctgaaaaaatacatgctcagcataaattacaggaacaggtaaggcaaattcttattacgaagattttcaggaaaaagaaatgtctgtcatgtttgtttcagggagctaatgtcatggtggattactattacagcaactgaagatgttgattcagatgagaaaatataacccagagagccaatccgtcatactcgaaactgtatgtgctcttactactctccctagccgttttccatccctcaccgaaacatatctcagttggacaaatttatgaatttcgtccaagttcattatcagaagcaatttatgcttatttgtatctaatcatcgatgcagttgcgcaaacagttggagagtgctaatttcgataccgacgcgtcgatcttgactccggagcagatccaagagattgttgagaactagatcaaaaaaccatatcaacagctattgtgcatatgttctgtttaaatctgattgctgtacatttctattgctcatacaagatataccagcttaattaagtgttactcagctctcgccatggtttatggcatccattgtgttatcgtgttaacttttgtccacgtatagtactttctatacataattcaagattttataccccccaaaaaagatcaatcactgaaacaccactaagcgcatacttgtcttctgatcccattgacaagatcatggctactaacaagataaagctccaggaaggcacatgtgcttactgctagctcattgtgtgtattttcataacattttactgtatctaagattgacattatgatccacattacagtaaaattataacgagagttttttctttcatcacctagatgagcatgcaggtgcaggtaggcccaaagtgtgaccagcaacaacatgcattttttcccctcgaatctcttttaatttttgtttctttttatggtttaacatcgttgcaagaagcatcaaatcgacacacaacgaacctagaaacagcataaactcgttattttggaagtgcaatgcaggtgtaaaactgtccagtgggtaacttctgagctatcacgcaataactcgataactaacttgcaaatgtcttgcattagcaggaaaaatctgagggaaacatcaagctggagttgagacaggtcacattggccaatccattagtaaagcctgctccagggtaatcagtgatcaaacaaacaacttgtcctaagagacccttttgatggtcaaagaatctttttcatggttagtttggacataagggattaaactgtaaaatggatccaaaactttcctatctttccacaaccggtctactccaactccagaggcaatcaatcagactatcgcactatgtgagttgatctggggaggcagcagaaaggcagcattttacaacacattctcttaactgtaacaaaagaattgactgatcagtagacttgtctgatgttgatatttatccttgaattttgaatgtagtttaagagggctgcagga

SEQ ID NO: 73223 - DNA, 5985 bp, Oryza sativa
gccaaccgcagccccgatgccgccacaccgccgttaacgaacgagaacgagaacgatcgaacgactgagagtgagaacgaacacgtcaacgtacgttgccgcgagaacgtgaacgagaacgagaacgatcgaacgaacgagaacgatcgaacgaagacaagcgagaacgagggaacgaacgtgaatgagaacaagcgaacgaacgtgaatgagaacgagcgaacgaacgtgaacgagcgaacgaacgaggacgaacgttaacgtgaaatgctatatatatatatatatatatatatatatatgttacttcgcatttatcctaatacattttttgtatcttgcagaaaagacgtgttgtcggagtcgtccgtcaagcctgagtggaagagctagccctagaaggaattggagcaggcaagtgacgtaataatataaatgatcgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcagccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagaggttcaagggagatctgtaccagaagtatatactgaaggggcagacaccaaacttcgacacattcccaaagctaagggatcactgggacgagttcgttgcatataagacaggcgaacaagggcaggcgatgatggaaagaaacaaagaaaatgccgccaagaagaagtaccatcactacttggggtcaggaggctatagcatcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagtttcgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctatcccgttgatgacatcactcagcggacaccatgtgagctgcatattcctttcaagaacttatcaataaaggtaagatttagccattccgctagttgctgcttatatatgttgattactaataaataatatctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaagcggtacatcatcctccctgggcgacaagcggcgtctcgtgcaccatctcctccggctccgccatctccttgtcaggatcctgcaccgtctcctcctcatgctccgccagcaccgtctccacctcaggctccagcatcgactcctcctctggatcctgcaccgactcctcctcgtgctcctacacctactcccccgcaagctcctcttccggcaccttcaaagtcaagggtccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaatcaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctagacgccctcgacgtctctattatgagttgctagattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcgacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtattggttccgtcatttggtccgcggcaaatggagagaaagacttaggcgaaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagcttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagctagtactactacgtcgaaatcgtagctagctaggacatataatggattgtaattaatatatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatgtatgcatatatatgtattgaaacatatatatgcatggtttatactagatacaggtacatatatatatatatatatatagaccgttcagcagcaggggcaagctcaaccagaaatggacagatcgatctttagtcccggattggtactcccggtttggaaaccgggactaaaggggggttacgaaccgggactacaaagggtttctccaccagtgaaatattaagatgattgcttaggtttcagtcaataatttaatttagcaaggtaaaacgaaaagacaactattccatctaagtctagatgtatgaaaaactacaaataaaacctatctcatttggaaaacccaagacataaaataggatcaagcttttttggatggagagggtatttacaccattgataaaattaatacatacttaattactccaaggttaatagtaaacccaacagttagctattcatttgttacaacattaataactagccttatcacattatccaacaaaatttcttagagtcttgtgtgcatctggctgcatatatgcaattaatccttttcccttcttcctcctctcctcttttcttcaactccacacaaaatataaggtggcaactcttaatcaactatagtttacttatatcacttattatgtatgctcttagttgtagctgggcatatagcactagtagcattaacgcactaaaatccaaggaacaaccttttcgatgttttcatcagcatgacctaattatattgtcaaccaacaatcttcaactggaggagtattagatttatattccttctgtctatattctggacaggtctttgtccaagactagaagcaacaatattagagtaacagtacctgaaggaaagaaaaagtatacattgcaaaacgacgaaatgaagatggatcgtcaattcatcatactcttgtctacaaggggatgagaaaggacat

SEQ ID NO: 73224 - DNA, 22526 bp, Oryza sativa
gtctccttctcatgggtggtgtatagcttttggcattatcaactgttcaactccctgtcagtcaagtttgtcacctttttcttttgtgttgtgattattgattacttcttatatttgttatctatgcaaacgctttgcacaaacataaagctgtcgcagttggcagaatttgtgttgcttctgtgccattgaaagtttcaatcaattggcatcactgactgctacactgcagctgtgcctgttcttttccatctagatctagaatcggatgtaacatatcctaatattataaatcggtactgtgttggttttttatgggacgaagggagtacacttcttctagctactaaatgctatatttttcttaaaaaactttctacatatatatttcttaaagttattattttaaatctattttttaactttataatagttaatttatccgtttgtacctctcgaatcattcatctattaagtattccattcaggtcaaaagaagacacccaattgaagtaaaacatgctagctgtatgatactttataatatatgattagtgtattttgcttgcacttggatgaaggggctattttaatattagaaaagattttgactaatggtgatgcctcgcttcgggatctgctcaaaatatgtttcttcttttctaaaaattgtttttgggtacagatggaccgtgtaaacagatcattgttcaaagccaactaggaaagtaaaataaaaattatttacatgttaaatgttaatgactagttattgactgctgatgaatgtgtttaacatgtgaattatatattatgaaaatatttctaataataaatctaaaagtataaattttatgatgttaaactatataagtttatagaaatctatggtcaaagattaaaatgttacttaaaataaaaacaatcctaggacgataaataatttgaaattgagggagtaccgtgtttgtactctagcagtctgactctaaataattgaacaatcatgaaaacttggccagagaacacaatccaataagtaaggcccccaagcttaaagttattccaaataatgtatttgactgatcattctgcaagcagtgaatatatatatatatatatatatatatatatatatatatatatatatataatttatttggtgctctatggtgcccgggctacatgattcaaattgggtatatactcaattcaaatgagtatgaaatttttaaaatgtttaggtattaacattaactactttactaactagttcaaaacaagtttaaactaaatttaaacttgtttttgttagattttgattctaggtatataggatccaatcatataattagttgggtatgtaatcatggattgtgaaataaagttaaatttgagttgctttgtttataggtataggtatgaatcgaattcttataactaggtatatactcataatttaaaaattttgaaaaatttaagtgaatttttatattttataccatggtgccccatatgggtgtcctatatatatatatatacatacgtatatacgtatatatacgtatatacgtatatatatacgtatatatatacatacgtatatatatatacgtatatatatatatacatatatacgtatatacgtatatatatatatatatatatatgaatctcaagtgaagtcaatataagaaaacgttttagaatcaaaaaaagaagaagaaagagaacatttcaatctgcaaatttccctcatgtacttcttgtttcatgcattccattccatgttactccgtgaacattcctgatcatccacactatttggcattgtatttctctgaccaatgagatcacgacaagtgcaaacgaaaaaactggcaacatctacatatgctctcccatgtgcattttgcagttttgactgcatcaatccatccaacacaaacactgtatatcttcatcttgtgctgccatttcagtttttaggagtggtcagtcctggcttgcacagaaaaaaaaaaagaccgtgaatggtcactcacaggtggggcctagccgcctaggaccaaccagccaaacccagcatgaggaaagccacccatagatatagcagcctacttacacataaaaataagagcttatcataataagataagacatgactagaaattacatattcagcttaccagggtttaagtcctaaattcagtgcatttttcaaaagaaattctaacactttccgaacgaatcatctgaaacaacacacctagaactctcatctcgagctggctcaagcgagattataaaccctcattggtactcgtgagcttccatttcagtttttaggagtggtcagtccttacttgcacaggcgaaaaaaaaaaaggccgtgaacagtcactcacaggtggggcctaggacgatccagccaaacccagcgggagaaaagccacccatacacatagcaacctacttacacataataaaaataagagcttatcataataaatgagccattggttatatattcagcttatcaggatttaagtcctaaatttgatgtatttttccaaagaaattgtaacacattccgaacgaaccatccgaaacacctgaaactctcatctcgaactggctggggacgtccaaaatccacgagactcgagtgagatctcgcgacatcataaaccctcgttggtaacagtttacaccaatttcaagacacgtgtataaaaatatgcacgcggctactacgaacacggtgcgtgtgtggttgtgtgcgcgcatcgtccagagcgaaaagtacactccataagagaggctggggattagatgataaaactaaaactaaacaaacagagcctgggctgtgggccattcttggcttggatttactgggacagttcttccctcttggatcaggaattcaggaggggggagcttttggccgaattgatcaggaaagatgcagctagctgcagcgttgcggtggaccaccggacggccggcgacgaccactggttgtaccgtggtgatggcatgtcccggcatgggaagctagcaagtgcatttcagatttttccaggtcccctcttctgctctgttgctgttgctgtgtgtgtctctttgttttttatgcttgttcatcggtcatatgctaagggaatcttttaatgctgatatatgaaggcccatgtgttagagcaggtacaatagcaggctataagcaagttataaacatattttaaagagataaaagaagatagagaagagcagcgggctacaaatctgtagccaactgcagcacggactccaaaacgtaatgcgtgtatgacaggtaggaccagacattaataatatagtaagaactattgtatgaattggctatagataaattggagctagtagttggctatactattaaacttgctcttagtgtgggtgggtgggggtggaagagtcttctctccaagagtaggactatcatttttctagtggttttatagggtttttcaccaatttattttttcacaggtttggaaaatagtttttcgaaatctaaaataggcctgagattcaagatactggggataaatacgaacttcattataggttgctaagtgtcatgtgtaagatagtatatgagttggcagctcttaaccacaacataccatgttgtaagctaaaagatttgtaaaataagattgttcacttttttttttagtattatcaaaagttcacacttagtaagataaatcaggtggctatacaggcatagatgccacacgaacaaacggagaaaatttttgtacattatatctagaagaggcagtatgttgaaccacatcttggattaggagggtggccggctgactcagcaccaacgagtgccattgttcgttgctgtaaaccgctcttacatgcttcatcttggtttgatggccacacaaatttaaatgaagatcaggaactgaattttctctttttatatataggtgtatgatgttgtgccctgttttatctaatcaaaagggtttcttaccactatgaaaataaactgtaaggcgcgttgatatcactatcaaatgcacaacctttttttttttaagagtgaacttcataaaactataactattttatcaaaaatgttagtatgctgaaaatttagctagacattttagagaacgacaataatattatataattttattagaaaacctcatctttacatctttgacaagtttgggtctcctgaaatacttgtgctcttgcatcccacatgacatacacacataggagataaaattatagttttgtaataaaatcgtccactattgttgcggttttgtaaaatacattcccttaaaattatagcaaaatgatagttttcatcaaacaattatagttttgtaaagtccacttttttaaaaaaaataatgaaactagtacatgcatgtacatctcgatggccagtgcattgtgtagtatttcctttaggctgataatccttgtcgttttagacaaggctattgttaaactaaaaaactttgactataaataatatttaaaacatttgtcaaataaatatggctcccatatgtataggttgatcttaaaaagtgctctgataaaattatatacttattgatatttctatatatatatatatatatatatatagagtaataaaaaatagttatcaaatttattttttgaaactgtgtccttgttcaaaatgataagtattattagtccggagggagtagtataatccaaagttcaaactctttgtttaatatagaaaaaccttgctttttgactgacatatttcctccgtcctaaaataaatcatcttatagagtttattttttttcaaaataaatcaacttctacattcttacctaccattggtctacaaataaaaaaaattatttcttcaataccctttacctatccacccatgcattaatataagtttataattaattaggggtatttgggtcgtccattttgggaatttaggtttgaagtatttgtggaacagatcgagggattatttctctagctatctagctaattaattcgattcattcatcagtttttatttgtagggataaatgagccatgtctgtactgcaaactgcaaacatggataggtcaaaaaccaaagtccacaatagctgaacagctagcggcgacaaggttccttccacgctatgaataagggtgctgcatggcacggcaaaatcatagtacgtaagtacatgctacatgcatattatgattgcatgctggttcacatgcggccattatatactccctccatcacataatataaaggattttaagttttttttacattgtttgatcagtcatattattcaaaaagattgtgcaaatataaaaaaacgaacagttgtgcttaaaatactttggataataaagtaagtcaaaaaaataataataattccaaaattttttgaataagacgagtggtcaaacagtgtaagcaaaaactcaaaaccccttatattatgagacggacggagtatatccgagtgcaacaagaaaccatcatatgattttttttttctttgtgatgaacaagcctgccattttttagtgctactttatttggggacaaaaaggttccaagaaaaaaaaaacatgagggaactaattatacctagtacaccaacaaagttagggtatgtctaataatagagtcaattatcattatttatcaataagttatgaaaaaaaaccatcgcatcgttatttacctttatttcctagaaaatgaaaactatttcttaattagcacccgctggctaggcaatagcaatatgtaggaaggtccttatattgtttttccatatagctcctagcatattacagatttatggtaagtttatcgtacatgttggggtttttttttatagagacaattagacaaacatttatatgttatactcaaccatcattttttcattgtgtttcaactgtttctaagattaatttgaaggttaccactcatctagtttgccagagtactccaaattctttcgaacagtgagcctatatcttgcaaaaaaaaaaaaaaaaaaaagaaaagaaaagaggaccgctctttccagccttggacacataggatccacagtaaagtttgcaccccgagatggatctagcatagaggcggcgggatctcgagcttccactactggcgtgaggatagatgattgatgctattaacttcttgatacacatttgatcattcatcttattaaaaattacataactattagtatttattttgtcgtgatttgatttatcattaaagaaaatatgacttacattttcaataaaaaaattaaataaaacgaaatgaccaacttatgtaaagaaatcaacagtatcatctatcaaaacagctattgcattttggtcatcaatatgcaactgggcattacttaggacatcaatgcaagcgaagagaaacacagctagctgccgtgctcattgcgtagtagagtaactggccattgcattttggagtaaatggattgatataattttttaaagtaattctcatataaaaaattttgtaaaaaagcattatttaataattttaaaagaaaaacaatgaaggtgaattggaaaagaaggacatgaagacacggaccattatatcttgtctcacttgagcattgcagccattgtgtagctagcaattagctaggcattcaggtttgcagagtaacaatcatggctttgatttgacacggcatctgtgtcatgcgtgcttttcttttaggactgacggatacgtgtacggtatacgcttccatcaccacaactggctacagctactactgtgtatcctacgcgtgtgccctggacagacagacacaaggcatgtctcggataggagtggctgcgttcgttgccttgaacttgagggaaattttctcgcactccaaacaaaagaaactcgttatcatatgattaattaagtattatttttttattttatattaaatttatttttagcttctttcatttatcttaaaataaatttatttttttaattattgaagaacttttaaaattacagaataattatatttggagtagataaagtgatcaatagttgtattgggatttgattaaaataggggtgttctagtctttttctgcaaatacactatccgtcctaaaatataataatttttagccctcagaatttatcccaaaatattaacaacttttccaccaacattctcttcccaaccaatcacaaccctccaccattcacttttcctatctacctccacactccccatccaatcacaaccctctaccattcacttctacctattttcttaataatcatgtccaactctaaaactttttatattctgggacagagggagtagaacataccatttcgtctctccacattttatactcgtattgcttatatactacttgcagagagtaacttttgccggtctttcaattgatgttcttgaattaatacacggatcactctggtttaacactttcaggagaagaatatgtgtccatctcaggaggtcgtgcccatgttaggatggcaatttccctattggaggtaggtacccgcccctacggggacgggacggggctggttttccacccgtgggttggctggggacaggacccaccacatttgcgggggcggggccggataaagggttccacccaccccgctagtccctgtggggcccgaaattaagataaggccaaccagaaaagcccatctagtccatgtaggggatgataaacgcgaattcccaatcccatccagcccccacacatgcaaacgcgagcactcgttcagacttctaaacgcatgaaggttgtggtgttgactcacagaagtcctcttctcgcgattgcggcgcagcgccagatgcctgcacctcctcgcatcgccggcatcttgctcctcctcgcgctgctgatatctcactactcctcgcgtcgccgacatcccgctcctcttcgcatcaccggcctctcccttctccttgcatcgccggcctctccttcctcctcatgacgccggccaccttttcctctttgtgccacatacctcctcgctcctcttgttcctctcccaactaagtcttcttcttccaatggcagagtgagtgacctccagcggggccccggtcaggtagcattttgtacccaagttcctcttcggggctggggccgggggatgaagtcaagggttagggcagggtcgttcttgcccaacccagccccgaccgaccccattgccattcctaacccacatacggctcatctatgtattgtccttgccaaccgagcatacgcatggcctcaggcgcatgggacctctgctagtgggcctcgagaagctcaacctcctcgttgtggcaggtctcaccctccctcaccccctccccctacggcacagatccactagcagcagcgatggatgggcggatccggcggcccctactcctcctgcatggatccaacgacttcgagcgaccatgacgacaacgacagtagcctcaagtgtgatggtggtggatcctgacgtgatggcggtggcggcttcaacacgatgacgatgcaggggatccggtgtgatggtggctagggttttgggttttggatctatggtttttgtatttttgggttttgcaatttttattttttttgtcaaaattatttttgtagattgatggcttaagcacctgcctacgaaaattgtattttttttcgcaagcagttgcgccaaccacatgcaaaaatattgattttcgtaggcatcttggtgtaggcgggtcacctagccgcttgcgaaaattggttttgaccgtattaaaaatttgattcctatagtagtgtatgttcagcactctcctttcacgacctctattctcttgtttttcacgtgtacgctttgcgaactactaaatagtgtgtaaaactttctataaaaaagttattaaaatatcttattaatctttttttatgtttttagctaatacttaaataattatatggagtatcggatgtgacacattttagtactacaagtctgaacagactctaaacatattaaaacatattaagacatgtcatatccgatcaaagtaaatattttgagacagatagagtattatttatctattgtgcatatatgtattttatatatgttgatgacttagcaagttgacaacatttgtgtccacttgtatagaaacgctatacatgcataattaaggctgtgtgtttggtatttcggtttggtaactacttgaggcacataaaataacttactattgttagtgtataattaattaatattagcctaaaatataaaaaaagattaatataatacataaataatttctctatagaaaattcttgaacacgcttagtagttcgcgaagcatgtgtatataaaaaaaaggagaaagtagatgttgataaaggagagtgccaaacatctcgcctacgtgtccaatgacatggacgcctagtttatttcaatttgatcgtgcataatactccttccgtttttaaatatttgatgccacttttttgaacatatttgaccattcgttttattcaaaaaagttaagtaattattaattcttttcatatcatttgattcattattaaatatactttcatgtatatatatagttttacttatttcacaaaaaaattttaataatacgaacggtcaaacatatgctaaaaagttaacggtgtcaaacatttagaaacggagggagtatgcgtgaaggtcaatctactctcggagtctgattcttttactgtatactagcattgtcttttatttatatttatagtaatcattatattccgaaacctacatacgtattttatatggtagcgatgcgttttgtatttacataataattctagttctttatcggagcaaatatgttggctccagtttttattatagaaactttgtaaattgagcctttcccatacaaaagcttaatttatacacgtgaactttttcgaaataagatttcaggccacgcgagcatcgacgtgtgtgattccgattcagcttcaaactttcggtgtcaaaaaattgtatataaaacctttgcagaaagtttgcatatatatagaaacatagattgcgcatacacacaaaccacgctaaacacgtcctcacgcaaaaaaaaaaaaaaaaaaaaaaaaaaaaaaaaaaaaaaaaaacctcaaaaagaccgcaaaaaaaaaaaaacacgtcctcacgcgccacgtctgtcgtctgagcaaaggttgacacattagaactgctccatgtacattaattcattcccaggagaaaaagaaaagagatactccctccgtattttaatgtatgacaccgttgacttttcgaccaatatttaaccatttgttttgttcaaaaaattttttgccaatatgaaaatatttatgtcatgcttaaagaatatttgatgacaaatcaagtcataataaaataaatgataattacataatttttttaataagacgaatggtcaaacgttggacaaaaagtcaacggcgtcatatatatatatatatatatatatatatatatatatatatataagttttttagctaatacagtaaattatcacttaatctattatataaggaaggagtacatcctaatgtgcccagctctcagcattcaaacacgaaataaataaataaaactagtcatgacaaatataaagctgccagatataagccatagcttacgctagatccataccaaaaataaataaataaataaatactcctatactccttacaaacatttataaaaaggtatggaaaaaaaatagagagagacaagagctgtgtttgtgttgtgtcgtgattggtatttaaatccggaaaaagggtccagccactacggttttattagttggcgacaagccaaagccgcaaccccacccccgacgtgctcctccgccaccgccgccgccgccgacgacgaccgccgcctccgccgcgatctctcgcctctcctccctccctcctctgtacgcagtgtactactacggtactaccgccgccgtagtactcgctggtgttggggagcggccggatggaggcggcggctgcggctgctgcggcggcggaggcgcaccaccacaatctacacgggtgcctggccgtcagggcgccggtgccgaggtgctcgctcggcggcggcggcgggggcggcgcggcggcgatgggtggatcttctggtgaggctgtctctctctcctgctgcgctcgcttgtgcttccattggcttctctggttttttttttcttcggttgcgatgtagtagtacgacggttttggtcgcctcccacctgcttgtgttattgctcgtgtggctggcggttgaagtttcttagtttttttttctctctctctctctctctccgaatttttgttttttttactcagaaaagggaagtttgatgcattctaggatttctttttgggggggtttatttgtgcgtcagaattatggggagatttttgcactgttccaaatgttgtgctgttcttgctggagttttttttttttttttttttggttttaccttccattggtgctgttcttaatctactgtgctcttgaacatttttctttcgattgatgctgctttcctctgctcctgccgttctaatccagcattcttgtattttatactatacattttcctttccctttttcacctttcttagaacagttccagtatctttggccactggtgtattctgatgatttttgtgatgttacctgaatatctcaaatttttatttttttttcttttttcattgacaagaagtcagcactggagacccaagaggaatcttataaaaaaaaaagctcttggtattgtcaatttctgtacttgctaccgcttttggccacatacttgtttgtggtggctcagagagaaagttgtggcataatcacacaaggaagctaatcattgatcttgtccttttatccttttgggtgccacattgctaacttctgtgcaattactcttcttttcggtattcgctagatttcaggcgcccgaaaatgtttcgatagtatctaataatgtcgcgcttcattgataatagtatcgcaacaagggactaattatctgcttcaataattatcagcacttaagtagctggttagtagattcacttgctgtccttcacctccttttttgtgctaatttcggtactaaatgatggcacctttcctctgtgttcttatcttggctccaaaagattgatatatattgatatgatatgactaaaccacatcatcaaccgatgttgattgtacagttgcaacatcaaaaaaaatgctggaccattagcttattgatgatggtggcaacccaactgttgcttttgcttttaagctgagttttggttgggttcatatgcgcctaatcttatcggttggaggcagcttagctgctctaatttggtgagaaatattggctgtgatggcatatttgttgggcaacttgagtagtgaccgatgagaaagctgcagagagaggggcatatatgataatgatatatctctgggttaagaacgttgtcgcctaacaccatgtgggaggtatcagtttggtcggctgcaaaaatgcttttgccatgtctgtcttatcctctggtgatagatccactggcttataaatataaataaggcatttgtaagcttgtttaagatggcataagcaaaggtttgtgtgtgtcagagtcactaggcctagctagctccatcagttttggctctgggatggtgctggggcagcttgcactgtggtccaagattgccagttcagtaatccttgttttttttcaatggtttaatcttgcctctcttttttttctttttgttgcattcggaatgcagatgttaattatggtttggtagtgtatattaatattattatattggtgatttttgccttgatagttttgaaaagtttgccattctcttctcttctttggtgaatatgtgtggtgtaatctgatacataaaagggattttttttttggtgaatcttatgagggaatgtacctgttcttgtgcagatgaagcatcctgtgggtcaccaagatggatagggaagagcctctcttgcgtatgcatcaagagaaaaggagcctatgagagaatatgcatgaaccttacaccagtgcaggtatgggcttgcgagatatctttactgtgcaaagatttgcaatgcttttatgccaatgtgcacagacagggcctttttctgctgtcagaaaaggatttatctgcagatcaaatcaatcaatagataagcgggcctgcttttgagtaaagatcacatcgcttaatcgcagactcgcagtgaccactcaaaagggattgtttaagctttggctttaagttattgtttttctttattcatggatattagtttttttttcaatttcagtatgtggtctgaccactgacatcagaaaatttacatttcagaacttcctttgaaactttatctcttcatatatatcactaatacagatagttaaaacaatcatctcttccaatttacaggaagagaggcttcagaggctgaggcaccgtatgaaggtttattttgatccttctagacgagatcatcaggtaaatcttgtactagcaataagccaataaatgaattcatacaatatgttacatttccctctgtctaactgcagtgtagatgtagacttgctatcacacactatccaatgctgtagctgtagataattattttggcactgaacatgatcagcagataaaatcatgcataacaatcagtgaactcctcagttttggtattgatgacactgatttgactagagtaccacagagttacatggtagtaacatgtactcgtatactttgatgtaagtttctttgtattgatatcacctgaatcctgataaatagcaaattatgatgataggaagcattgaaagctctttggcatgcaacatatcctgaccaagaactacaaggtttgatttctgaacagtggaaggacatgggatggcaaggaagagacccatcaactgacttcaggtactccaaactaaaacttgccacctgacagattagctccaaaaatatgttcagctggtgtgaagttaagtgaaaatgcactacatggtgcagaggcgcaggattcatatctctggagaatcttctattcttcgcgaagacattctctgtaagcaattcttcatcattgctttcattatctgaaacactgtagactgaagatcgccctcttgtttaatactgatcttctttggttggttaatccctgtaggcctcatttcagaggctgctaaagaaacaatgtggcaatcgagctacttgggagtacccatttgcagttgctggtgtaaatatcacattcatgatcatgcagatgctggatctccaatctagtaagcactgacccaattctgccagtaaatccagtctgtggaccgcagttgtactaattagacaataatattgtatgcagctaagccaagaacgtttgttcgagctgtttttatccaaatgctgtcaggtagggccagttaagtaaatacctttcctgcatcatacaatataccaacattttgaaacgaatttgtccttgctttgttcccccagaggatgagtgggcatttgatctcctctactgcgtcgcgttcgttgttatggacaagcagtggctcgacaagaacgcctcctacatggacttcaatgtaattttcctgtcaatgtacatgccatattttctccgtaactcatcagattgcattgttttgaccgatcttgcgattctgttgtgattcaggagatactgaagtcgacacggacacagctggagagggagcttctgctggatgatgtgatgcggatcgaagacatgccgtcatacagcctgctctgctagtagtggccatactggttgaacaatcatgattgagtcaatggttctgacctctgagtgtatagccccctcccttttgttgattccagggaagggaatttttgatggcatgtagagcaatggcctcctattgtcatgctgaacttgtcccactgtaaacaactcatctgggcatcaccacaatgaattagaattgctagcatccaatgtcaaagctggtgttaatctgtcatattttaccccatggatgtaacaacagaatcaacgagtgggtaaaatcaacttgcaacctctggtgaatggtgttcaatgaatcctcatttccttacttaacttgtcaaacttttccgatatgatgtcagccttgtcaacaatcctctgttcatgaacagaaaatcagctactatgaaattgccaaatgctgatcagttctgacatgctatgaaattgtcgtttattcttccaatgccgacgtcagctgtcgtcgccggccaccgtgctggagccggggatcttggaaagccgcgcccgcttcatcaccttcctcagcctgtccacgtcctgccacctcccggcctcggcgtacatgttggagagcaccacgtagacgccatggttgccgggatccagcttgagcatctcctgcaccgccctctcggcgacgtcgatgtcgccgtggttcttgcaggcgttcagcagggctccccagatcaccgtgtcggcgtcgcaggtcgtcatgccacggatcatctcctcggcttccgtgaggaggccgctccggccgaggaggtcgaccatgcagccgtagtgctggatggtcggcgccaccgcgaagtccttctccatggacgcgaacacgcggcgggcctcgtcgagacgccccgtgcagccgtaggccgacaggacgccgacgagcgtggcaccgttcggcggcacgccgtcccgcctcatccggtggaacgtagcaagggcgacctcgccgtggccgtggtgcgccagcccggtgatcagggcgttccacgtcgccgtttgccgctcgggcatccggtcaaacaccgccgtcgcctcctccatggcgccggtcttggcgtacatgtcgaccagcgccgtcccgaggatggcccccaccacgggcgccgtcacccgcctcgactccatgagctcgtgcacgcgccgccccatctcgagcccgcgcgaccccgaccgcgcgcacgacgacagcacggacgccagcgctgcgccgtggggctcgatcccgtcgccgaccatctcctcgaacgaccgcatggcgtcctcgtgcatcccgttttgcgcgtacccggacaccatggtggtgcacaccaccgcgctccgctcgggcaatccgtcgaacaccctgcgcgcgagggggacgaggcccgcgagcgagtacgcccggacgaggccgttggcgacgtaggcgtcgcgctccagcccgtgcctgacggcgagcgcgtggagctgctcggaggcgcggagggggaggcgggcggatgccttgaggaggaaagtgaaggtgtgcctgccgggagagtacgagccgccgccgccgccgctgccgcggcggaggagggagaagaagcggagggcggaggccgggtcgggggaggaggcgagggcgcggagcgtgatgttgagcatgaaggagtttggggcgcaggggagggaggcgaggaggcggagcacggctcccggaggggagagcgcggcgtgggcggcgaggaggcgggacgccgcgaaggcgtcgtcggcgaggcggccggagacgagcatggccgcgtggacggcggcgagcgcgcgcggggtcgcgcagcggtcggccaggagggacaggttcggccggcgccggatgccgccgcgggcgcccacggcggcggcggcggcggcggccattggcgtcgcgtgcgtcgccacactgtacacggaatcctcctctctgcgtcgccctcttcccaaaaaaatacgtatatagggcgtgtttagattaaaaaaattttcgttaaagttccaacttttccgactccgtcacatcaaatgtttggatatatgcatagaacattaaatgtggatgaaaaaaaccaattacacagtttacatataaattgcgagacgaatcttttgagcttaattacgctatgatttgacaatgtgatgctacaataaatatttgctaatgacagattaattaggcttaatgaatttgtctcggagtttacatgcagaatctgtaatttgttttgttattagtctacgtttaatacttcaagtgtatgaccgtatacttaaaaaaaaattggcacacgaactaaacacaaccatagtatcagattttaaacaacaagtaatatgattttatgaatttagatagatcatgaatattaggcatccatttataactgatggattttactgtaattttgtaaaacgtccatataaatccatttaatttgtgttcaaattgataaaatccttcatctcctagaggaagccagcaaatctagttgggtaggaggcagtatggaggttaaggcgttcctaaggtgtcgacttgatgtccttgagactgtaaagtgtcgctttaggatatactccaagttatctctgaggctctaaggcatcgcaccaaggtaagacagcttgaggcgacacctgggagtctcgcgctctatatcgctagtgaaaaaattagctttcgtgaaaagaagtttaagtgaaaacgagcccatgcactataggaaacatagagaggggcatctagcaaagcaatatgacatttggtgactttgctccctccccttcacatctgacagtagcgctctttgcatctggcaacgacgtacccatctctttcgatggtggagactctcccctcaacgagtactatctcctctcccccttcatcatctgctgagctactcctttctgttcttatttctatgctcttctcttcctcaatgctcatttcttgggccctccgttgctctggtgctctccctcgctgctcttggcttcccccctctccctaactactcttggcttcctagttcctcccgcttccttaactatttgcttcatgtgcatttgatgtagtacatagaatactgttgatgttattggttattaaaatgctaaattattatacccatctaacacttaaaatactcattatatcccaaaataaacaaatttagtactggatgtgacatattatagtactatgggtgtaacatgttataatactatgaatctggataggaggtttttcaaagacaattcatagtattaggatgtgttacatcccatactagattagtttattttgaaacagagagggtatgtactactatcagggctcaacaatttgcagcaacaaggtatataaagtgttgttaaaatgtagttatattacactatatttttgttgtcatattatattattacgattataggctgctttcggctgggctagctgccatagcggctgcggctacagctgttgtgaatggctgtagctaacagccgttttaaactatcacagtcgctgcggtagcaggagcaagtgcctccgaacaaagccttacctccgaacagacttgccaaaccactctccaagccgtattttaacaaatgtaggaaaaaatgccctccaacagcctctctaactgcctctccaagttatccaactggccaaaatacgcctctccctggccaaatctggccagcctctagctagccaccccagcttgccaaaggtgggccccaccctttttcaccgctccatcccaatctcgcagaaaatcaacgctccctgcactcgtcgtcggtcagccacctaccctcgccatccaccgtcgcgtggacgtcaccgcctcccctcgccgttagtcagccgcctgcccttgccgtccgccattgcgtggacgtcgccgccgcagcaaagggagaggggtggggaggagcttgggaatgtctcgccgtcgccgctcatgacttcagtcgatcattcccatctctgaaatatagagagggtgttgatgtccctgtcttgctttcatcacctgcttcaacccatcgaaaatcccccaaaaccaagatccccaattgctcgaaagagaagagagaaagaaacaagaagttgcttgaaagagaaaacgagaggcgcaaacaagaagggccactgccgccccgtcatcgccgtgcacggccaccgccaaccgccgcccgtcgctgcacacaaactacatctgccgcaagcaaaaacaggcttagggaatagggggagcaaggtgaggaagaaagaagtggtatagaggctgacgcgtaggtcccgctgtcatagactctgaatagagaggatgaatggagagatggttggagatgctctaaggatgaattgactagccaaattaaatggagagttaactaaatagatatttggcgtccgatttaaagagactgttggagatgctctaaggcgtgtagggccatcttacctcgccttaacgcctttacaaccattggaagcaggatttactgaaataattgttttccagtactatgcatgatgtcggtttcaggtgtttgcaaacagaaatgtagggttagtagacagtaaacaaaataagtaacaactttcgcaacaacaattttattattcctctttgctaaaaaagagctacaaaaccgtcgacggatggcacaataatgcaacaatatgcccacatttacaaatttatttattttgccaccattccggattttccatttattatttgcattgttcttacatatgctaggtagctcgccatcaaagcactcctgacattgtctttgcgtaccttcttcagatctcactaaacgacttgatagtccggaaaccatgattctcagggagcggtgcatttcccgggcgaatggagattattacctcaaaacctgaaaaagaaaatgtcgggaaagaaaaatataatatgaaatcttgacccaaggaaacgaatgatagcttgaaatgatcacatgattaggaatggcacccagagaggtcgactggttaaagctaaagcatcttatccaccaaataaaagcatgaacattcccatgaatatttgaccagaactagtcattacctgcactttttgcagcaacagcttcttggaagacatcggtgataaataagatctgagcaggactgtccaccccaagtgattgcgaaatctcaaagtagctccttgtttctcttttgttactgcggtttatgcgagatggaatcataatttcactaccatttttcagtatatgcagagaaatagaaatggaacaagaaatcatacccggttgtggtgtcaaagaaaccacagaggtattgtcgcagatcaccataagccgtattgccaaataatagcctttgcgcctcccggctgccacttgagtatatgtagacctatttgcaggtatattatttgttatcatgtcatctaatactaatacacctttttttgtattttttgcaatggatgattcaaaaatttgaaattgatattgtttagcactatctagggtcaacgttcttgacccaagttggcagctagtaataactatagtaaaccatgaaaacatattaggagccatgaaaagtttaaagttcacacttccacacgaatttgactaaagagataccttcatgccactagcatgccagtgctttagcgcctcggggacatcatcgaaaacaactccttgcagttctttactttcaaaaccagtcctccatatgtggccctggaatttgcattaaaaatgctgaaatccatcaaagaaacaggaatatgcttgcagcaccgaaaaagaatgtggactaatctacctggagttgtttcaacgacgtaatcttcctgtctgctttaatcatcgattcaacattagcaactaatgcattgataacctcttctttgtcagcatcgtcaggtggaattggaacagacccaacaattccatttttcaggtcttcttcaacctgaataatgaatgctaatatgttatatcttgcataaaacagagatgggcacattcacgtggcctagtggtaaaactcatggttctggtggtgaggactccagccactttccaccatggtggtaaaacagttaactacgtccacaaataggaagttgaggaaccaaaattggtatggtaacttagatcaaatctaacaattcaaaacaaaataattttcacagggctaatcaaatagtatgacttaaataccatcgacaaatacttagatggtacaagcttgcagccttacaggatcaacagcttcatgggatgtgcaaaattgatttatcataacttacttggatgcgcaatagtttgatgtcctctttggtttcatcagaactatatgttgaagtcagatgctttcgcacattatcacgggcatagggaaacatcacatcagtcacaaatgatattggagtagttgttccctcaatgtcaagaacaacacaatgctgcaagagaacacaaaggttagctatttgtattccagaaacatattatatggatgagttgaccagatgtagcaaccacaaagttaagaaagtacacaaacaataacacctagtactcactgctgcaaaacggtacactataagatctaaaaaaatcatttagaaggtagattttgcaaatactcagaacaaagaacagacctttgatgatttggaatcagggcatccatttggaatactagagcttagaacactgcgtggtcttttggcactgtttattggaccatgctcaggagttgtccaatcaatacccaattgatagagcttgatggcagcatcaaaaaggtaatgatagcattcagcctgaaaagcacaggcatagcaattaagtaaatatatgtcatggcataaagtccaggaaccattatccctcacaatgtgtgcatgaccacagttatatttagagtaaattgcacagttggtacatgaacttacaaggtggatgcgatttagtacatgcatatgtaaatcgctcatttcagtgcataaacttgtctaatacgtgcaaactagagccaaaacaatatgttgtaactaatttcactaagttgagcactgattaggatgttatgtaggctcacatgtcaatatgatgttacgtaaatatgcatatagtcaatcaaacatacaataagtcatgttaattatacataaagggagtatgcaatggatacgaaataaatgaagaacaaggttaaattatttacacatacgacatatctcataccctcacgtgtgcgcctgacattctataatcagacgaactcaacatgaatagtcacaagttttggactagcacgcacgctctagataagttcatgcaccataatgagtattttacaagtttgtgtactaaattgcacccacctaacaagtttatat

SEQ ID NO: 73225 - DNA, 4389 bp, Oryza sativa
cctgcagccctaaatcctaattaaccattcattctccctctttcatttagtcctaaccctacatttattttcaattccaatcccacctctcatttccaattatccaaacatagcctacattctcaaaaacattttttcatgcataatacctcagcacaagcaagccacgccgtactacttcatgccatcacctcgagctgcgacgtcatcgccgccacgtccttcccgcgcggccgccgccaccggtgagctccgaggcagaagccttctcttttcgcgttgtcgcttcccccccccctctctctctcttcctcaactccgacagatgccgcccgtcgtcgagcgccgccttcccaccgtttcggagctcggtgccacgccatgagtccgcctctgtctcctcatgccagtgctgccactcgcagatgccgccgagcgttgtctccgccgaatgccgccgcgccggagcgcacccacgacgcgatggagcgctgccttcaccagagagttcatcaccactggcggcatctagaagccgagcagccgcggccatgacattagaaaggggaaataaggaggaacaagagaatatgacaagtgggtcgagggatatttttgacctttcatgctctttatctctcatattcaactggaaattaatattttaatgtgtgcggtgtctagcagcaaataaccacgtttagagaaagttttccccaagagtgagtttatggtatcctatagctaaaaccatagagtcgcgatgttatgtagcaaaatttgcctatagtcataggttcatattacatattgtcccatacaacgttacgtgataaggaaattaaaaaagcaactcaagtacatttacggtacgatcaattcaaatgataaaagggctattaactcattagaatcggatgagaaatttgaaggcgaattaaacaactgatggagagcattagtgttattctaaaattgcaggcgtagttattcttatttaatcaagagtaaagtgtattgctgcggttccttaatttaacttgttcgtttatgtcatctagattgccaaactctcatatctctaaacttattgattattccggtttcatattgccatggccatttacgtggcatgttacgtggacactaaagtgacacgccacataaacattccagtcccatattttctttttcttcccctctacgttttccttttttttctttttctcacaccgacggaaacaaataacagaagaaataggggagtaacaaaagaaaatgagtcagcatccatgtgacataccacgtgagctccacgtatgatctcggagttgtggccgtttgaaaccggaatatcatatttagacaagttcgaggatcgaaaatgcaatttaagtgtttgggggtgctgtatgacacggttgaacatgtttagggacgggcattgcactttactctttaatcaatatatggggagccatcctttttatttattaaaaacatacatggagccgtactcataagcatggacggaggattattcaacaacgacaattgagatgaaacaaactaatcagaacgaaatatcaattggatgatgaaattcgaaattgacgggctcccaaacagcattttcatgctcgatcttcgatcatcagcagcaatgaacgcatctttattgattttacacgaccggaccgggaacgtgataacctgaaaaataataataacgtacgcattacaactgatcaacagaaatttccagaaagagaagatctgtatatataggaaatgaatactatgggcggttttggctaatttgatgcctgccctaccaaatagttggcaacttaattagatagcatttgcagacacttagtttgttgccaatatttactaaagcttacacaatatttgcagacattttttttttctctctcgaaatctaggaaaaatatgtttctcttatctttgttttacagattacaaatgtggcttcgaaccaaaaatatattatcgagatccaactaattaagcacggaacatgtatacaacatatgtttttggggcatgcatagttgttgattaattttcactaccacaaaaactatttttcagctgacatcatctggatctaaacttctatatatggtggatacactatcgcatataggaatcgatttttacatacgattaacctaattaagtgaccttatctgaatatcatcatcagcacccacggtgtgtttctacatatggctcttttgtggtccatctgtaaaaataaatatgggtgttgccgatgtttttttcttcaagtgtctcctgacctaattacgtatgtaacaactgatacatggaacatatcatatatatgtgcacaagattcgcgtgcacaccagttaacaaatgccacgaaatttttttaaaagaaatcgaacatttactctgatatatatatatatagaagtatatattgtgcaatgcatgtcacacaagcttactgccgcagtaggagccagggaggagtgggcggtggcagtaggcggcgacgtagacggccttgtccatgcacacgtactgctccacctccggcgtcaccattccgcacaggcaccccacgtccaccctcctcaccgcgccgcagcacgccctcgacggcgccgccttcgcctccgccgggaaccgcaggtacccctcgcagctccccatcagcaggtccaggtccttctcgcacttgtccgccgccgacggcgacaccgtcgccgccgccgccatggccatggcgatgatcaggaggacgacgaagcacacggcagctgatgaagacgatgatgcaattagcctcgccatggctgaaaggaaattagctagttaagcaagatttggttgctgagtggtgtttgtgagtgctttggaatggccgaatgggggctgtatttatggagagattagcatggaagttttgtgcaagttgcctctccatgcatatgcgtcttccttgataattaactgactagttaaattagtttgttcaatgcctacccacttctagtaaactgatttaattaattaatccatgtttgatatggcatgttactagctctgtcctacagcaattaattgtttaggcgttccttaaaatcacatgatgtatttcgagcttgtttggttggtgccacgttttaccacacttgagatactccatcttataatataagggattatgctataaatagtacaagagtttatatatgagacataaagtatgatcttgggatcataaaatctcttatattataggataaacataattccttatgttatgggatgaagtagatgagtctaaccaaatgttgctaatgtttggtttgttcttacaacttctacgtgccacactttctttatgttttggttcagctagtgatagtccctttttctagccacagtttgatggcaatgggggtgcacgatcgtccgtcaggtgaagataactattaatttggcggacacctgagacacacggtccagctttcaatcaacacgatccaaactctgcaaccacagtaacatgtttcctctggttctcaaccatgccaaaactcgattgacctcgccgagaaggctaacccctccatgcccatcgaagaatacaaacaagaacaagaaagattagaagacaattgtagataaattattaagaactcaaagttgggggttccacaaaacgatctagctagcggcgaaactacaatgacagaaataatctaagcaaagttcagctctaaacgatgatgactactgaataaatatgggtagtaacatcctagggttaggcctagggcgctcacctccttgggcttagtacacggcacaataacaaggctcaagatccaaatcagactcgaactaaaagatatacgtgacttgtgatctctgactgctaagaatgagtttttatgtggaactagtatcatcttaaaatagaatccattacctttccaactagtactcatgggcccaaaagcccttctagatcagcggccagattcatttgaagttgatgttgttatgaggtccaaattcaaattcaaattcaaaacatgcaaaacttcatctcttgacttctagcagtaaacttggtgtaacaccttgcctccaaaatccgcattagtccgctctacacgttgagcggacccacgttcgcatggtatcccgcttacactttcgtcctcgcctcgtgtaaaaaggataacccggggataccatggttggagcaccaaggcttataagcaggccctcacccacctaaacttccaaggtggtactaaaccaccactacacatccacttctaggccacatgggccaaacacacactactaggcttc

SEQ ID NO: 73226 - DNA, 6124 bp, Oryza sativa
agcccggcgtggtggcgcgccgcaacggcgggagcggacaaagttaggggagatgaggccgacgggagagggggaaagaggcgacacctcgccgccgctccacctgctccggccgcacaccgcccacactcggagccgccgcttgcccgccatcacgctcacccgccgcttgccgtcgccgcagccgcactcacccagagacaccgccgctccgcctgctctagcgcgctgacgccgcccctccacctactccagtcgtgcgctcgcccatcgccgcccgccgccggcaaagagggaggagaggaaagagaagaggagagaaaagagaagaaaaaataaagtgcagctgacatgtgggccccatgaaatttttttatttttttttttgctgactaggatgccacgtaagcgaaaccacccacctatacttccaagggaccttctgtgaacggtttaaatgagtttagggccgaacatttctggttgagggacctcaaaaaaatcccgctgttaagttgagggacctccggtgaacttattccaaaaagatataaaagggaattcggcctcggggttcgcaggcccggcccgggtagacatctatgcacatgcccgctgctttggctgggccgagcgtatccatgtacaagcgtaggaaaaagttcactagaggtctctcatgtcgtcgccgagttacaagatcgtccatgaactaaaaaattagacacaacttatcccttaacttacaaaactggatcactttagatactaagacggtattgttcccggttaattttggctagcgtgacggttgagtcagcgtgagacctatgtggctcccacatgttagcacctcaatcttccacctctatcccctctcttcccatctcaatccaagattccaggtggccagcgaccgaaggagataaccggaggagggtggcgctcggcgggagaggcgtgcagcggtcggcagtggcactcactggcggcagcggtgctcgctggcgaagacaacgatgctgagccgatcaaagatgaggaagcagaggcagcgttcgctcacaaagatgccacgtggatccagcaccggatcttccactccaggacaccctcaagccgaggtgcttgggatgcggtagcagggacaggtgacgggggatacggtggcctcttgagatgcggcgacaaggacagtggctgggatgtggcggtgaggacggtggcgggggattcggcggcctacacatgagatcgagcatctgatgccgtgtcgcctgctcatcgagcaggatgtgatgtgagagcgagatcccactattgctactatggcttctcagtgtcttggtatctcgtccgttccgcctacgatggctccgcagtgccgcgatccatggcggccttggctgcttcggcctcacgggcaacttcttcgagcaccgcgccatcacacgcaaccatccccaccagcaagtccgtcaatgttgggcaccttttccatgcaagattcctgcttcgccacgcgcccaccctggctgctgtgtcaatggcgcctccgcctacgccatcgtccttgtcactagcgtgggagaatgacaagtccatctagggaatggcttcttttcacgccggggacaggcgccgcttcgcccgcatcaacctcgctctctggagtcgtgctctccatgtcatcgatgagggtggtggcgcctcaccgcctgtgggcctcctccactcctgccggggctacctctctgcagcattgaaaagggaaaggggaaagtgaaacaaagggagaagtaggagagtttgtgtcatattgacatgtggtgttcactaatttttattttttcatttaaaatgcactgaaaatgtaggtctcacgctgactcagccatcacgtcagctaaaaccgggaacaaagtaccttagaactcaaaatgacccaattttaaaagttagcggatggattatatttttaggttcagagaagactttggaactcacggacaaataagggacctaaggtgaacttttccacaactcgtggtgcatattggacggcctttggttcaatatgggagtttaagattacgaggaattgttagcgagcttataagaatttagagttttctgtttctaatttattttttatcctgttctcataatatggatgaggaggtgcttttgattctgcgagaagctacaattatcattaaaaaaaagagaatcaaatgactcgtgattcagttgcactggaagaccgagcatgctgccattattgtcgtgcgagccgccaacgaggagggcagtcaaacactgcggcgatggatgcctacccttatgctcaccctcgcagcagagagggcctagccgtggcccgtggtggtggcagtgagggagaaggctgacagaggaaagacaacgaccaatggatcccacaccgatttttcaccttgtgttgccacgtaggcaaaattgacaaagagataagaaaccatcaaaataattgcaaagctaagaagcatatttggactattgtcgaacctaatacttcgtccgtcatataatatagcaatctagtattaaatgaaacattctatattacatcgaatctggagaggagagagtatatagtagtagcaaatatttaaatttccctttctcacgggtgtgattatgcagatgggttaggttgcaccgacgggtgtgattatgcagatgggctgggttgcaccgacgtgaggttgggcaatagtggtccagtccagagtccagactcagcccaaacaaaaaaaaaatgaaaaaactcccaccgcctgtttggttggaggtagtgtttagaagggattatgagtttagagggatgattaggatacatgggaattttagtggggataggatggggaattgaggaaggaactccctccttttcaataccgataggggcaggtaattggaaggcaattcctcctttatctaaccaaatctcagccatctgtttttattaatgacctaatcttcaactaaactccctatcaattttcatctcctctactaaataagatattagaattaaaaatcaaattcccatattaaactcatcattaattccctttaaactctccatctccgtccatcaagctaccaaacaaccgccagcgtaatcgaggaaagaaaagaaaacccagcgtataaaactggcatccgacttccttttgcctccgctgcgtctcctcgagcagagcagagcagcggcgtcgccggcgttgctgctcccgcgccgccgcatcctcgctcgccggtgacggtgagcatccatctccctcctcctctccggcgacacttctcgaatccgcgctaaccctagcaattcttctcctgtagatccggaagattctctctctgtgccttgaataaaccctcttaaaccccccatgtcacgcgagcctgcggcggcggcggaggcggaggacgtcgtggcccgtctcggcaccgacgaggcgactgggctgacggaggaggaggcggcgcgccgcctcaagctgtacgggcctaacctcgtggtcgcccatcacccccaggttcgctttgttcctccttccctccccctccctgtttcttttcttttgccctaattgatttcgacgactttcgtggggattgcgctcactaacgcctcacaatcattctatactgttgcagtatgtgtgtggctttgcatctgctgtatgtttcactatctcttgacttcaattggcgagtatatgccctccatcatgtcgaaactctagcaagcaatgaatcgaatgccttttgagcttgtgtattgaactataagcctcatcttttagcttatgcttatgcttataagctaaaatttgaattttcaaccttaaatttggaattgattttgaggtttttcatcttagtatattttcggtttgcaaatatgccgtttcgcttattccgtcaataagcgaaacgatggagtcgtatgatgtcctgtgagagaaaaaaaagtgagaaaagatttttttttttgaaatttttaataaaggttacatacattagcagtttgatgttggtggccttcaacattgtgcttcaggtgggtggcaagcttcttgctacactaaagtgcatcgtcctgctctggggatgggatcactccttcaccgagtacattaaatacgagattggatgggagtcatgggagcatcttatcttcccctgctccagggagatgttatgtgtcatgttcatcaatttctcgtcatgggcggcattggcggctgcacttgtgtcccttgcccttaactcagctggtcagacaacctatgaactgatcgttatcgtctccttacttgtgggaagcctgtgtgcatgctgtgttgccaagctccttgccaatcgtgctaaggcaccgctggaagctaaagcttttgcgcgaaggaccaaggttctgagggatggaatatggaaacatgaggatgcgaccaatcttgtccctggggatatcatatatctcaagtgtggtgatattgtgccagccaatgcttttgtcctcaacatggcacagatcgacaccaaaaccatccgtcatgaaaggagtgttaactatgtgatgggctcccttatatactatggctgggctgtctcctgtggcgaagggactgctgttgttactgtgacaggcaataacatccccatgagcactctgaaacagctttatccaaaacgattctctcggcctgggcagcttaggaagggtgtcatggctgctgccactttttgcttctgcttagtacttgttggcatcacaagtgaggctcttgttaaattctttttccatcaaagcataggcacgctgcacagtggccactttatgccacttattggtctaataccaatgtcgattcctgctgtgctctacctggcattggcattggactctcagaggctttccaaattgggggttgccagccggggaacttttgctcttgaagacttggctagcatggatgctatgctcttcaacatgactggcactttgacatgcaacaagccctattttgacaaggacaagattgaagtgcttacagaaggtattgataaagatcatgctgtcctgttggctgcgcgggcttccaaagcacacaatgaactgtataaagaaccgattgatgcagccattctaggccttatggatgatccagaacaggtaccttcttattaggatctatgtgcttttccttcttgttctttttccagaaggcttaacaaaccaattgatgcaggcacgagttggcattaatgttatagagcaccgctcccgtatgtttgttgcaatgacattgatgtacatgactacttacatcgatgaaaatggctccaagtgttctgtgctcaaaggtgaccctgcattggtaagcaaccaatccactgtcagcaaatccaatgaaactgcccctcctttagtaccacatgcattacttgtttacatttcctcacactagcttataagacatgttgacccaaatcatagcacctcccagctcattctatgagaaagcataaacgcaagcccactgcaaggttgctgggctgagtggattttggctgagcttgtggaagcaaaggaataacatagatgtattcatctcaattatcttcttttcttggcacagatgcttcgtgactgcagttgtagcgaagaagtcagagagcatatacgcaaacgtattgataagctcggtcttgatggatatcaatgtattgctgttggacgtattgttaactctcggttggacatcattattcttctacctttcatagatgatctcagaagcgatagtgcagaagctgttgataatcttactgatatgggtctgagtgtaatagtacttacaggtgatctttgcaatgtctcctatgtttatcttgattttcatgtcattttttatctgcattttatctaagtgttctcacgtttgttttgctatttcagaaagcccaatgacaattacaaagcacgtatgtggaagacttggaaaactgggcttaaatgtgttacatgctgactctatgcgggagttggtaagcagcaaaaatgagcttttct

SEQ ID NO: 73227 - DNA, 5421 bp, Oryza sativa
tggtttctaaaagaatgaaaggcacatgatcctatgggactcttgaaatggctaatggagtcaatcgatgtggagaaagtggtggagaccaattagaatgcataatcttgcttttgcatgacagccatttttactcaaaactattttcatttgtttttgtttccttttgtaagatcagtagccaaacattggctcccaatccgggtgagatgggttcacaaaactgcctgaaacacataatttttaagagaactttttattattgtttccttagagttggttgtccttcatccttcctgaatattcggaggttttcaaccagaggttctctgcatcgtgcttctacaagtttttggatctaatacaaggcattcacagtttgcaatgcacatattggcatacatatatttttaacaaatgattcacatttttgtaagattgaatcctttcttatatccttgcaaatttggctttcctaattctttcctgtgatctattattatgcatttatggtctgtttatttttttccttttttggttggtgttctatcttaattcgttttcttttttctatcagtaaattactatggtgaggcctctataccgatgcataccacataactaactgtttgacccttaggtttattgtcttcggacctccaaattttgtataatctaaacagtacataattttagttgcttatcaatagtgtggttttgagttttggtttgagtctcatactttattcaatgcgtgccatctctaccactatattaggagtttggcttcttgcttagttttgagttatctggtactgtgcctgggatgtgaccacaaaaacaattatagtacattagcgcatttatttatttatcgctatatctgttggcagggtttgggaatctgtggatagatttcaatcagcgggttattaactgcatcttgttttcttacagtcattaactgctttgaacgaggaaaattttggtgttacggttaggtgatcttgtttctacttatcacaaattactgatctgagctagtaaggttgttgctatgaacaagttattctgcaatgtgttgtatgtttaagaacaaaaaggggatcatctctattgtcaccatgccatgctatctgagagtgacttaatcaatactagacgaattattattgtgatgataaatggatagagcaggatgtgtcactaagtaattcttatttgcctcagccctcagtatagtagttatatgaacattgattgtgtctgtgcttgcataattatgtctcaagctgcatcacattttccatgtctcacaggatgagtgaccactagatcattcctatttgttcattgaccaacagcagtagagcactgtactcccacgacatgtacataattcttctctcagttgctggtgtgcatgtttacattcttgctatgctgaactcaacaaccacagctagtcagctacagcctgatcaagagacagcagggctacctagccctttgaaaggaaaaggatatccatttacacctagaatctccttttgttggtggtcctcacaatggtggagctggttctttccctttcagattcacacgtgggagtgcagtggcagtgacctcgtgaatcacttgtcggtgagggccccagatgatcagcgtcttgctggaaacaaaggtaacatcgactgctggtcactattacattatgatatgattattattcagttccttctgatgctgcttggtgttagttcacctttagtacaatgtcgtggtaacgctgtattatacggtagatttattttttaaggtttgtcctttcactggattcttcttctgtttattcttataatgtgatgtggtggtggaagagtatcagccacacaggccttagttggctagacttttctattagtggaagtgaatctcatcaacagactttaacataaaagaacaggaagccatttgttgagtgggtctgtgctcataaagagctagagatcatcacttcccactctgagtctaagaagctagctttcttaggtccatatataaaccatacttgtaattatcttacttgatatatatattttttatgtgcaaaagagaagcaacttttgcaccttgtggaagatgaaataaatggaggacagaagaaccaattaggtttgtactaattcgttggcttgtacgatgatgattgattaaagtttcttttggcctgcacaattgattcgtcaagcaagcgtgtgcacatactttttcatgctcgccattatctctaatgattcttttaagttccataagaaatcaacctcgagtccttgacttttactgtgaggtgatatggactccaaaggaagttactggaacaattttgttatattttggtccagattactctttgatgtgaacatccattgtgtttcttttatttttggattaaagattgatcaagagatgaacatccgtgtgttactaatgacggctactgtttttgcaaatatccacactagctagggcacgccttttctcatggagggttaggtttacttgtattcaatctacttaatgcagcttcttacaacacggcagccccgcaatggtttcagatatcctgtacagagatgcacacaaaaatgttttccaaattgtagcataatgatctgaacaccaattagttacaagatttattctctgatttaaaaaaaaacataatagtttttatttgttgggaagtataattcgtcaagcaaattaattgaggataggagatcactgtctttccctacttgaggctttggagactgttaattggattgaaatactaatacttgacaagctactcttgcactattactattacacacaaacaagtcatgaaaacccctataatagttagagcatgataaattgcacacagcaaagcttatctatactgacatgtttttttggtgttaagcttcgaagcgaaaatgcttggcagaacaccattgaggtagacggaatttagttttgacaaaatatttggaagttaaacagtgcagtttgaattgtggtattttagcacaaagttctgacttctgaattagcagtcaatatcaatttggtattcaaggcctcatttgctgttgttttagagttctcagcactggttgttatttctcagtaacaaaggtattcttttcttctggaaagaaagagagctgaagctttattctgaaaaccatcaatattggcaaccaagtacaggtagaaactactaattattaacatcaaattgggatatcgtaaaagccaggcacgatgatcactgaccaacatctggtagtggtactggccttgatcttattagtattttcatgatttcttgttttccttttatccttgaatacataacagtataacacagtcaactaacaactttacctgtgtgacagaccaacacaaacttgagcaaaattagtctaacctagtgtatatagatcagtaggagttggctgaagtccatcagaccactatcaggattgctatcagtgaaatcatcgtgcttgcttttcatatgggggtttatattctttattcgtgtgaagtatatgatgatgcaatctggcatagcgcactccagtctaaccagtataataaaacaagctgttactggtggcagctagtcaccatccgtttctcgtatcctacatgtgtctatcttggccagtgtttagaacctggtggttcctggccagtatagtttaaatttgaacttgtaaattgcattatatctactctctggcacttcagaaaataagtaaaaaaagaaaaacaaactctcctcggattattccattcagcccatattctttgttgttatccccctactctgtggatgattatattgatcaatttgtgatatattaatgacttatgtgttatatccattcagatctatgaaaaattgcgctttagccgtgcccaattcttctagccagtagccaccagccaggcgaccatgagtttttgaattaaaaatttggatttgaacacttttctggtaaaaaccggtaaccggccagtaacctcactggcaatgcttctgatatttttgccaaaaccggtattcataaccttgatattgataggtcacatcaagcatgcatccatgaatgtcagcgctggacacctagatgataatgaagtagatactttttttgtggccatctgatggttacatcctgctacttgcagccaatatcactctgtacaatgtctcgattgttgagatttttaatttttggaaaaaaagaagtctttgatcagattttattaggtgggcattgcttagtagtgctgttgtgctaactaccttttggatgtcctcagtttgcatcatcaatttatgttttgtgaccaatgtgtgttgaatacttgaatgttatctgacattttgacaaatccataactcaatattgtaaaacagagtacattcttaaatctgatggatccaggccaagcagtctgctacatgttgattctagatagaactggagtgaaacccaggtttggtttgttaccatggttttctgaaggataatctggacaccagattccggagtgagcttttgttatctaccatgcaagtcaatctccgtcgggaattcctatccctgttgattttccatggaggcgtgccgttaacgcagctttgatgcagtcatttcatgacacaggtgcaaatttcgaattggacgaccttcatgaatcaagacagcagctgggcattacaaggaccgcgacacccggctaccagaaagggactcggcgcactgaaattgctcctgggaatttccacactgtgaagaccaggaggacttgagccacaatcttcacaacctttggtccttgccttttcaaacctttgtctcaagacctgctactggtgctgctggaaagctgaatcattcccctctgctgtagtgttttctgcaatcaaggtgcaagatttagtcaaggatacaccatcttgttttggttgagaagatggatcatacatgccaaaggtggctgcacttggttgtttgtgcttctgcctacagtcactggtgtgaatctcatcatgccactcatgatcaaattgtactccgaggaaatggactggaaccaagatcaggaacaggtaatccactcatgttaatgaaatgtcaattattgaagacaatactcgatgaaactgaaaattttcctttgcagggggatccattggatctaattacaatttagagctgcgaaaaaaaaaatctcctgcactcattattaatttacggtgcatgggataatcgttgacctctatgatgaactcggagtcgtgctggactatgatacaaattctccataagattgatattagcctaactgttt

SEQ ID NO: 73228 - DNA, 16970 bp, Oryza sativa
ggtacactacatgagaaatggtgtattttcttagtactaccacatttttgtaaacatcacagctaacttcatgagaaatataaagcagaactggaacattagctaagattcatggggaaaagagacaagtgggttcaccctaaactcttttgcaccaggatcaagcatggttgcaatgcaagtttccatcccatggctatgaataacagccccagctcctctcatcagataagcctgcaaaataccaatgaaaattagacaatttagactaaaacaagttgaagcggacaaattaagcaaaggatagcactgataaccttcatgaacagaggagcacagtcagtacattttggaggcttgtttggccatggctttgatacaggtgaggagagcaccttcccatctgctgcagcacatacatgtcctctgccaccatcctctccttgtgcacacctgagaatgtgattaaaattcttatatcgtttcttttggttcaaatcgcaaccttagtgctcacagaagttatggtcgactggtagaaaatcacgttctgtttaatgattcaggttattagctttgtttcatccccatgatagattagtggcgctcgacaaacctctttccacatcaataggcatgtccaaaattgcaaaagcatgttttcatcaaaagaggataacattggttctttatagcaggcctagataatgaaatgctcaaggtggtccaatactggacattacaactacgcacaggtttacacaagtatttttaaagtaaaaactgtaatagtaacacttcacatgcatcatgcactgatgctcaactgcattgagacataagctaataagcataatagttcacacttgaaagctagaaatattttaagttactagtttgtaaataaaattgatcttggctccttagcaacttatctttgtcatagaaattattaacataacaagaattttttttccttagtagtgtacaattattattgcatgttttattctagtctgactttgtacagaaatcacttggttttccagctcccataattcaaactgttaattcttcttggccagtttctgacttaacagtgaaatatctgagaacgttccagactattaaccacactcggataaataaagttgaccacagtgttcaaccgctactgcagtgcttgctgagccatttcacaaaaactgcaatcagtcaaacatacgaggggtgggccatatcaatatgaaataagcacctagcctcctaaatgcttaagtctattccaactgtctggacaagcagcctacataagaataataaagcaaccgtagttccaatttttttagtaacaagcccaaatcaacacccaactaagcttatctgatacttaggccctgtttctttcagcttaagattattataatctagattattgagttagattactataagctagattgttataatctgtagtagaataagcggttagttgtttctttcctagattaatagagcctagattattgggtttgcaaatctaaagagggagtggggtggcatggtgggtaattttttacccaataatctggaaaaagctcacctaaatgagcttatcagattataataagctgggcttcagattataataagctacttcaataagttgtctgtttctttcagcttactcccaataatctggattataataatcccaagctgaaagaaacagggccttacacccccacaatcttgtacgttaatacagatcacaataactaacatgagcagcagagcacaatcttcaactgtgcatgccaacgagcaatccccatatgcaaaatcacatcagtcagttcgtccagcaggagcagagcagtgcaagatagtacaggagagaggtggtccttcctgttcctgactccactttgtattgccacagagcaacacaacgcatgagtaaaccaaattaaacaatacaaagctcgactgctctagatacgtagtagcagcacaagagtgatgagacacaggcaagtcaatgccatcgaaattgttaatttaaccgaactccacgcagcagactacgttcctacccacccacccacccaccctcgtcgatcccggaataacatcccctgccgccgtggcaattcatcgaacaggtggagggagggtgtgaggctgaggaaggcggaggaggaggaggataccggagggggacatgacgatgagctgatcggcgagggggagcgccgggtcgttggccttgacggtgatgctgccccccgttccggtgacccacccttggccgtagaagtggcggcacagctccgccaccagctcccgcgcctccctcaccgcctctccctccaggtacgcctccgactccgtcgccgccgccccctccccccttccgccgccgcagcacgccatggctctcctccgccgccgccgccgggattcgagctcgccttgatgctttttgtggtgatggtttggttttttgtagtaggaagagtgagagtagcagtagggcggctcgattagtgcctcctaattaatcgcgcgattctgattaactaatttttttatgtgggaccggcatgtcagtgacgtgtttggagggaatcgcggaaagcagagaataattgttactagtactagtcctttttctcactggtgtgtgagcgagctcgctaacacgtgtatcagcaggtagggccagtgatcgttgtgggtcccacatgtcagtgaggggatctcatgcgggtaaggcgttcatggcgtagctgtgagaggaggtcggggtcacggggcggccaggtgagtcgtgaacggcatatttcgtgatggcatagcatctgatttttttttttgtatttttctcttgtcgtattcagagacaagttttgatgtcgtgcacaagtgaatttattcgggtttatctccatgagaaaggttcaaactgggagtactgaagaggatgaatttggcagctgtggaataaattctatttaaattcccttcttttttgaaagggatttaccaacaatgctttaaaatatagttagaaataatatttactgaatttttagaatagttaataaaagataactacctatgtttcccgttttaacttttttataaatcaaacttttttagatttgattaagtttgtagaaaaatataacaatattttcaacacaaaacaaataaattatcaaaatatgttcaatgttagatataatgaaaataatttggtgctacagttgttgctatatttttctataaattttgtcaaactttctaaaaaaattgacttaaaaaaatcaaagcgacttatattttgaaaaaaggagtactttcatatgtttccaaaaataattttatgtggatatttcatttatcttttcaatgatctttaaaatggagccagataacaaaaacgacgggaaagaaaacctccaaaagtaatcccaaaacaaaattccaataaattcaaataaacttttggatctcataatcgaaaccactcgaaataagttcactagaggtccctcaatttaacagcgagattttttaaggtcctttaaccataaaaccagaaatctttacccttaaactatacaaaaccgtctaatttgggtcctaaggcagtatagatggctggttttgatgacgtggtatccttgtcagtaaaaataataaaataaatatgtgggggcccatacgtcagtgagagaaaatgatgtggccccacatctcttttttcttttctttttctctgctcttctcaacttctcggttcgcatgcgcaggcgagcaaatggcggccgacggcggcgcgctgggaagaagcaggagaggggagagaggaggcggccgacgccagagaaggggaaagaggcggccggcgcgaccgcccgtgaggccgcaacggcaggagcggcggccggcgtcgcctctccccatccggaggcgggagctgcaccggctccgggcgcgggcagcgcgcagccggagcaggcggtgtcaacggtcgagcgcggctgtggcggtgggcgagcgccggctccgggcgcggccggagcagtgcggcggcggcaagtggcgggcgagcggccgacgaggtagtcggcgacggagaagaatacttcaataagcttcactagccgccgcctccggagacggagagctcctcgtcggagttctaatccaacgtggctgctgcctcacaatttatatatatatatatatatatatatatatatatatatatatatatatataactacttgtctataaacgattgattctgttgtgtttgagaattaagatggtggatccagtgagtagcgtgaagcatatcacggagatggctctgaagatcaagcatgcggtggggacggtttagagaaacaagtaggactgcctccagatcagaaggcgagtgatgagagtgagcgatatactgtcgctgctgcaggaaacggagaacatcttgagcaacccggcaataagcgccgcgttggaggatctcgccgacacaaatttctcactgtgctcctaccttttttgcctctgtaacagcggggagaatgggcaaaagtgggagcggcagcgatggcatcggcatgcggtgggagcagcggcggtcgtggcggcgcgtggtgggagcggcggccctgggggggggaggggaacggcggccgtggcaacgtgcggtcggagcagcagtggcctcggcgacgacggggaacatgggtgacggtaggagcggggaggagtcggcccgcggcgggagcagcggtggccgtggcagcgcgtggcgggccgcgacggcgggagcggcagaggcgtcgactcgaggtgggagcggcggtgacggcatcagcgcgcggtgggagcaggggaggccgcggcggcgtgcggcaacgtaactgacatgtgggccccacctaccagtcatcaatactgccttgggacctaaattagacagttttgtatagtttaggggtaaagatttctggttttatggttaagttgagggatctccggtgaacttattccaaaccactcccaaccacaacgcgagtccattgaactgggccagactaacgtaaatgggccgggccgaggcccaaagacatttccatccagttttgggcttcccccccgaactcaccagggcccacctcgcctgccacccccacctcctctgcgcgggaaaccgttgctcgttggcgccaatttttcccgccatttcgccccccgcgccgcctccctcttaaccccacctcctcctcctcccccaaccctagcagccactcctccccaccttactcccccccgcttccactcccccgaaccttccagaaccttctcccgctcccccgccgagatggtaagctccccttcctcttccttcagcgcggcggcggcggccggatctgacgcctcgccgtgtttttttttcttttttgggtaggatgactcggagaacaacgcgccgtcgacgccggggtcgccggggttcagcacagacaggctgccgccgaacaccaccaccagccgcggcgccaccgacccgtcctcctactcggacgacgacgacgacgacgtggttggcgcggaggaggcggaggtcgaccccaacgtgctccccgaggacgacggcgtcgtcgccgccgaggaggaggaggacggggaggacctcttcaacgacaactacctcgagtaagcgagaattcccagatctgatgttcattctagttcggttgacaagtgagatctggtttgattagaagtttgtttttgtggcttagtgggagaattagaagttttagtgtttatgttaaatatttgctttagggattggcaaatttggccgttgactggctcatataagagggattgaccaattacttgactaaattgtgtactttttggtcaaagaattttaagtacaattttttactgtagtggtgctacaaatacttcaatggtgtagaagcaaacaactcttatcctactgtgttctgtcacattgaaatgtccacaaagttctttcattttgattagataatctcttgctctgtttaattacctataagtttattaattttggtttacatgtataaattagttgaaggatttattgatcacttcgcctgttgccttgatgcttattctgttaagttatgtagttggcacaataaacggatacaatacatttggctgttaatttgcctaattgatattgtttgaattaacggtcctcttgctacacagtttcttttagcagttcagtacaaagggactacctgtctttataaatccatgaaacattataaaactctcaagtcaatgcaaactcgtcagatgttgcaagttattgttaaattccacagttttgattaacatattgcatcttttccctccttttatagtgattaccggaggatggatgagcaggaccagtatgaatcggttgggttagatgactcgatagaggatgaaaggaacctggatgagatcatggcagatagaagggctgctgaagcagaacttgatgcaagggatgtgaggactggtgcagcacctgataggaaattgccacggatgctacatgatcaaggtaatggcattgtgaaaaattgcatttccatgagatattagaactgaaccccacctttctgctgttgtactttatattcttgttacttgagaatttgagatatgttaatttgatatggttagctttagtcgaatgctatgttttaatgcttcttgggtcaactatatgtaactgaggttgtatactccatttgcatttgcttcttttaagtctgattcaacccgtagtgtggttgtgaattttgagttttggacttcagtgatgattttttcttaaatattcaatatggagcatcacattactgaatatattatctgagtttgacattgtggtatggttgtgaacttgcagtagtaatcctttctatatttactaaaattagtttgcttgaaacttgtttattctttctatgagatattctttctggtcagttggtcttggtaattgtaagttgaagatagtgtttcttttatggtgcagacacagatgaggatatgagcttcaggcgtcctaaaaggcacagagctaattttagaccaccaagggaaccaagaacaccaagaagtgatgatgacggtgatggtgccacgcctagttcacctggaagatctcagcgtggaatgtattctggaggggatgtacctatgactgaccagactgatgatgatccatatgaggtattgatgtttgaactaaaattaccttaagttcctttagattttccaattggtcgccgtcctatttgctgagcatattttatatgcaggatgaatttgatgaagaagatgagatgaacatgtaccgtgtacaaggaactcttagagagtgggtcacaagagatgaagtccgccgctttatcgcaaagaagttcaaagaattccttctaacatatgtaaacccaaagaatgaacaaggagagtttgagtatgttcgactaatcaatgagatggttctaggtatgattctcttttcctttttgcatgaaaaaaggccacatttgttggcattgtaagaaatgcttgcttacctaatgtttcctctcctctttgcagctaacaaatgcagcttagagatagattacaagcaatttatttatatacatccaaacattgctatatggttggctgatgcacctcaatcggtgctagaagttatggaggaagttgccaaaaatgttgtttttgatctccataagaactataggaacattcatcaaaaaatctatgtccgaataaccaatcttcctgtctacgaccaaatacgcaatatcaggtcagtacatgctttctttagtatggtatttagaagtcaaattgattgattgtctgtgcttatatgctacttgccaaatttcaggcaaatccatctgaacacaatgattcgaattggtggtgttgttactcggagatcaggtgtttttcctcagctacaacaggtcaagtttgactgcagcaaatgtgggactgtcctgggccccttcttccagaactcttacactgaagtcaaggttggatcctgccctgagtgccaatccaaagggccattcaccatcaatgttgagcaagtaagttgcctgggacgatggtagttctgatacatttgggctttcttctctgtcttaatgcatgaacatgtttttggttctaatattcaaactgttctcttttaataacagttgatttatttgtctcacagaccatatataggaactaccagaaactcactcttcaggaaagcccaggaattgttcctgctggcaggcttccaagatacaaggaagtgatacttctgaatgatttgattgactgtgctcgaccaggagaggaaattgtaagtcttctgcatgtaccttttttatttctacatcttattgtagaaagcatgttctaattgactatctgcccatgttcaggaggtcactgggatatacaccaacaattttgacttgtctttgaatacaaagaatggtttcccagtttttgccacagtagtggaggcaaactatgtggcaaaaaaacaggatctgttctctgcttacaaattaactgatgaggacaaggcggagattgagaagttggcaaaagatccacggatcggtgaaagggtttgtgcttaatccttaagccccttgactcaattataataagctaatcagtattgtctgacaaatgacttattgtttacagattgtcaaatcaattgcaccatccatatatggtcatgaagatatcaagactgccattgcactagctatgtttggggggcaagagaagaatgtcaagggaaagcatcgcttgagaggagatatcaatgtactcctcttaggtgatccaggcactgcaaaatcccaatttctcaagtaaggaataggcaatcagtttcatcatctctctttttattgctccattaactcaatatttcattatctaaaaaattaactcactgttttgtaggtatgttgagaaaactggacacagagcagtgtacacaactggaaaaggagcttctgctgttggactcaccgcagcagttcacaaggatccagtaacacgggaatggacacttgagggtggtgcactagtgcttgctgatagaggcatatgccttattgatgaatttgataagatgaacgatcaagataggtatgtgtaataccatttggataatgtgtgcttttaagcatttatgttctattgccctaagatatctttctcttattgtttcagggtgagtattcatgaggccatggagcaacaaagtatcagtatatcaaaggccggaattgtcacatcccttcaagctcggtgcagtgttattgctgcagcaaacccaataggaggaaggtgatgtgatctacttgctcaggatgttttcaaacaattgttttgagcaatatacttaattttatcatgttattgcagatatgattcatcgaagacattcacccagaatgttgaactgacggatccaattatttcacgttttgatgtcctttgtgttgtgaaggtttggagctgattttgctgtgtaatatatttttgcagtcctggtatctatctgtactgattttttctggtgcaaatgcaggacattgttgacccatttacagatgaaatgcttgcaaggtttgttgtagatagtcatgcaagatctcaacccaagggtgctaaccttgaagatagggttccaactgatgttgaggatgatccattggctgctgccagacaagctgacccagatgtacgaaccctttgtacttcgcacaacagaaacatttttttactaaatttcattgtttttaacaaaatcctatattttttagatcctttctcaagacatgctgaagaagtacataacttatgccaagttgaacgtgtttcccaaaattcatgatgctgacctggacaagattagccatgtttacgcagaacttcgtcgtgagtcatctgtaagatatccttgtttcttgtccatatcaaatgcatcttatcaaatacttaaatatcttgccgaattggatattgatacctatgaaaactggaaaccaacatgatatccaacctattttcttgtttcagcatggtcaaggagtccctattgccgtaaggcatatcgaatccattattcggatgtcagaggcacatgcaaggatgcatttgaggagctacgtgtctcaggaagatgtcgacatggctatccgcgtcctgcttgactcatttatttcaactcagaagtttggtgtacagaaagcacttcaaaaggtaaattttgattttgctgttgtattgctattctatcatcttccaactgatgcatacctagcatgagtttgaactgttgtaagctgccttagttttttagcaaatgttacttgcattatgcggtctattacttgctgaactcattccgagctcaaacctatgccccttcctttctttgttttcaccaatgtaactgtagttcctcaccatttctgcaaattttaaagtatgtttcttctgcctctacagaatttcaggaaatacatgacctataagaaggattacaatgagctgctcttgcttcttctgcgcaccctggtcaaggatgtgctgcacttcgaagaaatcgtttcaggaccaacgacgcgcctgactcacatcgaggttaaagtagaggacctgaagaacaaggtatgagccaagatctccgcctcacccacacgcctttctaaccaagcttattgcgcaaaaatgcttcgtcatccagatttcgctcttgattccggtacatctgtctgatgcaggcccaggagtacgaaatctatgacctgagaccgttcttctccagcgcccacttcagggacaacaacttcgtcctcgacgaagggcgggggatcatcaggcaccctcttgctgcctaactacagaagatcatctgtgacccatctgacaatgaacaatttgagctacctcatgggattatcagacatagtgtaatcatcaaatggcaactcctttgtgctttttagagactgttgcatgttatccagctgcatttggatagggtgtaccgtgtgtactttcttaacattgtaattctgcaagtatggtagaaaatgataaatctgtgtcaatcaatgtatcattgttttgcattattgttttcatttttttcctcatccgatgaagctataattttgcacatgatataactttgctgggatggacatgacatggtaggcatcttcatcactgcgattaacatggtaaaaataagtcagctacagcagctacggtaacactagctccctaattaacataactccaccaaaacgaatcccttgatattaacatggtaaaaataagtcagctacagcagctacggtaacactagctccctaattaacatatgtatatgtaaaactatatgtatacataaaagtatatttatttaataatgaatcaaatgataggaaaataattaataattacttaaattttttgaataagacgaacgtcagacatatttaaaaagtcaacggcgtcaaatatttaaaagataatatattctataccactgactttattcgagttcaacaatttgctatcgacattgtctctttttataatatactggcgacctggtatatttagtttttataaaaaaaatatttctatgtggtatatgcaaaagaatttgcttatacaaaagataatagcacagaaatatctgtagtgtatgaaagatgatttatattaaaaacaacaataaagaagtattttatatatcatatcacatacaagttacattttttttaaaaaaaataaaaatgtaaaaaacctgaaacttttatataaatttccatgttatataagaaggccacataaatgagataaatcaataattaacattgtatgtccataagggtattttgggtatttttgaaaagaagtcccaacccaattacgtattgtagaacaattgattgataaagttgccggtatattatagaaaatgacaatgttgatggcaaaccattgaactcaaataaacttacagaatagattctcttagtatttagggatggagggagtagaagttttgtaaaggatcactaaaatatttatccaatcaaaggatcctacggcctagaccatctggatccgaaatcggacggcctatgtttattggatgacgtggcccaataagaggtattacttacttccttcactactttcaattcgtacaaaatccctcaaaaaaaaaaggaaagaaaaccccccttttcacactaacctctactctcccccgtctcagttcccgatctgcagcggcggaggagagagagacaccgccgccgccgccgccgccctccggcgaactcggccgggaggcgcacggcgtgggacggacaccagcaccaccctccctctcttcctctccttcctcaccccccaacccccgacccccgacccccgacccccgtctcggttcatccgcgcggcctccattccatctcggcggctcgaatccaaccgaaggtacgccgctcgtctcccccccctagccctccctctcaatcctccggcggcgccgccgcttcgtgaggccgtgcgcggcgtggattgccttttgagttgggttggttagataaacccttccggatttttttttttttggtttcgtgcgcgtggttgcggtgctaatatcagttcgtttatttcattgaggtttgggggttcagatgaactcacatgtaccgattaatggtgaagcttgttgtggagtggcagtggcggggatttatcattgtgggaaaatgtaggataatttcttagctttcccttgtccgtaatcactttatactactggagtagaacgtagaaatccgtgcacttcggatttcagagcgtttgccttgcttcagcgaacaattttacttgttcatacgtgttcgattgctcaagggatgataacgacccattgcaggtgttatcgttagttcagatgttagattgttagggggataaaaggtgttaggtgcaaggtcatgcatatctaagttatgttttcgtgcatttgaagtatatatatatttatgcaaggtcatgcatctctacattaagaatgcagtggtaatcttatagatatttatttatgataatggcttttgtatgaaattagactccttcactgtatctttgattccagtagagtatgtgttcacttatgctggaatgacaggataatatccactgagaggctcaactgcatgtatttcaccagtagagtaaactagcaatagttttttttttttttttagaaaaaggcagccgcccagcttttgataaaaagcataaagagttcgtacaggcaatagtttagttctggcatttgggtaacaccacatcttgctcttcgctttatctctcttcataactttaaccagtccaatgttttgtgctccttaagtagtgtcatcaactatggtaatttttgttattcttagctcaggatccagatgttagttgcagaggtgttcagagcaggagcatacatctctagattttcgcgacatgcatgccaagtatatactgctaccgaaactctttatagggacagaaatttacttgtcaatgcttttccctgcattaaagtacagttacttgccttgagagaggggtactatgtataatttctggaacaaaattgtaggagaaaatcgcttcatagttctgtttttatgattttccttgacatgggatcctctctacttatttatttatttttatttctgtttagttctttattataaaacttaacgcctgttcatttataagttatagcactcactgcgattataagcctgcttaccctttttttataattaatttattttctaatatctgagcgaattttcatctaatatgttgctttctggaattcaggttgcaagattttcgggcattagctgtgcacccatttctcaattcagaagacctcaatctctggagggcagcagaaaactaaggtcttgctgctttattcaaacccgactgatagccatggctacaaccctctccaatggtgtttcacagaatggccctcagaggaactatcaggtagttgttgctgctactcgcgacatgggcattggaaaggatggggtcttgccatggaagctccttggcgaccttaaatttttcaaggagcttacagtgactacagctgatcctgtgaagaaaaatgctgttataatggggaggaaaacatgggagagtttaccccttaaggctaggccattgcctggccgtttgaacatcatattgactaggtctggtagttttgagtttgcaacagtcgaaaatgttgttatctgtggaagcatgaactctgcattggaactactatcatcaactccatactgtttatccattgagaaagtttttgttatagggggtggacaagtactaaggtgagctgttaacttttgccaaagcatctagtatgtaaattgtgttgtttctgtatactccacctcaactctattcacctttatctgtaaaatttcactgtagggaatctcttaatggaccttcatgtgaggcagtccatttaactgacattcagtcaagcattgagtgtgacacctttattcctccgattgacttatcggtgttccaaccatggtattcatctttgcctgtggtagagagcaacattaggcattcgtttgtgacctatgttcgggttagaaaaacaatggcagaaacacatgactcaaatggcaaggaatcagctaatgatggtatcaagagtgacaaatttgaaaccgagaatttctcttttctccctaagttgatatttgaccgccatgaggagtatcactatctcaatcttgttgaagatattataaggagtggtgctcagaaaaatgacagaacaggaacagggacattatcgaaatttggttgtcaggtattttctctttaatgttgtgaataattaatttgaataaccagaaataacctgtctttaacttgaataaacagaaaatataacatgtctttcttttgctcatcagatgcggttcaacttaaggaatagcttcccattgttgacaacaaaggtatgcatgttttgcactaaagcacatcagtttgcatctaattgatttattttgataatgatgaacaaacaattctgtggaaatgagaaatgggttttccttaaataaaaagatggatttaacagaaaagaagcatgcggggggaaatgtggttatgaaacttatgtttctctggtttggatatcttcatagtgcttcagaccaattagttttcaatacatgtcaaattggctgctattgtgtcttattggtttactttcaatcttttttcatcacacatgcccttttctttgcctattatttgtaactaaatagctaattgttgcatggtctgaatagtacagtctttgtaactggctatcatctttactaaggcaaaaataagatgctcagtgtgatgttggtgctgagttcatacttgtaacttgggacattcttctgtacacagtagaaaaaaattgggacattcttctgtacatgggagaaaaaaaatattcattttctactgagtttccacacctccggatcatactattaattgtatcattgtgtcctgggttactgccttcttttttttccctaccagtctattttactgatgttcgtatatgatttggagatttagtgccacattttgtagaagcatagtacaattttgtaacgcaacttcttgaaaaatgtatatgtagaaactagcccctcttaagctgtataatgtgagtgttgggtttccttttctttattattgaaatataataacatgatgctctttaacagaaggtattttggaggggtgttgttgaagaactcctgtggttcatcagtggctcgacaagtgcaaaggtgcttctgcttaaaatttaatatttcattggaaatgttatatccatacgcaatctatatactgtctcgatgctttaaattacttatccagacgagccatgaatgcttatcagcctaaaactggatcctcgtgttctttttcatcatatgtccatgcacaaataaagcccatgatgttatcttgtctatagcaactccaacatgtaattttgcagctctaacaatcttagagtaattttacaccaggaaaatctcatatgaccgattgttcaaattcagtgcgatatttatttacctgtgcagtctggtctatttattcagaagggcctcaattacaagcttggcaaaagcctgatggaagtttatgttgtccctagatatatgaatattttctgtggggtggaaaacttttcttttcaattttttgagcgttgaccatacttaaatcacagttttcttttctttttctgttatgtaactactttctgcatcagttatgttgggtgtatccattaactattgcagcagatgaggcataagtgaatattgttagattttagtttcttcacatgagctcccatgcttaccactttggtacaatgatacatttttctaccttcaggttttacaagagaaaggcattcatatttgggatggcaatgcttcgagagagtatcttgacaggtatttatcttggatccacactagtcgagaaacaatggatattgctgttcttggttctcgtgctctgatccatttggcaaaattttactgtgttctagtgttggcttagcacatagggaagaaggtgatctaggtccagtttatggatttcaatgcgacactttggtgctgagtaagtttttctctcacccc

SEQ ID NO: 73229 - DNA, 2901 bp, Oryza sativa
cagccaacggtgttctatagagaacagacctgcggtctgcgactttggcgcagccaacggcaacagtgccgcagcggcagataaaacaaccagtgtggctttccgaacacatcccatatctttaatcagatgcatggaaaatcatatacacagtagatattttgaattatatcgtgtaataaaaataaaatgtactttctccgtttcacaatataagtcattttagcatttctcatatttatattgatgttaatgaatctaaatagatatatatatatatatatatatatatatatatatatatatatatatatatatatgtctagatacatttacatcaatatgaatatgaaaaatgctaaaatgacttacattgtgaaacggatggagtagcaacaaacagtaatggtcgaaatcacattctgaacactcatggctggacgacggactaccatgttttcatttgagaacttattgggttgattcccaacggaaagaaagaaattgaggacgattaattccatatctttattatctcaaaatgttctttactctgacctcaactcctattacccttttttttttgtctgtacgcttcacaaattactaaacgacatgcttttttttaagaaaagaattgctacaaaaatattgctttaaaacatcatattaacatgtattctttaaacttcttttaaattaatatttaattaatcatgtgttgacgagctatcccattttttttcgagggaaagaagtccccaaccatcatgtccaaacaaacataacctcaatcttcatgctaaaggtaaaaggtattaggccatgttttccatgcaaaaacttttcatcgtgtcacatcgaatgttttggacatagattgcatgtaaattgcgagacgaatcttttaggcctaattgctctataatttgacaatgtgatgctacagcaaacatttgctaatgacaaattaattaggcttaataaatttatctcgcagcttacagacgaaatctataatttattttattattagtctacgtttaatactttaaatatatatatccgtatattcgatgtgacccctaaaactaaacatggccttattattacctgaacaaggcctgaatgtggtcggtaggactgtccaaggatccagaattccagatatatactactacctccatcccaaaaaaaagtgcagctatagatatccgcgtttagcgttttgaccgttcgtattatttgaaaaatttataaaaaaattaaaaaaatagtcacacataaaatattattcatgttttattatgtaataacaataaaaatactaatcatattttttttaaaataagacgaacgatcaaacattggatataaacagtgtcaaaattgtacttattttgaaacgttgggagaaccactagtaggagggaggaggtgtcaactcctattttgcaaccgccccttgttggctggagaggcagaacataaatacatgcttgctgattgctctgacctcttgttggagccggagggcaaattacttgagactagagagtagagactgatccactcgattggatccaacggccgccggctcttggacaaaccgagcggccaggacagcagggagccagggagagcctctcctcttaacaaattataatattaaagtttttgaggggctggagtgctaaataacccctcaccctttggccgcctcgacgagtccgccccgtcccgtcacggagcggccagccagcagccagcgggcaaaaccgacgaggcaagacgttttttgcggagacccccctggagttctctggtttctctacttttaggctgcgttcgagcgcaggagaaagagagaaagattgtttcgttttccacgcgcacgcttcccgaagtattaaactatgttctttttgcaaaaaaattttataggaaaattgctttaaaaaatcatattaatccatttttaaagtttaaaataattaatactcaattaatcatgtgctaatagctcacttcgttttacgtatcttatcaatatcctcaatcccctccttctctaacacactcttagcctctcgacctaggttctctctctgaaaaatcaatgtaaccgtagctctaaaagtcccaagagcaactttgtgttattattgtttgcgagacctttttattgcagtgtgtaagaacttgttttgaaaatgcacgaggaacttcacctgggatactttagtctcatttgattcatcggaatttcaacgggatatttcttcgtcgctattagtatatgttagaggatggttgttagttgttggattcaagatgagcactcagcaccatatgtttcacaacggaatgcacgcctttatcattctatttcccaaccaaatggctcgagtatcaagtcctcgtcttcgtaaaaaaacaaccgcacattttactcattttaccactatcgtcatagctaaatctctagtttaaatccaaacataattgtttcgatgaataccacgaatcgctcctcccgattaatgtcttcatcggttgctcatataccctaataattagataagacttttatatatttatttttagggatttaaaagttaatattgaaaaagaaaccacattaaaatatcttaaaatcaacattaaaattaagtttcaaaatttaaattttagcttttgctttagattattacgccaaccgatggaaccataaagtttgcacaaaggttttcttcaaaaataattttgcacaaaggtccattttcaaaattacctaaaactcaagggaccccatccaaaaccccaaaccatatttctatatcccctcaacctctctctctcctctatctcttcaccattctcaaccccccccccccccca

SEQ ID NO: 73230 - DNA, 20018 bp, Oryza sativa
ttagtcccagttggtactaaagataccctctttttagtttcggttggtgttaccaaccaggactaaagatggatctttagtcacggttatttcaatcgggactaaagatgggcatctttagtcctggattcctagctctggttggaaacccgggactaaagagtgttaccaaccaggagtagaaacggtttctccagcagtgtttcccatccatcccactcgttcactctccccactcctcacactcaatcatctccccactcttaacactccctctccaacttcaccactcatctcctgtctccttatactccctctcttcccaactacgagcgagggcggttattgagggtgagagcaacaggcttcaacggcgggctcaagttagagtagaggctgcgggctcgagcaagagggatctcgccggcggcggcaatgggagagtcggatccagcgccccctccccttccctcgcggatcccggcgcctctccaccccgccttgcgtgaggatctgtcggcggcttcgagcgacaaggacgacaacgacggcagtggcgctggtggcttctggattctagggttagggtttcggggataggtttttgttttccgatttttttttgcattttttccttttcgttatcggatggcttaagtgtccacatgcggaaattgaattttcatatgggttgctctacccgcatgcaaaaatatggttttcgcagccactgggcgccggcggttgccacctccgcctgcgaaaatatgatctaaccatatggaaaaaaaaccctttttctctaatatagtgcatacaaattagctggccatttgtcaatctatcgtaccattgaaatggtcagacaaattgtaaccctatacacctcttctatatgtgcgtgactcggccaccgcacctcctcatgtccaaaaacaaaacttaaccaaatcagaggatgcaccacttacagccggacaaccagcatcgaccgtacagtgaggtgatgaatctggtcagttaaccaaggaacaaaccggatcttgaacttaacacacaaatttctcgtcaaaatcaagcgctgtgttcgatcgatcggcgtgtagcatgcatgcatttgcgtttgcaaattgcaattgagcgcgtggaattagcggaaaccgggtgctacgtatacgtaattgcgtgcgtacgtccatgcatcagctgcatgcaatatgcagagtcggtgcgcacatgcgcaatatgcaaagagctaattggctctaaattacaaattaattaattagctccagatctagctactatcagatcactctcggatatactccctccgtattttaatgtataacgccgttgacttttcaaccaacgtttgactattcgttttattcaaaatttttatgtaaataccaaaatatttatgtcatgcttaaaaaatatttgatgacgaatcaagccacaataaaataaatgataattacataaattttttgaataagacgaatggtcaaacgttgaaaaaaagtcaacggcgtcatatatttaaatatagaggtagtaattaatttgatcgaccgtaccgtaggtacgtactttgaattcgtcatgcaaatggagctgatcaacagaccaagggatcattgcattccccaagctagctgccggctgatcgatctggccgaacactgacctaaaaagagaagagagggcaggcccgtagatggacagggccctcatatatattttagttttcaattccaacggaatgtgtgttttggtatgtttgatgacattcttatcattttgtttacttccgctactactactccttcactaaatctcgctaaacaaacatgtttttcttcatctatgctttctatataagtgagaccacaaacagacaccacgtttagccacgtcatcaaaaatagtttcaaccgttagattgataattctttcgagtattagccgttagataaaagtcccctctacttcctcaccaattaaacaacgccattaatcaccaccccatctaaatgctatctaattaatcaggtagtcaattggacaataatacaatcaagatatcatatcatatttactattccaaccatcattcaatcaattggatccatgccactacaaatatgccaaattaaaaaaatatcactattattcacgtgccactgcaattttaggaaattggatccatgccactccgtcgcattttccatttgacgccgtctctctgcgtcctccgcccatggtgtgccactgatgtggctgaggtgctctggcgtggccaccgatggcggcagcagcggtgcagccgaccgtgcgaagctccacaggtcgtcgtcgccgccgatggcaccgccgagcagcctcgtggcagtggcggagtagtaagcgaggccgtcggctgctgaggcatcggtggcggcggcggcggcgtcgaagcagacctggtcgtcaagagcgtcggggtagccgttgaggtgtgcgacgcgacgaggcggtccatcatggcccagtccgtgtggtggtggtagtggagcagcaggtggtcggcggcggtggtcgacgaggccgcatcgcagccgtgcttggagtagacgagagcgttgtggccgccgacgggctctcgagtggcggcagtttcatcaagccgtggccgtcgagcacgatgtcgattggccggagataccttgacgccggcctgctgctgccgccgccgctggcctgcggcgaggtgagctcgtgctcctgcttgcacgacctgcccatgtactgcaggatctcgtcggtgtatggtctccctgaggcggcgcgtctcctcgtcctctgcccaaggcacgccgccgccgccgcagcatgagctccagcccggcgtgcacgagccctcgaggacagccagtgggcggctgtggatggcattgatggagtggttaggagcctcggccgatccagcggggtaagccgccggagatggggaggagttaggattactgcaacacaaacttgcaagtccatcaccaactagaggagatggggagaaaaatgtgtgtggggcccacggttggccaagtttggctagtggagggaagattttgacaagctagatggcttagagcatctccaacagcctctccatcccaccctccaagccaaattttagcaactttggataaaaaatgcactccaacagaatgactatcccctagccaaaaaatagcaatggccaaagatgggctcaagctagtcaaatttggcaagccgttagccatcctcagcaactagccatatgtgggcccgactatctttttcccttctctttccccaccatccgcacatcccctgctcgtgctctccctccctcagcctattgctgctgcgcccctccttcctcacccgtgcctgccgccgccacggaaggagtgcctctgcttcgtcggcggcgggatgggagaccagcagtgaagagtgtgaccgccgcgcgcctcctcccaatccctctactccatgggcgccgacgagttcgccgagatgctggtgctcgacggctgcttcctgctcgagttcttcctgagaagagtgaggggcagctcgccatgcccggcgttgtcgccggccatctggaagcagccgcccgtcccgtccccgcgctccagcgacggcgctggcgaggaaggctacagtgacattcaaacaacaaaagtactaattactaaacatactgggagcagagcatattttattcaatcaagtggagaatttataataaaaacaaagattgttttcctcgttgtgctatactcctaatcttgtggagattatgggtaccccatacctacacagcatgtacatccgattgagtatgtggtgccatgtatagatagaatatcttaaaagggactcgggttaaattccaaacttgtatgtcaaggaaatacccgggatcctagtcggttacgattacatcatatctgtaactacctattccgttagagatatgggctgtactttgtaatacggactccttcccctatataaggaggggtccgggtgcctcttggggcacgattttctcccagatcatacgatcaataacatactcggcggatcaatccccggacaggagtagggtattacttcttgttaacaaggcctgaacctgtataaaattccttgtctctcaacccatccacttttctagcttgatagccacccccttttagtattgccgaaatcttgtttcaacagttggcgcgccaagtaggggtagcgtcaagttcttcattgattagtgcgatgggtttcgtctccggcatcgacaactttgtcttccctcccgggcaggcgttccggttcggcagcctcgacttcatcaccaacaacttcggcaagatttctctcctcgactcggattcgaaccagtcgggaagaggccaggtttccgccccgttcggtatcccgaactcggccgagatctactccgcgatcatctcaaccgagttagctccaaaccactcggacgagatccaatctactccaacacgacccgatcaagacaatagagcttatcccttaatcctaatgaaactccccgatgacttggctgccgtcttcaccacaagggcgtcctctccccgaggcctaggcgggatctggcctcggccccgatccagtctagctccagggaagtcggcgtcatactccagcctctcggcacggtttcgacggaacaattggacggctacctcagctcccccggtgtcgactcccgaccgacaaagatcgtagagtacgacgacttcggctaccgctacgactaccgcaacctcgacgacttcgacgaaggctacaaagataactacatgcctctctacttcggcattttcatggccgacaacgagacggaagaacaacgccaagcctgagaagcagaagaatagcgcgtgcgacaagaagctgaacgtcgccgactggaggaggagcgtcaaacacaagagcgagaacgactgtagcgtgagcaacaggagcgcgaacgggctgcaaaggaggccgaggaccggcgacagcgcgccttggaggccgggcgacgagcacgagaactcatcggccaacaagacgtcgaggggacggcggtttttcgcaccccccagcagaacgcggttgcagcgatcacccttctcgacacccttctcaaggaagacgcactcaatcaggccaatcacgtcgtcaacatcttgaaccagactaagaccatgatcgccgcttcggtcccggtcaaccccgcaagcgtccatacgccgactggcagccgagttccgcctcttcgatctcaagactatcaccaaccaagcgtcagtgtcgtcggcgcaggatccaatcacaggagcagggatcacggtgaacgatctgtccactcgcctcctgaccgacgcagggagcatcgagccgaacatccccactccccacatcgcaggcgtcccgtcgatcttcgcgaaactatcaaccagcgtcgcgcggcaagaggctacatcccccaccattcaccagatcgttacgacgacgatgtggatggagttgctgccttcacaagcgacctgcgtcgagtggattggccggccggcttcaagccgactagaatcgagaagtatgacggcacgacaaaccctgagtcttggcttaccgtctacagtgttgcaatccgcgcagcaggaggagacagcaaagccatggcaaactatctgcctgtggccttagcggattctacccggtcctggcttcacagattaccccgtggcacaatcggatcttgggcagagctttgcgaccacttcatcgccaacttccagggcacctttgaatgtcctggcacccaatttgatctctacaacgttgtctagtagtccggagaatcccttcgagattacatccgacgtttttccgagcaacgcaacaagatctccgacatcaccgacgacgtcatcatcgccgccttcaccaagggcattcgccatgatctcttagtcggcaaatttggccgtaagcctcccaggacggtcaagcagatgtttgaaaaagccaatgagtacgcaaaagccgaagatgctatcactgcaaaagccaaaaaagccgaagatgctgttcatattttaagccgtcactgataatggcactcaattcactagcggagtatttaaagatttctgtaaagacttcggcatcaaaatttgttatgtctccgtagcgcatcctatgagcaatagacaagtcgaacgcgccaatgatatggtacttcaatgaataaaagcacgagttttcgaccgactgcatccctatgctggcaaatgggtagatcagctgccatctgtactttggtccctgcgcacaacacccagtcgggctacgggccagtcaccgttttttctggtctatggcgcggaagcaatgttgccaagtgaggtagaattcgaatctttgcgatttcgtaacttcagggaggagcgctacgaggaagaccgagtggatgatctcaaccgactggaggaagcccgtgaagcagccttaatccagtcggctcggtatttacaagggatgcgacgttatcacaaccgcaatgttcgatcacgagcatttttagtcggagacctggttttgaggaaaattcaaactacatgagatcagcacaagttatctcccttgtgggaaggaccgttcataatttctgaagttacttggccaggttcttactgacttaagcgtgaagacggtactcatattaacaactcgtggaatattgaacaccttcatcgtttttatgcttaggcattacttttgtatcttcctctttgaatgctaacatcaagttactccttgagttatcagtcgggggctactataataataatggagtgtgatttttatcaattcaatttgcttactggatctatcattgctctgttcgattttttggcttagtcagtgaggactgaaagtttttaagaacttttgtggtttttaggctcaataaggtttgataaaacttctaagaaatcaggagctgagtttaaatcatcaagcacagcataaattcatcagtattgtacaaattgtgcctccattatcatcatcagaatacaaaatcaatcagtttcagttttttcatcatcagagttatcagacccaatcggccttaggtcgttgtcctggaacctctcaactacatcaacggctatcttgtcagcagctttttgcgcatcattgatgaggtcaagggcggcttcttcacttgtcccgtctgcaaagccatcaacagcatcaatgtcaatcttcgggtacaaggacttggtcatcgccaacgccagactcgctcccatacttccagcttctttgatgttcttaaaatatgtatccggagcaattctcagcttgtcaaagatttcggcagcatcaaatgaacttggaccattgttattgaaaaacatggcttggacgagtggtgtagtagcattggcgacttcatctctagctccttcaagcctcttgattttgctgaccaagacgtcgaattgagactgggatttgattttgcgatttgcacaaatagattcacatcaacgaatgagcaagaagatgagaatggtttcaaagtttcagctacaagtaccttcgacatctttcagaaccgagtccctttgcttcgtcagttcgcccttgtctttctccagagccttgattcgcttttctagctcggatatcttggcagcttgcactgtattgctttccactgattaatcacatatggatagcagcgcgaaacaagtcagacaagaataagagttacctttggatgaaccactcagctcaaagttggagtcttgaagctcggcaatccggtccctaagttcatactcagtctttctggcaagctccttagcttcacgaagttggtctctggttgcttccagggttccaagatgggggaccaatctctcgagagtttcagtctttgcctcattcctaagatggattctctgcaccacaaatttatctttgcttaagtaaagtggccgacaagatgattgaggctgtgtgtgaagagacatacatttacaagacgagtggcctgactgagtgtcttcttcagcagacatacttcctcgtcttccttttgtttatttatcacaattccttgtggttgcatttcgtcatcccaccatttaactaatatgggtgggcgagaatcttcagccgaccgtatccggaggacttcttcttcatcaccaaccattgggccttatacattcatgaacaatgatgaagcaattgaagaaagtttgttggatcagagtggatttagaagaattgcttacctgttatgacttctggttggggacgagcaggcccttccaccctaacaggagagctcgatcccggatcggtgctggcatccttttgaggagggctgctagtttgagcctccacttccgggatgtcttcattttgttctgtacccgattggtttccagtcgggggctcctaatcagcaccgactccaacttcggctgactggtttccagtcgggggttcgttgctggcctctacattgtcggttgctggttgattactactcgggcgatcttcggcagtcagcccgatttccgttgtaggaccagtctccacgccagtcggctcaaggtcttttccagaaggatcgatgtcagatggcttcctgcaaatttgaaatatgctatcaacactacttcaatagtgagtgaccagcgaaacaggggaaattgctaaatgacttgtacctggatgacttcctaatttttggtataggacgactggacgttttcttcttcaggttagcttgtcttggctgtttcccagtcacccctttcttgccagccttttcagcatcgtcactcagaatcaatttcctcttacgggagtctgactggttagttgactgtgaggtgttaggttgagtatcggaccggatttttggcctccactagcctgaccggtttgccgacagggtgagcggcgttgagcaatcggaggatctgacttcatcaaggcaaattcctgtgcatgatattccaagttttcaatcaaccttgtagaagataaaagcatgtttttgaggaaggctgagatgtatggtacataccggtggagaagggttgaaagcgttgtatggcacaactggcagcaagtgcgagtagctgactacgatagcatttgagaagattttatacactctccttcatgattttgaattcaagatattctggatcttcacggttagggtcatgcttgccatcaaattcgaaggctgtgcgagatctctccttaattggtgctagccggctcttgataaaatgtcgggtgatctgttccccttgaagcccctgttctttgagcttcagcatatgatccatcagggcaagtgcttgagcagcctcatctcccatgggaagcgagttccaggtgtcctgataaactggagaaagacaggagtactcgggaagtgcgggctcggggttttgcacatagaaccaatttgcatgccaacccttgttcgaggttttgaaaggcatggagaagtacttttggcttaaagttccccttagttgaaaactggctcccccaacaacgcacggtttactcttgttcggctggggcttgaggaagaagatgcggcggaatagagcaaaatgtggtctgatgcccacgaaagcttcgcaagcatggatgaagtttgcaatatggactatggaattggggtttaggtgatgcaaactgataccataaaactccagaatcccttggaagaatctcgaggttgggagagaaaacccaccgtataagaaatgagagaataccatgacttcatgtgtgtcaggggtcggaaacgcttcgccgcatgccggatgctactcgatgatctccttcgccggaagaacaccgtgcgccaccatctccttcaaattttcctctgtaacatcagaaggcgcccattgactctcgaagctttctctctcctccgccatggatacgaattggatgatgcgatttggtgtgaaattggccgggaatggatgggagatcgatgcggtggttgcgcggaagattttagtggagctctggaggacggattggagtggatttgtgaaccctagctttcgccggtgtggcttcatactatagcagagagtggggaaagtggcaagagtttcggcggggaagacgaaacgacggtttgttctcggcgtttatttcgctagggtatcgagagtactaatgggcctgggcctaaatagtacttcaacccaattttgctatcggcgtggctagttgtgatccttaggaacttaggcatttgtttttgctttggcaacacttgctcacgacagtatagctcaatgctgttaaaatcctttttgacgcagttagataattctttgggattactacaatgcacataaaaaggtgcccaacagaaaagtgttatactaattttataggcctttttaggctacaaagctgttcgggttttgttgagatgactggtttttgaatagtcattctcttagcatgttatatgcttattttgatcgtggcgtgagtcatagcttaggctatttagactcatcgtttgtcatgctttataccacatttgatggatctttttcagagtttttactcggattcttatcatatgtgttgatttatagacctttggagtgtttctcactcgggcctttttatatctccttttttgtgtattaaagctaaagtagtcgactgaatgttttattaaatgtcgcatatgcttagctatatgataccttggacgattcggttgtaaaaccactcagatgaattcgatgcacctgattttctctattttcagcccttcacagtctttgaatttggtactcgggagatcgaggcagagtaagttgaagtactcggattattgttttgaattatgagagaagactattttgtcgactgtaaaggtctcaggggctactgtggagattatggtaccccatacctacacggcatatatatccgattgagtatggggtgccatgtatagatagaatatcttaaaagggactcgggttaaattccaaacttgtatgtcaaggaaatacccaggatcctagtcggttacgattacatcatatctataactacctattccgttagggatatgggttgtactttgtaatacggactccttcctctatataaggaggggtccgggtgcctcttggggcacgattttctcccaaatcatacgatcaataacatactcggcggattaatcctcggacaggagtagggtattactacttgttaagaaggcctgaacctgtataaaattcattatctctcaacccatccacttttccagcttgatagccacccccttttagtattgccgaaatcttgtttcgacaaatctgaagcaatcttcgattgatacgataattttaaaaagttgtttcacaaacttcaatagttcaatcacatattcagcatagggacttatttcgaacccggacattcttttgttcctgctattcaaactgtttccaattgaaatttctgcaaaaagatgtcgtgaaattcctgtgttccaaatggggcttaaagtggatatgcaaccttgtagttaaattaagagggtaaaagatgattatctaaattttcctgttcggtgctgtaaggagggcgcggcggcgagggaggctcgacgaggcacgcctgtcggggaggaggaggccggcgaggaacggatccatcgtcgccatcgccatattttgttccgcatgagaggatgaagcgtagggaaaaggaagaaatatgaggaagaagaaaggattgcagaggctgacatgtgggtactactgtcgtagactcctagtagggaggactacaagattcctaacttttaccaagggggtttaaaccgtcggccacttattaaaactgtcggccttacatattactgagtgggtaccgtcggcaaatccctttcagccacatgtggtcggtaattgatcatattaccgagggtacctcggtaaccatgtacccgagggtttcgtcccgagggtttatggtcggtctttttttcagagaccacgcatggttctttcttgccgaccacatttcccgagcgtataccgtcggttattcttattctcaccgagaggtttttatataccgtcatccattcattacccttcggaaatagtatttgccataggtttttatataccgtcatccattcattaccctcggaaatagtatagctgagaggttatttaggtacttggaaaagtaaataaaaccctcggtaatttgatattttctgaaaaaaaaaatgcaaatttaaattgtacccatttttaattaatcttataaaagtaacttactgcacatagtcacatcataacaaatttcagcttaattaatctataaacagatccacgggaagttcaaccatagatataaataaccaaattgttcaaaatatttatcatccatcaccatagcaaaactaagtaattcatgacatgtcttgcatgaaagactttaattgaaacaagtctgtaacatttaaaataagatagattgagaagaaaaatctctaaactacaagggtggtccatcttctattgccctattcttcaggaatctcatttccttcctcaagatcaaaatcattgccttcatcatcatcaatctgatttcctccctcttgatcaaaatcactctgcatatatgattgtatcttacacattaggtattgcactttatttagataatgttaggtactgcactagagcaaacttgtattcgctatcacaagaatactttgaaagaaacttattttggagggtttctaaattggcacacatgggggagttcctgatgaaaatttccaaatctaggaggcaagtagcatctatgtctaagtccaaacttaagctagtaatttatcattagaggttcaacattgccgaggatttggctctcataattaagcagcagtctttaaaaagtaaaattacagagcttacccaagcttcttctgccctctggttgcatagctgttcattatttccttgttgcattctgtgtgtgtgctgccaagcagcagcaagtccttgttgcccaccttttttatgttgctacattacaaataaattagtatatgcaacttttttatataggaacaagctctatggattgctacaaattaacaaagtactagggactgcttcgtggcaaccaagcctcgcgacccgccgcattggtatacagtatcacctccagcaaacctgtttctcttcctatataaagatttcttcctaaattcaggtgtactccagtgctcacaaagtaaatgccaaccctcttcagtaactgaaaaatcatttggtttagcagaaaccaaagcttgcacagtaggccaatggttaccatcctcatcaacatcctctgctggtactttgcattttttatataacttattagtagctcttttcttctcttcgaacaacatttgtggcacattcttcttgaaattttgctccaagactttatcagcttccactttgtcagtgggatcacatttaaaacaatactgccaaatcaagcaagaataatattatttttccacactgttgagactatcacaaatctgaggaaatcttacccaaaatcctttaagaactcggtcagctggtgacatcattctttcatttgtagacctcttgtagtccctccaagtaagtgcaggtgtcctgcattctgggagaccaatagcaccaggatagaacctatgcaacagtgcaccttgcactgtcgatggtctacgagatgagatatgaggatacacttcaaaagcgctacaaacagaaaagtaaattattagtatatccacaaataaagctttttgttaagcatacacttgaagaagtcaaaatgaaatttatttaaaacttactcgccagctgggactattctaggacgatcatcctcctccattagcaggttgcctgagagtgtcattcaaaattttatatactatattaatccagaagttaaaaaataagtatatatgggagttttctagattcaacagccatgggcatgattgtgcagcgaagaatgacagtgtatagattccgaacagaaaaaaaatggacaatctgcaagggaagtaaactaaatgaaaaaaaagtacatgtcttgaagaattctacagtgtgccagccagtgtgcaagtaatatggggatactgtgaagtgaagaggaagttcgctatatccctagataaaagggggaagtggattgggagatttgagaagaggagtaaattcagaatttttaggatagagcaagcactgggccacctaggcgaagggcagaggccacaggacaacagcatccactacagatctttgctaattatctgaatttaacacatagttgttcatccactacagatcgttgctagaaaaatgcactcaacaaaaatcgaaaatcagattaatgtagagaataaggccattgcaggaagaaaactttgagggagggagagatgaccataccttgacgtggagtggtgccctcgcgtgtgcccggcgaacaaattccgccggtggggagaggagaggaaccagcgatgacgtacggagaggaagggaattcacagattcaatctaatgaatcagttttgcttccaactatttcgaaggagaaaagacgcaagagtaggagtatatacttatcgcgtgggcggctaatttgcgcgcgtattattttaggagatcggaagtggtcgcgaaaaaggaaactgtcggccacactctgcgaattggaaatttttaggtcgctaacgcgttctttaatattttggtgcctctttgttcattgtacaaggctgagcttagatggtttggaaccattatttatgtgttggaggtcttgagttcaaacccaagatttgacatatattttttaaaattttggattgtatatattacatcatgcttacaaaatagtagataatattaataaaatatggccacatttttatgctgttgattttttttggcacaattttaatactattgaataatgttctcttcaatttgacgtatatgcatgccgtttcataaactacttatctggtcaaagttataaactcttttaatgcaaacatacatgagcatgcatggtttaatcatgtgaaaaataatcttataccattgcatttgtaaagaaacgagataataatttatgagattgggtcgcaactacaaaggtgccatgaagcgggtacatacactgggcagggggccgagaagaatgaaatgaaaaaggagaaaattgactatgagaataactcgcacgaagaggatatatgagaataagatggataagcatatatactatctttgatgctaagcacaagatgtcttatatatgaaaccaatcaaattgaagataacaactatgtggttaatatggtaaagactagagagtccattaatatacccctcggttactaatataccccgtcggtcactaataataatttccgagagttatattaaacccctcggttactaatataccccatcggccactagtaatcatttccgagagttagattaaacccctcggttactaatataccctgtcggccactaataataatttccgagagttaaattaaacccctcggttattaatataccccgtcggccactaataataatttccgagagttaaattaaacccctcggttactaatataccctgtcggccacttataaccatttccgagtggtatcttataactctcactcactgatatatcccgtcagccacatgctaaatagccgaatgttctcgtaactatcctcattaaaatttcaaatggtcggccacctaaatcttcctgacggtctgtaggattttttgcttggacgcttggcaaatcttaggattctagtagtgggggtgaatggagaggatgttggagtaaacaacgaatttaacttgacaaattagatagagagttggccaaatagacatttggagagtgagatttggagagactgttggagatgctcttagccattcggttggagagaatgttggaggacgtttcttttggctagaatggttaaattttggcttagagagtgaaatggagaggctattggagatgctcttagagctaactgcttactctaaaacaaacacaacagcaaaaactattgtttaaatataatttataaactactcgatctatgcattgttctttaaaaatacttttttgtcacattatattatctctcctgacttgattggcagtgagttgctcatctgcataggagcacacaaagcgctggcgataatatggaactctgctcaatggtgctttctctcacctccacgtcactgctatagttgatatgaaaggtttataaccagttattgtagcttctagttgatatgaaaggtttatagccagttattgtagtttcttatggaactctggtcgtgtttagttaagtacttttcaaattttttatgaagtatacggacacacatttaaagtattaaacatatactaataataaaacaaattatatattccgcatgtaaactacgatacgaatctattaggtctaattaatccgttattagcaaatgtttactgtagtaccacattgttaaatcatggcgtaatcaaaagattcatctcgcaattgatgtaacggaaaaattgaaagtttgaagtgaactaagcaaagcctctggtcttagtctaaagtgaaatatattcttttgtttaatgacatttcctgagaacaatgcatgtctcattataggttaagctggcgttggggcttcttatttatgtatgtacggccctaagaggaggtatcaactatattaatgtaacaataatattaaaacactaagcttaattttagcatggaaaataaaaggttgtatatattgtacgtgacaattgactgcaactatatttacatgcagtctattgtcatatacaatatatacggccttaatattttccatgctaaaattatagagaatatttacaatatgtacctttataacaatgtcagctactccctccatttcacaatgtaagtcattctatcattttctatattgatattgatgttaatgaatctagacatatatatctatctagattcattaacatcaatatgaatgtgggaaatgctagaatgacttacattgttaaacggatgaagtatatgatatgcaactatattttacatgcagtcaatcatatgtttaccatcagtgatggatctagaaaatcgatttgttggtgtcataacgtgtctatcggtgtcataatacgctaattatacttagatcatggtgttctaatatatccataagcagtttcgctatagttttagcggaaagtcatcagtattgccagacgatggccattatactgtaatccgcccatgttatcatctattattcacagaatggtgttgtaacatgtagagtttcccatgttaaaaataggaggcccataatattcactcattctagttctcttatcattctccgcgacattcaggaattcagcaaccccattattcctatacttttgggctccaacgagaaatacacgtatatccaacttcaatccatctacaattaataagatagtaattatcagaaaaatacaaaatacattataaaagtataagacaagatagcaattatcaaaggtatctttttctttatacctccaaattttcaacgaagaaacgccccatagtccttgcacctaaaatgtgaacaatgcagagggttggaatgacaaacagttatatgatagaggtatatatagggggtaagacacctctaatgggtaagtggataaatcggtctgaaatgagtattagtcatctttaatgggttgctagctaccttggtacctgtcacaggtgaaaagtcatcttgtaatgggcaccatgtacgccttacaaaggaccttttgttgggtgcacattttaggtagggagtcacctacgatgggcctcggcccaaggcctcatctgtaacaacatccagttcaacctatcacatatgtggtcatccgtgacaaggcactagctttgtcctatcatcccacaatgcatacaagaccatcacaaagttcagccatgtactatctccttcattgtgcaattccaccaatctggtctcaataagaaaaattaagtgattatccagtagttccggaaatttcttaaattaaccaatcagcaccataccaactatccatttgcaatgtgcacatcactactaccttaatgttcttcccaatttcatagctattttcttgcataattaaggtgcagcaatgtcaaccattaacgagtttagatggcaatgtagtatagaatattaagtgaacatttaagtcaatcgttgtgtagttggccttgtttgattatgatggcccccgtatacatttgaggctagtgttacataatcctaagagatgataggctttgggccatgctacatgtttaacaacttatgaaaccaaaattaacagtacagattgtaccgcacaaatccaaatggaccaatttaaggaccagcagagatcgatgaaccatccaactttggaattgatcaatgattagttaattcaatgagtcacagaaccagatttagcagaaaagtataatatgacaccactacaccaggaaggagtgatagctactaattaatcaatcacttagtcatgttgcagctgtttgcaatccaacgaaatgcctctttcagggttacctgttaactactctttggcaaaagatcgaacatttggtgtgcgtcaattaaaaaaaaaacaaaagggcaacaaattcggtgtccagttgactgcttcggtgcctagcctgattgctaggatcgagttaaacaagtgatcaatcaccggtggtgcaggtacttaccggggacgggacgtcggcaagcgatccagaaccaaaggctgctgcgacgacgcgcgcgcgcacgggagatggcgttgggatgcacgcgtggccgggccttggagcactggagcccgatgatgatacgcgcgccgagagcaatgtccgtttcaagcgaaaaagataggaataagttcaccggaggtccctcaacttaactgcgagattttttgaggtctctcaaccacaaaaccagaaatgttcgcccctaaattcattcaaaccgttcacatgaggtcccttggcagtataggtgggtggttttgctgacgtggtatcctagtaagcaaaaataaataaataaagtacgtggggaccacatgtaagtgagaaaacggtgcgggcccacatcccttcctttttcccctttcttctctcctctcgtcttcttcgacaagccgagacgggcagggtgacggccggcgagagcggcggcggcggcggcggaaggtgagcgcagccgcggcaggcgaagcaggcaggagcagggcgacggccagcgagagcagcagcggagacggagagcgagcgtggccgcggtaggcgaagcaggcaggagcggggcgacggctggcaagagcagcggcggactgcgggcaaccgcggtgggaggtgggggcgggatccggaggtggcggcggaaccgcggcgcgttagggtccccgaacacgaggtcatccttgagcccgctgtccaccgagcggggtctgtgggcagaacggaggcgggcggcgcggcggcacgcggagcggcgttggacggcggcgggcaaagcggacggcgggcgtcgggcgagcagatgagcacttcaggcggatgaggggccgcaatggcggaggtggccgaaggagagcgtggcggcctactccgccattc

SEQ ID NO: 73231 - DNA, 720 bp, Oryza sativa
gatcccccgtttttttatgatcatccaacatcatcttgatttgttcatcatttagaatctgtacaagaccttgtggagggacataagaaggcttcaagtagtatacaccatctcctttttgatatccatgtataagcaatgactcctccaaatcgataaatttcagagaatccctgtctaaaagataaatcgatgaacaaatcctttccccaccagatttcctagagcttccaccagttgtacaaccagtatgaacaatgaaggaaatactagttcgacccatctgcagagattataccaatttattggtttgcaacctaaatcaaagagcaaatattcgatgatctgaatctagtaagacaactacatgcataaaacatgatctaaccaaaaccagggagaaaaaacgaacctgtagaatgaattgacgaggtgatcgaagtacaggctgctttagtgcttccttctatgacttctcttgccgggcaggagatttgatatcccttctctgtactatgcgatcatcgtcgtacttcgccgttgtaccgctgttctttcgccgccttagtgttgcagtagagatcgcgaaattaaagcagggaaagatggaaagtggaaggaggtgcgcgcgcttttgctgccaaggtggcacaaagcaactctacccgtgggcggcgctgaaggcccacgataacgagaaattgagcgcatcacgagaaa

SEQ ID NO: 73232 - DNA, 595 bp, Oryza sativa
gtgcgttctgcgcctcgagggattgcagcagctgctcgagctccttcacgaaatcaatggcgccgccgacaatggacgcctggtcgccatacacgccgaccaattaaaagcaagcaagtgagcgacagtaaagtgcagagacgacagatcaaatcaacctagcatacctagcatcatcgcgattctagagcgaagcagttgtgtcagcgagagtaaactagaacagtaataatgttactatgattcaagcaatgataatgacatggagggggcatgcacattaatggcacaaagtggccgaggaacgtatgccccatggaggaattaatgattcattattgggatagcatgaaagagacctggaaattcctcaatattcagttgacgagaaagagcaaaaaaaaaagtgcttaaacatcacaaaagttgaacgaatctttcttaaaaaaaaagttggatgggtacataatggtacgatttttatactagagaaaaatcacagtgcttctcgccgaaacattctcttgccaactccagttcagcacaacccaaaatccaatgtccaaatgagaatcaagctagggagatgaaccct

SEQ ID NO: 73233 - DNA, 21935 bp, Oryza sativa
taagtgacttttaaatgccgtttactgcaaaacttaacccctatattattatctccttgtacccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaaggtcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcttgtctctagttctgatctattctctccttgtatgcttcccctctcaacctctaccttgtgacagatggataatcctggtaaccaaggctatgggaatgatggatccgatgactcaagaacccaagccaatgggaatgagagaagcatcaacgcaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagtctcccacctttgccattgccgtcgatcctaaggaagccagtgagtggttgcgcaccatcgagaagaagctagggttgattcagtgcaccgaccaggagcgggttggcttcgcaactcatcagctggttggaccggcttcagagtggtgggatagctacgaagcatcaaggccagaaggacataccatcacctggaacgagttttcatctgtattcaggagatcacatgttcccgcaggaatgatcacactaagaaaacgagagtttcgctacctgaagcaaggggatttgaccgtcacagagtacctgcacgagttctatcgtttggctcgctatgcaccagaagatgtggaaacggatgaagaaaaacaagagaagtttctccaggggttaaaagatgagcttgcagtgcaactactcctagaggattatgaaaattttgagaaacttgtggacaaagccatgcaacttgaaagtgagcataatcggatgacgaactgcaagagaaggattgtcaacatcccagtatttccaggtggtaaccaaagacagcgcactgagccacttcagatcaccggatcttctgttgtgcatcaagagttcctgccccaagaagatgaacgcaatgtagacaacaacaacatcattcaccaagatatcgacgatagtatcaatgaaggcacccagaatggcaaccctagcaattttgactctgagaaagactccaagggtgatagcaataatggtaccactgatgccaatgttagcaaggatttccaaccaccaattccaactcctagtcaggacgatcgttcccaggcggacaactcagcaaagaagacgttgatttgttacaactgcaaagaaccgggtcatttctccagagattgtccacagccgaagcgtaacctgcgtcaccactccggccattatgcaagaagaagacaagtcactcgtcttgtggtcactggagcaaacgccatacctgtgaggcctcgtgttaatcataacccatagtagaaacaatgtaccaatgttaagcaccttccctttttgtttaagacagtgccttgtattcatgtaatatgggagaaattgtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaaatcaagtgattaaccaaagagacatttgtttggactaagagttacagatgagtccttttcggatcaaaggcaacgacagttagtatagcttttggcgaaacacttcaaggtctcactgaaaggcagcaagtcaaaggaccccatcgtcaccagaagtatccacaactctcggagtgaagagtacttggttgacaaagtttaagaggtgattgatagaagataccagcaaaggtgtttattatcgaaccaagaagtaggtcgaaaggtgattgataagagaaatctaaaaagaatacgccagggctgaatgtgtaagggaatactttgaatgctaaatgatgacaagcatggtatcttagtaatgacgagctgatctcgacgcatgacatgaagtgggtaacttgtatgaggttgaccccaaagatatgaactatgcaaagttctggaactgaagccccatcttcaagtgccgcaacccagtcgaagtcagctaaaggttcaaccagggacaagtcaggtgaagagaagattccatccgcaataggagatcgagccaagcagtcccgagtggagaagttttgctaggcaagtttgttataaaaggcgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaacactaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcctcttttccccccccttccttcttgggccggctcggcccagtccctccctctctctctctcttcccccgcggcccatcggcctcccccgcgcgcgcgccgctgacaggcgggcccgcccgccgccctcgctgacgggtggggcccacctgtcatcgccttcctcccgccgcgcccgccgccgcgcccgtgccctagcgccgccgccgccgcgaatcccgccgctcccgtccgccccgcgtgcaatcaagaggggggaattattccccgcaatcccctctcccgtttccccctcttttccctctctctctccctcggattcgttcgaatcaagcccgtaatcgtcgccggcgcaatcaatggcggccgagatcttcgcgcgcggtttcctctctccccggccgccctctctccctcccggcgctataaaaacgttgcccgagctccgctctttcgtttccgccgctcgccgctcgctctcgccgtcggaatcgtgctcgcgccgtgctcctctctctccgccgtcgccgccgtgctccggttcgccgccgccgtcgctccggacttcctccccactcggcgacacctccctcggcatcgccgcatcgccgttgaccccgtccgcgcctccacttcgcccgccgaccgccggagcaccgtcgtcatcgtcttcccgaaccgcgccgccgccttcttccgcttcggccgccattctcgtcgtcgtcgttgccccggggtgagccgaagaccgccgttcgccttccccctttcctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggcccccacccccgtggacccggtccgcgcgcccgctccctcggctgacgcaataaataggatttttaattgaaaattaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcctttccgttggtcgtgtagacgctgcagcttcggaagatccgctcttcgtggaagttgaagccggtgtttgggaaagcgagcaaggcaagtcacatcatccttgatcatattgaatcccagtttgtaaaattatgttgatttaaattattgcattaccgctttatttaaattcccgcgttatcactgttttatttagccatgcctatgtacctttgttatgaccatactattattgttattgttattattaccttgttcaccctagaataaacaaaaccccatctagtggacactctatttatggttccactagtatgaatttaggtagatgcttcgctgattaaataggacaacattaggtggttttataactttagactttgggaattctcatatcatttggacaccatggaattattggttgatggtggaattggacatacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggctcggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttaaaattcttaaaatttgctcaacaactaaaatgtggaatggttggcctgggttggcttgggacgagctgggacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacccctatattattatctccttgtaccccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgttaggcctgatgcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacatgcgcccctctcttcagctgttccggtggttcttcaccgtgcagtcggtgtcaccgccgtcggtggttggcggctgctacttccagccgcgggggccggtgttgaaccgctacatcccctacgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggtgcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagagggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagtttttttttttttttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgcagaccgccttcgggaagctgaagaggccgcccgggaggccgcccggattcgccaagcggaggaagccgctcgggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcagagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagaggctgaggcggcgtcccggcggcgcgaggagtcccttgaggcccgtgctatggcgctggaagaacacgccggcgccatggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggaacagcgggctgctgacctcgaggcgcaggaaaaggagctggacgcgagggcgcatatcggtggggcggccgcgggcgaaagcgacttagccgcccgcctcgcagctgccgaacacaccgtcgccgacatgcagcgcgcactagattcctccatcggggaggccgaggccctccgcttggcgggcgagatggggccctccgcatggatcgcgccggtcggcaagcgggcctctggaagggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatggtggtgacgaggccgtcgactcgggcgcgtcggaatgagcccccgagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaaactgcttctattgaaatgttgaaaaaagagaaataagaatgtaatgcatgtgtggtagcccccggtcaaccctgcacacccgaggggggtgcggggttggcctgagccaaaacctgacacccgacccccccctcctcaggggtagaagcggcgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcacgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctgagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgtgggtcagagctccggtactccttacagacctggttaacgactagctgggagtcgcctaataccaagaggcggcggatccccagtccagctgccactctgagtccggcaaggagtccgtcgtactctgccatattgttagtcgctcgaaagtcgagacggaccaagtatctgaggacgtcccctgtcggggaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgcccgagggggtaagacgtaaccacagtgacccgatgcgcctggaaataacggcgcagtttcctcgaggccatcagaatagcgtaaagcatcttctgggcctgagggtatcgggtcttggcgtcccggagggcctcactaacaaagtagacaggccgctgcacccttcggtggggccgatcctctctgctaggggccgtatccccggggcgttcttcgttcaagtggcctttcggggcacacttgtcttctgtgccgatgacctcggggtcggaggatgaaaggggcggcctcccctcagtggcctcggggccgtcctgggggtcgggggctcctggcatcgtcggacaagcgggcaaagggccaactccggtcgtcaggggcctctggcctccgttcggctcgggggcctcttctccctgctttctcccgggtcgagtcagcacagggttagcctcggggccaaagggcgataggtgcggccttcccgcagtggcctcggggccttcctgagggtcgggggcacccagcaccgtctgacaagcgggcagaaggccgactccggtcgtcaggagccgtaggccaccgtccgacacgggggcctttcctccctgctcgctcccgggccaagttagcacagaatgggggtgcacgaaatgaggattgtcttcatcgcgctccacaaccaatgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagctttatgcgggcagagcggaggttctcaaaagtttccgctagatctgaaagtaaagtttcttggttgcgcgtttttactaccaagtcatcaacataagcctcaacattacgtcctatttggctacccaaagaaattcgagtagtacgttgaaaagtaggacctgcattctttaacccgaagggcattgatgtataacaataggttcctacgggggtgatgaacgcagttttttcctcatcctccctagccatgcgaatctgatgataaccagagtatgcatctagaaaacacaaaaggtcgcaccccgcagtggagtcaacgatctgatctatgcgaggcagggggtaagggtccttgggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcaagacggtgctcaatcacctccctggggaccccgggcatgtccgctggtctccatgcgaagacgtcagcgtttgcccgcaggaaggagacgagcgcgtcttcctatttgccattcagaagaccaccgatccgtgtggtcttggatgggccgtcgcccaaggcaacctccttgaccggaacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttcaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaatggccatgtgtgccccggcgtcacaccgataatcagttgggacggctggagcaccatccccggggccttgatagcatcaaaggccgcgggggaaaggatgttgagagccgctcccccatctatgaggacacaccccaacttcacgttgcagatggtgggggaaaccaccatcgcaatctgccctccccgggcaacgcacagtgggtggtcggtctggtcaaaggtgagagcaacctccgaccaccgcacccgacgcgtcgtctcatgagtaggggccgcggcgagaagctctcgcttcatagccttgaagctccggcgagaaacgtgagcacacgctcctccgtcgacagtggcaatggtggcccctggttcttggaaacctaggtcatcatcaccatcatcgatgtcaacggcgggggccttctgtctggcctcacttcgccgtttaccggagggaactgccgcagacttgccctcacggcgttcctgcctcctgtcctcctcccacttcctcgttcgctcagccaagtttttgactgcgcgacagtccgcgagatcgtggagggaggtgttgtggacggagcaccacctgctggctgggcgctccctgctggaagtaccagcctctctctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaagcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacccgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggcccctcaccgggagactgcgcaagcccccctttgccggttcgaccaggggcttagggtgcaatcccaagctctctctctctctctgtatgtggaaggatcacccgcccgcaagacacacgagacacggcgacgtatacaggttcgggccgctgtgaagcgtaataccctactcctgtgtttttgtggatttgtgtatggacaagttacaaaggattaactccctttcccctccgccttcccaaagggaaaaaaagtcctcctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccgtcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatttgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatgtagtagctcactattaacaatttaagatgcttcgtattgcggaagcaagatcctatttcttagtgcctcctcacttgttcctggttcatgattaggacgtgtaattaaactctttgtatatgcgtttagtattggattattggtctatttctaactaaccaaattattttgctagctgttgtatcgtttgagaagaaatgccgcagtaggttcaagaacagggaaaaaatcgtctgctttttttttagaaaaaaaaatcgtccgcggcagttctttttcatggccatcgtacgacatttggtaatttggtcaactactcttgtaacaccctcagactatttctgtcgtcctagatgaattttttaagtttaagacttctttagctcaggcatgcatcatgctcggaattgtttttttttctctttagttcatctcaagttcacctctagatccatatacaaattttgggttgaattatgtacttgtagcaactggttatcaaggggcggttacaacaaagcgtttgtcgcttaaattaatcatgctgcagttacgcatcacatcatctcttggaaccagtcctaatcccttagatgataacgatgcactaaccaatcaacaattggctagaatgatgaaactaaccggtcctaactagctagttgcaaaagcagcagagggaaattctgcttaattaccgcgaaagaaaagtgtattgattttgacattaatctgtttattttttatcattttctctatagtaattattcggagtctccacaataatgctgcattatgcacgcattattggtcttctgatgtaagcgtgatgcgcttcgatcacaccctggatcacggcttcaagtaatacagtacagtacatacataggcacgaatcatgaacaaaccatatttcgaggacatcaattagcatatcaatgacctagcttaactcataattcatgcatgttttattctgacatgcatgctagctacacctgtgctcacagacaaattaagctagccaaggtgaagacaggaattaatgtgaaaaaaaaatcagtgctactattccttcgtcgttttcctgcagaatatatgcaatgcaggcgccgagtacatgatcagatcatctcccatattgctatctgatctggttggacagcatctcggttcagaggaaagacacctcaaaaggttaccattatatatcaggcccaaagcaagcagctgccatctacgccgcgcacatatggctagttcggctcatcaatcatgcaagtgcattattcagttcctattcttttaggctcagcctcttcatgcccttcataaatcatctggaaagatgcattgctccttctttgttacgtgtttcgcttctctggggccccagaaggactagcttaaccccggaaaagaggagctgtgtacgcttaaaaggcagtggaatgaaacatgcatgggcgcatcggatcatgctatcattgcactcggttcggagcatcatcactgctgcaagctaggccacgaccgttcattcgttcatgtgtgcttgattgatcaaaagtttcctcctaactagctagcactgcgttgcactacggcatttgctggatgatagtatataatttctctctttttcggcagtggtgctgtggtggcctagctcgtgcgagaaaggctggttgttcgttcggtttggtaaagagaggctaaagtcttcttcgatccattgcacttcagtaaacacagagatgacaaaagcaaagcatacgcataataattctccgtcctaagcatgacattttcaacgaggaggagggtgcggacaaagaacatgtcgccctgctgatttcatggcggctgccggataatgctgcaacgtccggatgcgacaagcgaatacggcactattttactggagttctcctagccgaatgcttgggtttcatgagcctttacggtagtgtgtgctgcttgctgcacaccacatcgatttcttccataggccaggatcagaaacagccgtcaggatccaggaaagggagagaagcacccagaacgcctgaagacaccacctgttcgccctcgggatggctgaaccctgaaaccgactgcagcgcagagagcagcaaatacagtagtaaacgaaatccgaaagcgaggcgacgacgccaccatgattgccgttcgatgattgccaaggaatggctctcccgacgtcgcgtgatgtgctacaagcgatcgaagccttgcgtgacgcgtacatttgtcaaccatatccgtggacagccgcgccctgattcccgtgcgcatagcttccggggacatttccatccggcttcctctgccaaattttttggggttatcttgggcacggcgagggagtagatggcaagttctggcgcgcgcgcgccgcagcctgacacgccgccgcaggaatgggttgcttcgtgtctcagaaactcgggtgggtactttccttgaaagagagggcttgacaaatgtgcatgcttccagaatcccggactcccctagttcagtgtgtttggttgtgtttagatcaaagtttggattcaaacttcagtccttttccatcacatcaacctgttatacacacacaacttttcaatcacatcatctccaattttaattaaaatctaaactttggatccaactaaacacagccaaatgtctcgcagcagcgcaatagtagactgtaggttagcctgccggcgtcctttattcggttacatgtgctggctggactaaccactgaaaccagttgctgctgacctccacaaccatagaacacaacaaatgcaaaattcggtcaagcctcttgtgtgatgcaaagtccaaaccttttactagtactagtactttcgcaccgtgacacggacactgcatgaccccaagcaaacgatcagctaaaagtcaaccgttcaaaccaatccagttagcttcagataacgccatctcaatcccaaatcctcgatcgatccgtgttacgcgagacctggagattaatcacggaagattagggcgtgggggggtttgacccaggagggcgcctggacccaagaatttaacgaagcgaaaaaggccaaagcgatcggtcctgcgtgttcctgggcgaggtgacggacggcgagtgagaagccctgcgctgcgagtgggggaggcctcggggggagaggtgaggtcgggtcggtcgcacgtgtcgcgccgcgcacatggtcacccacccaccatccgtctcctgccacgtttattggctgaaccttctggctgcgcgcgcgtcgcgtccgcacgccgggggagcgcacgcatatcgcctcgcctcgggacgcccgcctcacgacgtggcccatcacgtggcctgatcccaacagcgaccttgtcctaaactctccatgggaaagagtttcatcgtgtgaagaaatttgtatggtcgtctgtccttagaccgcttgtcagtcaagcctgcctgcctgccggcgggtacatacagtatactccacatacttgctcatcacggtgtacttttgctcatcatatggctgaatttagttccaaactttttcttcaaatttataattttttttcatcacatcaaaattttcctacacacgtaaacttttaacttttttatcatattattttaatttcaactaaacttttaattttaacgtgaattaaacacgaccataagcgtagactcgggttaatgcaaaaactaaacagcggtactaacagcagcactgatttcaacaattcgccctacttcccgggcctcccggctacctggcgaggaattaagttgggagactaatcaactcgcgcgcgtacgtgtgatcgacatgacgcgacgcgacagagattgtggtagttggaggggaccagattggccgcaggatggggcggtggactgacgcggacggagcgcagaattccggtgaactgcgccaaccaacggcgaggcctcggtggtggtggcacgcgcgagcttgtggttaacctcggccggcctcgggacacctgcccctctgattggggagaaagccttcgtgcactggccatcgtcgctgttcgttccgctgtgattgagtttggctaggacaaggagccggccgcacggtgtcattccggtcacattccagtcaggttactgtggctgatgatcgtgtgaatgtactttgcgatcgcgatgtttcatcgtggagcattgaatggagaagatggcatctctgtcggagaaaaacgataaaatggctggagcgtgcaacacgagcatgccctagtcacaagcacattagcttctgatgggccaacaatatggcccatcacatatggttggcccgttgggctagcacgcacacgggttacttactggagcaggcccgggctggaaagagaattcagacttagcgtggacctatatttaaggggcttaaagtggacttaatcctagtaataataaatcaggtacgcattttttttttgaacggaaaaatcaggtacgcatttgaatcaatgtactgtgtacgtaggagagagggggcccatgagctaatttagacatacgggatttcaagtcgaaagcaagatctcctaaaaaaaaagttgaaagcaagagattatagattccaaattttttttagagcgaattctttaacttaagtgacggtggtcaggccagcagggaggaatcggtggtcgtctggtcgtagaggaagataacggggatcatgcatgcattgtgcagcttatgttaaacgcatagcag

SEQ ID NO: 73234 - DNA, 18540 bp, Oryza sativa
  unsure (1)..(18540): unsure at all n locations
aatttatactaatgtatggcctacattcctctaagaaaccatctatacagagcctcagagcacaaaaaaacctatgaaaatatactttcccacaaacctccacggtatctatctctatcacactccctggtgaagttctcggtacctaagccctccacctataaagcatatgcaaactttcttcccaggtccaatagagctcaaccatagccttttgtctacccctaaatattgtgtcatagttaattgtgcacttctgatcttcttgtagttggctccgcaaggctttagggcccatacctatattcttcctaaggtttggaattgcctttgcagctacccaactgatgtgtggtaattattctcctactgctagaacggcatgtatggaagtctattaacactttcacattcaaaataaatgcaacaatccatcaatttccaaccattatgaaaatatcaaaatgaaattactgaaattcaataccatcactatcttctaattaattaggttgcttatgtccaaccatatgccaagggtaaccatcaaatttacaaccacctatattttcagggtcagttttcaccaacttcaactcaaactccttgattatagcacattgtctcatggctagactaaactccttcatgttaggatacatagtgccaaccttcatgcaaggattattagggtcataagccatgaccatctcccctggtacttcatcatgtacaggtattgatgccccattaatatcttcaacattagtagtaggagctgcagctgctactgcagtaacaccagcacccgtagttccagcaccatcagcagctccaacttcagcagcagcatgtctagccatctcagcctcatcctcagcactcaaaccctatagctggtagaattgctcatcccaatcattttgacaatatctagcctcccttcatcatcattttgagcaagaatctctagcctattccaatcgacaacatcggtactagctgggtcaaaagcaccgtagactggaacttgttcgactactcattcaggcacaatgaggaaaacgaaatcgacggcatgatcagattcgggttcgaccacagctaaaataaccttaggctcttctagcctgaagaaaaataatttggaacacttgttagagtattctctaacaagcaaaaaaaaaagacaaatcaagcttcacaaactaaggagaaaaacatattcttaccccatgactagctcatacctggtacacccaatcaattccaccttattcctagcaccagcattccgtcgggaagtaattaagatgggaacaacggcttcgagaggctgcccttggcgtcggcggcgaggaggggaagggggagggtggcagcagtgagtaggcagaggcggcggcgggaatggcgatggtgacagctaaatctggggcgccgccacgagctataacggagtacgataggggaggagcgactgcatctcgatcccttttcattcactgacctaaagaatgagccaagggcaatttggtcagaacacaactcatttactggcttaatcgagtgaaattggaaaaacgacgaagtagcatgttgcgcgaaggtggcgatggcattttaacaaaacaagttcgcggtgtggcattacaatgaaacccagccttgaatgtggcacaatgtcaattttcttgggcaggcccacactgcagaggcgaggcaacactaacgacgcggcctctacaagcaaactcgagttccaccactggctcacctccgctcttgatgtcaagctgcagccatggatctagagcacgtgaccggggagtcctcacctccggagagactggatgctcattctcaactcgtcaccggctgggtcaccagccccaactagcttctctgagaccaactcctccagatccactgcgtgtgatgccacaatgatggggtagccggcgttgccactcttgcctgtgtcgctcggataggctaggtccttcgctgccgccatggaccaaagaatgggagaaaacaaagaaagtggcatggtggatgacatgtgggcctagttagttttttttcgattggattgccacatgtgctggctcggatcaaaaccgctcaaaacagtgcttaggtggttatttgtcaggattgaaatgttcgggctgtagaatatccagttttgttgtttagaaaagtaattcgtaatgttgcgttcagtggcggaggactcagtaggataaggttttgcttgagccatacctcgctttgaccacaagtaaccccatccactcctcgccctgctccagcactgcagcacgaccaccacggcggcatcgccgatgccgagatatgtaagcgcgaaaggaggaaacaatgctctagcagtaagagcttctgtatttcattccatatgctgtaattttgggatttttggtcaaaaaccgtatccaatcgattccctactagcgctcccaatagatcgagttcccttattcggattattcgttccccacttctagccactcggtttcattcccaaacccttccctcgccgctctctcgcgcacgtccggcgaaatgttcccgcgcagcttttctcgcccacctcgaccgccgccaccgtcctctttctcacagccgtcggtgttggctttgctccagggggcgacacatggtgtggcaatgccgaccatgccgattggtggagcaggaccatcgctgccaccgcaagccccaccgccatctcgattcggggtgcttccacgatatagcaagaattggtccaacgccccgcaccgccgcctggccgtcgcgttgtaacaccccgaaaattttgactctaaaatacaaaaacgaaattcagaataataaaaataatcttttccaaaattcatttatgctggaatttgttgttttcctcctgtgcttggaacaaaggatgggtgtctgagaatatgcttgtattttagatttcaaaatattatttgttgaaagaaccatgattatgaaatatgttaattaagaaaatatttgcaaatactaacagccttctcacaaatccttttctatggattaaaacccatgggttgtccttgttttgccaaatagtttctatttggagaaaacccttcttgaaggttaactccctaaggaattattttaccaataaaatgtaatattgattatttcctaagaatcctttcctttaaaaggattacgtcatttggcagttatttttcaaataacaattattaataaagtatttcctggaaatcctatttgcgaagtaaatcccaaaaaggttatattaaaagaaaagactttctcagataaagtctagattaccgccttaaaggcctaaacgagcctgcataatagaatttcttatttgagagcatttgtgtgtttgtgccaagatatcgattgaatcaatattactaagccccaaaggatgccttttgatcgacatccttccttgtcctctctcctctcgtctgttttatttagcacttcggtgcaaaactaatccaagttctgaaactctttccttctatcgcgttgtgatatctctctcgagctcatggaattctatgattaaatcgaaacccactccgttaatttgaatcggcctttcccttgaaaacctaaaatcgttcgacggatttatttctcgtgcatcgacccgaatatcctcggttctatctctaaacttgaaacccaaccacgtcgaatggatttgtatgccatacaccgctcttaaacccctctttgttattgtcatcaattcgttctagtgatcgcaaaggaaattctaaatccaatcctcgaacaaccaaattagccaaataatattcgaaagcctaatcaaatgtcccatcatagagtccttttacaagtttcgaatacaattccaaattccaaaccccctagcaaattataaagttacctagcaattatccaagtcccctattacagttgggccacccttctctcttccagccctacccattccacaacacaagtccattatccctctctctgcatgccgagctctctctccctctcagcccgcttccaggccagcacatcgagccgccgtattcatccaaaatgcctaattggtgaacagttgcacgcctccctcttcacgcagcaaggccacgtggtgcgcgcggagagggggcggcggaacggcgcgggagggaggggtccaggtatgatttttttttcgttttttcttccatatgttcttcagttttcgtgtttttttatgtttttttctttccgtatctttttttagtttttttcgtttttaataagtacgtatacaaactatgtatacgtataaatacaaactttgtatatgtgtatataaactttataacatgtatttttttggttggtatacgtatgcacgtatacaaagtttgtaaacacgtattttttgggcttttatacgtatgcacacaaactttatatacatgtgtatattttctatgcaccccgagacatgggcaatacagtgagggaaatccacaccccgagttcacaaaaccatgcttaccttgcccttcccctcctgtggcgatgtcgacatccaggttctgcgccgtcgccgttcaacctgtgggcgcgtgccacatagcctcagccctgtgctttttcccccatgcccatgccgctctgtgccgctacacttggttcaccaccccgggcaccccgcttcctcgcgctctagccggcgcccttgttcgtccacgtcgaaagcgtgagccgagctcacagagctgcgtagccgtcctctactttcctgtgccgcagccttctccttgaaggaaggaagaaccaactcagcaatctccctcctcgccgtggatataaagccagccagcacccctccctcttnctcctttcccgcgtacattcgccgacgaccaccgccgatcccgtcatcgtcatcaccacacccgagtccagctcgagctcgtngncgaactacaaccgccccgcacagncaagtctgctgcgcgggaagccgctcagcgtacggccaagtcagccgcgcgagcatcgtccgcagcggtttccacctagcttctggccagtgcccagccgagcatggtcgagccactggcactagtacactagtacagaaccttccatttgtgacggcctctaacatgcttgaaattagtggccgtcacaaggaagtcatctcaatcgggccgaaaaagcgcccgattgagataacttaggcccgtcacggatgacacatatcagtgacgggtgccaacttggggcccgattgagatatgaaatgttatctcaattgggcctaaactacggcccgtcacttatatgtatcatccgtgacgggcctgagttttatgcccatctaacatgccttcgagaccatatctcaataactaggcctgtcatagatgactcatccgtgacagactctatactaatgcccgattgagatgacttagtatttttccattttcatatgaaatgtttatatttgtgagttgacatgtagcaaaataattaactgcagtataataattcattttattagtcaaaaataaaatgatttcaaatgaaaaattgtcaacaacaaagttgtataacttatcaaaatttacaagttttattttggtcatttttctatataacttttttgaacaatttaaatttgaattagaaaatatgacaacttcaaacaatattttcaaatattaaatgatttcaaatggaaacaaagttttataactcatcaagatctataacttttattttggtcatttttctatataactattttttgaatagtttgaatttgaatttaaaaatatgacaacttcaaaacaacattttcaaatactaaatgatttcaactaaaaaagtcatcaacaataaagttgtataactcatcaagatctataacttttattttgatcacttttctatgtaacttttttttgaacagtttgaatttgaatttaaaaatatgacaacttcaaacaacattttcaaataataaatgattttcatctaagaaagtcatcaacgacaaagttgtataactcatcaagatctataacttttatttttgttatttcttcatccgataaagtgttagtaacattgctaacaaaattgacatatctgtgttatagtttataaaacaaaatgagagatatgtgaattttgtaaacaatgttactatcactttgttggataaagaaatgaccaaaataaaagttatacaattttgttgtgatgaccttttcaattgaaatcatttaatatttgaaattgttgtctgaagttatcatattttcaaattcaaattcagactgttcaataaattttatatagagaaattaccaaaataaaagttgtaagtcttgataagttatacaactttgttgttgatgacttttctatttgaaatcatttagtatatgaaagttataaaagttatatcttttataactttcatattttcaaattcaaatacaaatagtttaaaaaatgttatatagaaaaatgaccaaaataaaagttatacgtcttgatgagttatacaactttgttattgacaattttcacatttgaaaccatttactacccgaaaatttatttgaatttcttatattttaaaattcaaattttatatagttcaatcaaacccgaatggagaaatgacctaaataaaattggtagatctcaatgagttctacaactttgtttttgacagttttttatatgagttcatttcgtatcataaaattcaattcaaaatttatttttgcctaaatgtctgatttgactcctcatcatgttaatacttgctaaatatatatttgatccaattaacttggttttgctggtgaaatatgtgaaatatgtgataaaatggatgttatgtgaatgtggttgtgttaaatatattgatagttgtgtatgtgaatgaatgtacaacttcttcttcagaagccgaatcccaaagtgctctgaggttaagcgtgcttagggtggagcaatctcaggatgggtaacccgactgggaaatccttccctagaagagcaatttcgggatgggtgaccaaccgaccagcccacgggcatggctagcaaaggcctaaggctagcaaaaaaataaaatttatttatttttagattatactcatctgtgacgggctataatttaggcccgattgagataagagtcatccgtgatgggctatagttcaggcccgattgagatgagagtcatccgtgacgggttatagtttaggcccgttagagatgagagtcatccgtgacgggctataatgttagcctgattgagatgtgtgtcatgcgtgacggccggatgcccgattgagatattttatcacatcagtgatctttgcttagtgaaggggcgttacctgatagagatgaggctttaggcccgttacacatgaccgaacctgctctagtgtggatgccagcgccgtcaagccggccaccccgtccaaccagtgccccgacctcgtcctgcccggtgccgttcccttcctttcctcctctgcccggctacgccctgactcctcccctctgtgccgcctccctctccctacgcgcaaccgagccgccacgcccgggcgccggccgcgccgtcgcgcgcctgccgcctctcgctcggacgcacacgcacgtgagacgatgggaacgagagagagacataaggcagacaaattgagaagaaaaccatgagagaagaaaaagaaaaaggaagtgggacccacccttttgactcctcaccgtgagccctttttccctctaaaagtctacatcaagtccccctttctcccttgggccacccgattaacaagtctacaaggcattcttcttggccaagcccaggaaatcaattcctacaaaagtctgtattatttccctcctccaaacctcggaccgtagcccatcagcaatcatcacctccaccaaagtccatccctcctccatttcataggataatcttgggaatatttcctccaaattctgggaaatccttttcctccatttataaaaccatttgaacttcggaaatttgtatcttgcaaaccgtaactccgattgggtccattcaacttccaggatttctctaaaatcgacatctatcaaatggcactactgaattgaggtgttttgtactttatttgtaggattttggatgtttatctcttattgaccgcataggtgatatttttgatatttaacgaacgtggatttctcaaagatattggattctaaaagcaaggcaaatcactacacatccctccttgagcatgttgaacctatctttataaatgtggtgattaaaaataaaattgcatgctatttataaactgcgtacctaaacttgaatgtaacccacccttgatattgttacatttatatatttgtatatccttgttgcatgagtctattatttatacgcggtcaattattgacattgctagcattgcattgtacagacaattatagataccatgtttattatatggatatggatgtgagatcactcgatgcgagtgattaatggtttatggctagagacatgagcgccacccgcgacacaaaaaccttttgcgaaaactaaaacttaataaaacaaaacaattttgactggagtggcatggatagaatatgggtggatctatgaaacggctagtcgccgaccctggtcaattaagcaccgagtcaaaaagctatacagtaaacaaaccgagtacgaccgcacttttcaaatgggtaaacccgacggactaagaaattctcgtggggcggcaccctagtcatggtggttctataggacgttggttttgttgcagtgttgtgatttggataatgtcaacgaaaccaaaaatgcgcctaactatatttaaaatgtaactgcctgttatcccgggagtgccaggactcccttcacttctggctcgaggtagggatggtttgccggggtgaaatgggcgctcattgtctttggagcgggtgccgtaacacgagggtgactgaaaaaccagaccatgacaagtctcatgtgtggggactaggctcatgggttgggtatattatggagtgcgggattaaaataatacatccactgcggtgtgattaaaccaatctattcgaatagccttgctcgcggttaatgagcgccgagacttgtattactctagactagccccataagtttttaatactgcttatattaaaaatggaaaggaatgtgtgaccttgcccgatgtgtgggaaggtcgatatggtaaagattttataaaacaggaggcttggggaaggtggatgaaccctcgataattaatgacaacttcaacttaacgacttaacgtcgataatctaagtcatagatttgtgaaatgaattgtgaaaactagctttatgcaaataaaccaagccatccttgaacccctgtgtgcactaaatgcatcctgtagtggtggcttgcttagtatgattggtactcgccattgcttaattaaattttttagaaggagttgttggagccaacatgtatgtatgctatgcaaacaaagattttcaaaaaaaaaacaaagcactgctacaaacctgcgtctaaattgaacatggagatatgtaggttcttcagaaaatagtcattatacaatctccaatgactagccaatctatcctgatcaattactgcatgacctaaaacagacccaccacgcactgtgcactgcgtgacctaaaacagacccatcgtcgaactcactgtgcactatatcaaccgccgaagaaataaattcttcgtcgccattagatgaagactcttcgtcgcatttggaggagggtgctttgatgactcatctctttttttttaccaccaagttggattgcaagggagagacggccaacagagggaatggagaggtggctagcagcagtggggggatatgagagggtgttagtatttcttaacgacattactagaaatataattcccagcaatagcgcagaaatactcctggtatattatggttacagagttcatccgtaagcgcacggatatatcattgtagcatttcacccgagagtattccaagggtaccatatttatttaatcctgcgggaagatcatagtagagaaaacatgactaataatttatatgttatttgtagtaatcatattctaagtagaggttaagaaaatccaagggtagagtgacacacaagcatggaactactcattctcatattaaaatatctaagctaaatgaaaaaaaaatagaaagagaatctattcctatacttctagtatacatagtatacatacatcctagttatctgatatactagctaataccctctatccgatacccttctagtacttcgagaagccacccctaactgccgagtaccttacgacagcccgtcatgaccatacaaccggggctaaatacggatgagtacccgccccaggaaattaacttagaactatatacacgcgtggaggaatacccgtactgacctgtcaccatcagtgacccacctctcatccgtaacatataactccaaataatgatgtcccatagtctagacaccacgcctaaactaccagatactactctaatatcatcgtcatgacatagagtaattgcacaagcaaacactatacccgtaccaaagcatctcttagataagctagcagtataatcagtataacatgaatataatgtaaagttagcattcatatactcggaaagtattccaataccataaatgtttaaagaagagtattctaataaaagtacaaagcttacaaaagagaagagaagagctactagagccatacccgaactcttcccaaggcttccggactccgatttctactctattcctattccactagctttagaacactaaactaacttgagaggatatgaaagaactcttgcttgaggttgtgaagagagtgaggaagtgaagtccttttatagcctcccaatgacggttatggcaattggaatggtcggaaattccctctaaccgtcattggggagaaatcctggacgtccacgccaaaccctacatccaatggagcagatgggctggtccaatccagcccattttcggctggcggcctcctagacatcttctctctgtagacttgtgaattttggctcaattggtcgtgtcatttctgagttcttggcccattcatacataagtctgatcctcgacatcgtccgattgatttatcatctggtttgatgtcgattcctctcccttttatatatggttattttctgcaaaaggttagtaatccaaatattagtggaatattattattctaacatggatatgcattgcaagcataactagttctcatctattttggtaatattgacggtcaaaactgatcgctaatgaccgtcaacagaggggaaggaggaaggaagagctgggcggtgagggtgttgggagatcggcaggagtaatcggcgtcaggaacagaagaaagcgacgctcgcaggaataggaagagattggcgcgccccaccaggaagtcgtgcgtcgcgcgcaagttggagatcgcgcgtgatcgcggacgaggaaaacggatttttgttgttactttaaaggagtgcccattgttagttataggaaatcaaatttaggctctctcttggagatattagttttttcaattcccatattgatgtttaggaaaaccaaaaacttaattttggaaatggatttctgtcattcccttggtgatgctctcaatcccgtcccgcaccgaagcccaatgggattttgccgtgtgaccaatgttaatgactacttggtctctacgtccctatttccctacctcccatattcccaatttccttcgttcttagggctacggccgacgactaagggatgtgcgggcgtgtggggaccgtcgaccagaacaacaacatgcagagcgtgcggctggcacggcagtggcggggcagggcggtgcgacgccaggcttcctgctctgctgcacaggcagatccgcacagtccgcacacaatagctgtatcctgtgttaatttgcagccaaacagtgttacgagcccaagcatttgtttttacatatcttgctcttcgtttcacagattgttgaacgatttcacagattgtctatgctctacaagtttgcgtatttaatgcattgcccaatcttctttgttttatgcttttccgctaaataatttacatattccgttgatgtcctgttgctcctttaatctaattcgagttccataatatcatgacattgacagaacaacaatatttttttctcctttgtgttcattctagcattttcatggccatacttcttatttctctcaccctccgccactgatcgcgacagttggatgggtaattcaaaatttttcctaatacaattgactaaaatttccgatggctgacaaattgttattacagtcgagggatctttttgtgcttttttggttttgtattacaacaaggttgaggagcaaatcaaagcgatgggtcctggcagctccacggttttcacgttgattgggtttctttgtctgtcaaccctagtattatttttatatcttttattggaggtataccacgaggtccttcgatcggacctgccgaaaccgaagcgctagcgaggattcaagccgaagaggtgcggcgaagaccaaggggacgcggttgcgctccacacccaagaaggccgcatgggcgaaagctacgtcgcgaagcacacgggcttcaccggaggtggaccctatcaaaagagggccacatgggcgaaggctgtatggcgaggtatacgagcttcgtgccagccgggccttgccagaggaaggcatggcgggccgtcgtgccctcaaggagccccttcgccatgactgggccgagtctgttggcccactaaaagcccatatatgtaaaagagatagcgtgcccttaataatgtcactatcataagggtaaccatgtaaattcccctgtaagcctaaaacctaagagagggagcctgcaatagagttataatagcctcttatggccatgtaatgggggatccctgaaaaatttttaccaggtaatacagttgtttctactttcaactactattgagagaaccacacccttcgacgtgacgcagttgtcgttcgacaacatctttcttttgaactatctaccactactagaaaaattgtctttccagattttccttggcgaggggaaggtccgcctgcacgcgcggcccgcctgcgaaaatagtttacgtgaacaaaaaaaattgctaccaaaaaaatcgccgccgctacagcccctccccccttcggcctgatctgggagggagggaggctgccgctgggagctggcaccacctggagccgcgttgccaccgccgagagggagggaggagagggaagccgccactgccaggacctgctaccaccttgaccctccgcgccaccaccgcttccctccaccgctgcctccaccgaagatgtgagaggggagccgccaccgccctccggccatatttgggagggagggagccaccggtgccaccgcctcgaccgtccgcgccgcaaccgcatcagccaccctccgcaccgccactatttgtagatgtgctgccttccctcctgcccagggagggaagccttcaacgccgccgccacctccttctccaccctccgcagccgcctcctccaccctttgcgaactcaccgccatcaccggtagccgctgccgtcaccgccctccggtagttgcgctgggagaggaggggagggagagatgaggccccggaggggaaaggagaggggatggagagagcatgaggtgtgaaagtgaatgagacttagccattttggtgggtagatgccgcttttaatgtgtttgacctttttgccggcggacctcttaaggtaccgtttgcaaaaatagaccacttaagaggtccgcctgcaaaaatacctctattttttttggcaggcggacaacgatctcgcttcgcgttgttattttcgcaggcggccatttagctccaaaacgcctacccgccaagaaaaaaaatgccatcgtctagaaaaatggtttttctagtagtgtacatgactctaatatttagacatgccctttttccaattattttgactttagttcgagggatctagggggtggatccaacgtgaattctagggggattcgagtcctctctaccctgttggatcaccattgatagaagaagatagaaggggaaggaagagggagaggagctagagtagaaggagatgattcccttccaaattatattctggatccacccctgcagggagcttatttctatttttttgacattaaaaataacctacagagacaaaggcgcgtgacgatgagaagattatgacatccatacgcaagcactcgtgtcatgtgacacgttacatgcttcttcgccccacttcaatttgttcccactttccaatcttgtcctttctaattaaacggttggattttgtttataaatggtgataccaatatcttgaaatactacttgatggaccataacaaacctcaatttatatttaagtttgattgagcaaggcatactacacatttcttttggaataggagatgattcaagcttcctagcctacaccttgattacatggtcagcttagtgcaaaaaatgggaccggccatcgaaccgatctgaccactaggtcgtccagttcgactatagatggccataaggcccgcccggcacggcccggcccaggcacggataggcacggcccgagagcgatcgggccggcacggcctgattggaatttcgtaccgtgccgtgcctgcccatgggccgcacgtcaggcccaggcacggcccagtagcaatcgggccgtgccgggccgacacgaaggcacgatcagcccattgggcctgggctagcccaggcacggcttaggaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttaattgacaaattcaaatttgaacatgccttagttgaattcacagttctagattcacatatcacctttacaaaaattcacagatcacagatcaaagattcacagatcacattgacaaaaattcatagatcacttgactaagatcacatatcacatggacaattcacagaagagtttcaaaaatcacagactcacagttgttgattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaaatcacagttctaagattcaaaagtttcacgaagtcaaaaattacccaaaatcataaactttcacccaaaaacttgacacaagtatttcaatgaataaagtagctgtgtagtgcaatggctgcctcgttaaaaacctttctaggtaaaaactcacacctcgtgagaaaaccctagaaaggaaaaaagagtgcagccccaagcattaatcaaatgttcataataaagtccaagtccaatacaatcatccagtcccagtggcagtggttacttcatcaagaaacaaattgtcaaaagagtttataagctctaaattctccatggtatgttgcatctttgcatctgcttgctcccaatctttgattagtgccaaagcttgcaccatgtcaggagctagacgccgtcgtcgctcctcgatgatcctgccagttaagctaaaagcagattccgatgatatagtagaaacaggaacagtcaaaacatccctagctaatatggaaagaataggataggtgtggttgtgctcatgccaccagttaaggatattgaagtcatcatcgtattggttgacagtgtcactgtcaagataggcaaacaactcagatgcattcatgttagcagtagaagaancagcttgaatcaaagcggtagcagaagttctcctagaaaatgcaccagcaccaagtccagatcctgcactggcaccagcatcaccaagtcagaacctggactggcactagcaccaaatccagaacctggactggcaccagcaccaaatccagaacctggactggcactagcaccagcattaccagcaccaagtccagcaccaagactggaaccacaagcagcagcaccaaaaattttcccccaagctgtctttttcttaccagaaaaagagcttggggttgccctttgtaatgtcacagcaccaaatttacttttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgcttttgaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgagacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccggctgccgctcaacgacctgcaagaacaaatgaaacaacgacgagagc

SEQ ID NO: 73235 - DNA, 13817 bp, Oryza sativa
tcctgcggcccaacctagaacattgtctgaataaattgcaggtactgcaaagaaagctcaacataaactttctgcctccttgcacacctacgttgactcatccggtgagtgtaatgttgcaggatagacatgtcctgtatgattaatacaaacttgttgtttgttttctaacaaacattgctaattcaggctacatctggatctgaagtctctattggaaatccagttaccaccactgagtgactggtccatgagccaaatatcccagtgcaagttaacctggatgttggtgccagtaatagcaggcagcagctttaggcgtgcagtatctgaaaatcgctcttcaccgaaagaactagaaattgggaagtcttttgtgataccagaaacttgtgggtgttttggtgtgatgtaactgtgaagtaggactgtgccaagtcctgtttgttctggtgtatgtcctggttgttgtgatgggctcatgttggtacccattggttgttcccactaattatctgtaggtttgttgagcagtactaattggtaccagctgatgaggtagtatattttgtgtagtcgttatcagctgatgaagttgtatattttgtgtatgcctaacggtgctgtgcgctgtggtgagatgcacatttagtggtggtaacttaagtactttgtagggaagaacctatgctgatggaaagtattaatgaagcttatgaacttcattatgttatgcgcatggaatttgattctcagaaagatgtaaattgatttggaaaatgttgatagccagatgtggtgttgagaccatgtcaaacttgtctgcacaatactggctcaatctgaaatcacagtgacatggttttcaattcgacacttgatcatagtttacaaatatggttacgtgtgaatattgaacacggtgaatttgcaattaaccaagtggctatagaaagtatagaaaaatgtggaaagtagtggaaagtaatttataaatatctatattttggatttaacatctatctattaacttatttaaggaatagaaaaaagagccttaacgttcgctttcacggcctagaaattctcatattaattagagaaaaagaaaaacagagtccatatagaaatacaatttagaaatagttgaaattcggagaaaatataatgatgctagcgacgcaatctgcgcgggccaccatgctagttacaaatattaggagagtccatagggtttcaatgtgaggatcaagttatcaatagagtaaatttgacaccgcggtattatagttatagttgcaaaaatctaaaagggttttgataaagttgttagtatcgagattctagttagtattgtttttttttcctaaagtagtattgaattgtataattgaattattttattttctttttaactttttaaaattttgaactgtaacaatcgcaatgtaagccgtgtcaatgttgttttgcgacgccaggcagattggcgtggttaaaaggttcatattttagaaataagttcaaaaataaaaaaaatctcgtaggatcctacaaaatatagtaatattgtttcgatggaaactatcagtatactgatttttgtgcgcttctaattattctatgcttcgtatcccgacactagagcgataccacccgaaaacgatactacaaccgacacgtgtcgttttacccggataatatcgtacgataatgacgtatcccaataccgttaaccttgggttttgataagtactaaataacaaaaacgaaattagtcaatgatatgatatctaaactagttgattagaataaatatatttagagaatcttatcaaatgatattttagcaaataaaaaacatttttagttgttctcataaatcatagatgttatctaatcattattacaaaggcacaaattaattattatacacaggggaatgtataataatgaaatactgtagaagtcaaactagttgattagaatgaatagtaacgaaatagaaatagaactagttaagatagaaacagaaatatgtaatttttctgtactgcaggtaaatatgacacagtggcccacaatgtcagaaatccccccgccatatgtttctctactgcagcttgttctatcagccgaacacgctttccccaattttgttttcgcgcgaactccctcacagccaaccctagaatcgattccgccgccgcccacctctttcctctcccgcgcgcggcgcctgcctgcaacgcgaccggctgctttctccagcttcaacgccgtcggctgccttctccgtccgtccggattgcagccacctttcttctcggagaccctccgtcagccccgttttcttggcctgcgcggtcgtcagcctccttcgtcggagtcgcaggcccctctcctgctgggagcctccgcgcggagcgcagccgcaggacgccctcatcggccgcaacgacgctgctggccaccatcgccatctggagcactggagcctgtggcctctcctgaaagaacactgtgtaagtgagcagtagccatttttatttttctctctttctcattcccaaaaattcaatatatgaatcaacccttagtttttgtttcgttgtatttctttgcagcaaaaaaggatggaagaggatcgcagttggatgtacaatggacgtagaaagcgtaatcaggttagtgctgattggattttaaagactacagattttttagatcgggcattcagtagggacacaagtggtgatggtgttatgtgcccatgtaactattgcaacaatacacggccccaaacaagggatacaatgatgaaacatctttttaagcatgggtttaggccggagtacactgtgtgggtttaccatggcgagtctgactcagaccctacacgcgatgatgtgctccggcaacgtacttttgatgaagatggggatgctgaggttcatcggatggatgacatggtagatgatgtgcgtgatgcacatatatcagttgaggaggaagaaccggaacctatagcacgagctttttatgaaatgttgactgcatcaaatcaatctctccatgcacacacagaagtatctcaactagatgccatcacacggttactagcagtgaagtctcaattttccatatccattgcagggtttgatgcattgttgaatgtgtttggtgctctccttccacaaggccacaagctacctctcaatttatatgaggctaagaaatttctaagtgcactgaccatgccatatgagaaaatagatgtatgcccaaaatattgcatgctctttagagaggaaaattcagagaagacccattgtgacaagtgtggtgagagtagatatgtggaggtgcagaacagctatggtgaaaagaagcaactaaatattccaatgaaagtccttcgttatataccattcatcccaagacttcaacggttatacatgtctgaaccacaagccaagcaaatgacttggcacaagtatggccataggtaccatcctaacaagatagtacacaccgctgatgctgaagcatggaagcaatttgatcgcgacttttcggaatttgcatcagacgctcggaatgttaggattgcaatagcaacagatgggtttaatccatttggtatgggtgctgcctcctacacctgctggcctgtgtttgtcatccctctcaaccttccacctggtgtttgcatgcagaaacacaacatgttccttagtttgattatccctggacctgattatcccggcaagaaaattagtatgtacatggagcctctagttgatgacctactccatgcctgggagcatggtgtgcagacatatgatcgggccactaaacagaattttaacatgcgggtgtcatatttattctcgttccatgatcttccagcctatgggatattttgtgggtggtgtgtacatggtaagatgccatgtccagtctgtatggaggtgcttaaaggaagacggctgaagtttggtggaaagtactccttctttgattgccatagacaattccttcctcatggtcacatttttagaaatgacccaaactcttttcttgcaaatactactgttacgactgaaccacctcatcggttcaaaactgaagaggttcatgttcgcttgcaacgtctgcaacctgctgccaatggagaggggtttgaaggttacggtgaggatcacaattggacacacattccaggcttgtggaggctcccatacttccataaattagtacttcctcataacattgatgtcatgcacaatgaaaaaaatgttgctgaggcaatatttaacacttgtttcgatataccagagaaaacgaaggataatgtgaaggctcgacttgatcaagcaatactctgtaaccgacctgatcttaacatgatccggaggcaaacatctgggcagtggttgaagccaagagctgatttttgtttgaataggactcaaaagaaggaaatattagaatggtttcaaacactcaaattccctgatgggtatggatcaaacctaaggagaggagtgaacttcaaaaagatgcgaatcaatgggttaaaaagccatgactaccacataatgatggaacgccttttgaccagtcatgttccgtggctactttcaaccttatttgtgggaagtgatagcggagttgagcttcttttatcgtaaattgtgtgcaaaagaggtagatccaattgagcttgaaagcatggaacttcaagtgcctgttttgctttgtaagttagaaatgatctttccatccggattttttaatccaatgcagcatctaattcttcacctaccatacgaagcaaggatgggagggccagtacagtaccgatggatgtatccaggtgaaagagaccaaaaggatcttaagagcaaagtaaaaaaccgagctcgtgttgaagcatctatagcagaagcatatatactagatgaaatcgcaaacttcacaaccatatactttgctgatcaagtgtacacagttcacaatccagtccctcggtacaatgttactgttgagtcgagagaatgctcacttagcctcttctctattaagggtgattctactagccgaggagtcactagacacttaactgaagtggagtgggaggctgccatgttgtacgtcctcacaaacctgcctgaagtggatgactacgttgggtaagcactttatttgggtcacatccagttcatagcatgaaataatttatcctttcttgacatgcatgagttctgtgtttacaggaaattcttacatgaggagtggagtagacgaggcgagccaacaagacagcaaaaggagaacctcttacggaatggtgctaggaatggttgtcctaatttcgtaacctggttctaccaacaagtaattcctcaatttcaatattcaacttgaacatctaatttctgcacctgttaataactataattcatcaaaattatttcacttcacttgtagagtcttatagacatgaatatgaatgatgatctgaagcaagtagctaaaggatgccatactagagtgaagacctatagtatttatgatgtgaatggctatcgattccgtacaaataaatatgagaaggagaggccaaatgcaaccaccataaatagtggcttggtgacaataggacaaggagaaaatagtgatatcactgattattatggctacatcaaagaaataattgaacttagttttcatggtgatagtgaactcactcttgtgcttttcaactgccattggtttgaccctgcccaaacaaggtacaccccacagtatggtttagtggaagttgcccattcatcaacacttgcagtgtatgagccatttgttgtagctcatcaagccacacaagtttattacataccatacccatgcaaatctgtaccagccctgatcgattggtgggtagtttacaaggttcagccaactggaaaaatagcagcccctgtggataaggactacgactttcttcccaacaatgataatgtccattatttccaagaagatggtctccaaggcacttttgtagttgatcttatggaaggactccataatgtttctgaagccaccactagagatgccgaaggcattgtcaatgacaaggacttgcagcttctaaatggatccaatgtgctacaacaagatgaatctgatagttctgagtttgatgaagatgaggaggagggccccatcattgatgaatatttctaagtaatatttttgcttttttacatgttcattttattctacaattgatgaagatgactcatttgatgtcttattctattgatttccaccctgctttaatagaaccgatgaagatgacaacgacgaggaccacttctgtgctgacttgctaagtatgctttgcttaatgtatttgccttttcttacactttagtttcttctacatggacatgatctgtttttcattcaaaccttccctacttaatcatttctcaaataattacaatgtattgatcagtctccttgcatgttcttactaatgtgtggctaattcctacaggttatgaagcaatataagtagcatcattagagctgatcagaaaaggtatctactttcatctcatcagttttaagatcaattcatggatggtggttggtgctgtacatcaacagatgcatacattttatcaactgtgaaaaactgctcaagttacattattgattgttcttaaccatattgacaaatcacaagatatatagtaatgcatgtttcatttcattacttatatgatagttctgctactctgcataatggcaagtgtgtaggtttgctaggtggatacatattttctcatgtttttattccaagcaaatccatttctcagcttatagaactgaccatttggtcttctttgttttggtttaattagcttgtaacagtacatgggtccgaattatggaggataatttgatactagctcatattattcttttgcttcaaattaaatgtcaatacttctttgtaaagcatcaaacatgaggctggtgcagattagtgaaaaaattcataatatgagaaatgcacaaggatacagcagcacccatagcaccattttcatatggttcctactcaacagtccttgcaagaaaaattaatttcttataagtttctcacaattgcaggtgtattctcaagtttcaactgcatgttctaggaccaatgaactaaataatctggtgctagctattgtctcaaagatttgagtatttgctttaagtgacatggaccatgatcagcttgtatgcttattcattacaaccaatttttaccaaaatatatgcctatgtctgggatttggcatctcttctatgcttggtgaattgtattgtgatgaaaatttgtcttgatgaatctcaaatgatagggatgcaatgcagtgaattgtattgtgatggaatgtgtcatgatgaattgcaaatgattgggatgcattgcagtcttctgtgtgactttttgcaggtgatctatattggcatgcaaatatagaaatagaaatataaataaaaaaagagtgctgagtgtgacttcccgtgcgtcaatagcatacagcacacggtaacgctaaaaagcttaccgagtgcccgatggtgctgaactctcggtaacgctaaaaagcttaccgagtgcccgatattgctcaactcacggtaacactaaaaaacttaccgagtgatactgtggacgcacggtaacaaacaaactgttaccgtgtgatcctggtgcacggtaacccgccgttctgttgggagcgccgttacgtcgtgagtgttaccatgagtcccgagttttgagtacactcggtaaaattttcaaccatcccgtgcgtttttcgtgcgaactcacgggaagtccacatggtaaaccgatgaagccgccgtgtgagcgttaccgtgagctagaactcggtaacgacgttaccgtgtgtttttggcctgttcccgtaggttttgagcacacgggagcctttccatctccagtagtggcgcagctgctcacacccgtaatagctcatccagtgataaggttgttaggattagtttcttatctccaaatctgttctatctccttatcacttgtaactgaacattgtaagccacggtagaggctgtttctaccactatttaacagagatgcggcccgaggcaaatggttcaatgcttcacattttatcacagccgcaacaccaccgtcactgtgtatgagcgccgccgcgtcgtgcctgccaagtgcggctggcgcatccgtgaccctgccgctctgctcgaccgcgtcatcgtcctcaagaagcccgaccccgacctctggaaaagggtaatcaaacacacactgtagttaaaagactgaattgatttgtacgtacaacaaaaaaacccttgattttttgtaatgttgctcttaaaccggcgcgcgtgcagtctccaaggagggattgctgcagggtgatgtcgtcacccaagcaagggaaggaccggaagatgaccatctatgttggcgtctgcagggcgggaggtcaaagtgagtgtctgagccgggaggccgccgggcatcggccggacgcgctgacgcgggacggagagggcgcggccgtgcaggcgccagcgtggtgcgtgaaggcagcgggaggcacggacgcgggaggcgcgcgccgccgccgccgcctgcacgcccgcaccgttcccgcctcactaccgccttcccgggcccatattcggccaccgaggagcttcgctgggccgctgccggggtctccgtcctcgacctcgcccgcgcggcgacgccctccccttctcccatgtcgccgccgacgccgacgccaacgccctcccttctcccctcccccgtcgcggcccccgccgctgccagccgtcgtcgtggacgcgctacccccgcctcgccgcggcgctgtggaggcgctaccgccgcagctgccgacgcgccgacgcgctaccgcctgggtgtgtgactgtgtgtagaagagaggaagagatgaggaagggggaggctgacgtggattgactgacatgtggggcctacgtgggtcccacgctgactcagccgccacatcggacaaaaccagggtcaaaaccaccgagggacctaaagcgaactgtcttgttagttgagggacgtccggtatctgtttttgtgattgggggacgattttgtatctcgatgacaagttgagggaccttgggtgtactttttccttggataaatttggatactccgcagcggccaattcatgtatttccaaggtaaataagttcatatgagatcccttaattgtcgacgaatcctattttcgtccttcaactggaaaaccagatacaacatgttcctaaactatcaaaaccagtggatataggtcccatggcagtttggatggtggttttagctgacgtaacatctacgtgactaatttgactcggtcttcatttgacgtggcttatgaagcgaaatttaacaattttaaaaataaaataaaatatatgggaccacatgttagtcaaataataagattaaaaaatagtgggcccacatgtcagtgggccctacttcctctaccttagcccctctattctctatctcacccccttgtccttccaccctctccacgacttcaccgacaactccgcaaagacattgaccgagctgccggccatctcgatgagcctgacgtcgtgcgctgacagccgctcgccggttgccacctcgacgatctctagtccctccacttgctttggctactggcactgaggcgagaacggtgacgaagatgaggcattgcttgtcgagttcttgcttggcatcggtgttgccggtatctggtccggcaacaagcgtgtcacgaacctttgacggtgtcgtgtgccggttgcggttgcggctacgtcggcctcgctcgcgaccagggcaccggagaaaaatcccgcacagctgcgatcttcgaggaagaggagcagcttcatcttcccgccatggccagggtgcgggaggccgtgcaacgtgctattccaccctcgccggcctccccgcctcgtccccctctacgtgcactcgccagcagatactcgcgggcttagtgacggtgggcaatgcgcgaagagcccgggccggtgatgctcctccctccctgcccttgctcaccggcctccgccgattccgcctctgtcgtgcctctactcctattcgctggcgtgctggtgctcgtggtgaccacctctagggaagaaggggaagaggtgagaaggagaagggaaggagatagtgaagagagaggatgaggtggatgaagtggggtctactgacacgtgggtctcgctgtttttaatcttattattctgactgacatgtgggcctatatattttattttaatttttaaattgttaacttttgcttcatatgccacgtcaaatgaagatcaagtcaaattagccatgtacatgtcacatcagctaaaattagccatgtgatctacattgcaccggttttaacagttgaaggaaaaatattttggttgaaatatgaaaatcagattcgttgacaaattaaagaacctcgagtgaattattcctttccaaggggccctacagatgatggatacacggtttaaaacctaaacagtatctcaaaacacaagccgatgggcctacatgtcctctgtgtattgggcctcaggcgaaaagtagacgtgagctactttcggtttgttgggccgtgagaaaacgcgggcccctcacgcgggcgagtccggatcgctgccggcgcgcgcggcgcaaacgcggcactccgccgccgctctccccttcccggcgccggccgcgcgccggccgtcgatgtactgctggtacgcgtacgagaggaaaccccagacggccatgagcatggatacggccttgatcccggtcatcctgtccccgaacagcgcgacggcgaacaccggcaccagcggcagcgacagcgtgcccgtcacgttggcgaacagcgacgacaccctcacgatcagccgcagcgagcccaccgccatcacctgccacgacaccgacgtcccgaccagcgtcgccacgtacctcgcccttccgtccttgaacgccgccatctccgccggtatcgtcctccagtcccccgacgcgagcagccccaccgccgacaccgtcgacgccaccacgttggtccacagctgcgcgcgcagaacccaccggagcgtccgcgtccggaccaccttctcgaaggtggcctcgaacagcgacaggatgagcgcgaacacggcggaggcggcgagcgtcagggcgaacccggcggggtacttgcccctcggcacgctgctggcggtctcgtcggaggaggccccgatgccgagcagcgccgccgagaaggtgagcacgacgacggagttggcgatcagcaccgtgaaccgctgcgcgttgatgagcctggaggtgacggagttgaagccgagctgcgtcgcggccacgagcgagaaggtggacaccggcaggtactgcagcgcgtacgagtacatcaggttgtcgaagccgatgatgatcccgaggccgacgtagatgggcgccatctttgccgccgccggcctgggctcgtcggcggcgggcgccggcgtgaagaggagaaggatggcgagcagcggcgagccggcggactgcgtgagcgtggccatccacttgctgttgccgccggagttgtagtacaggcggccgaggagggtggccacggtctggccgcagagcaccatgaacatgtccgccgccaccgacagccaccaccggacgccgcctctcggtgacccaccacgcacggcggcggcttttggtgcagagccgtcctcgccatggtcagactcttgttctggcataagtttgcaaacagaagacatggctgtttagtgtcaccgtcatcagtaagcttacttctcaaacacaaaatgtaagcaacggaaaagatcaactttatcatttctcatctgatagttctccattttttgaaagaatatttgtaaaaaaaaaggtacaaatatcacaaggaactggagtgacgatctagttttaagggatcgtggataaaataagggaaatttagggggaaacaaaacaaaaggttacatgtaaaataagaaaacggttttgctaaaaaaatacgacatcatatactatttgatttcagccacttttttcaatgtaattgctacctctctgaatctcatatgtctcctcttttaagttgatttttatatactacttttaaatagcgtgtgtactgcgaaaaaaataccttataagtttcaaagtaaatacttccgccattctaaattgatcatcatatatatttatacaccaagaccaataataatttaaatcgcatcaatcaagacaacatgcacacattcttccacaatgtatacatcaattaaaacaatatgccaattacgccctagcatgcacacattctctcatgttatattaatcgtattccgataaaatttgtgtccatacagttatatcatgcagttatataatgatcaatttaagaaattttggattttgttctatgatgatcaatttgagaagtagagaatatgtcatttacgtatataaaaaatattcctctgtgtgtttttttgtctttttgtttttctttgcaaaatacaacgcgatggggcctgtggaccatgccttatgtgttgttgctaagcctgcttacgtctactctggtcttacttgtgttgaattcaatgacactagtcacactactatatgatgaagataagactaagagtgccctcaaaaaaaaaataataagagggcccatgcatggagaagtgatgtttcccactttctctatatattttttatttattcctcagtggcggagccaggatttgaaagttgggtattcccgtctacaaaaaaattcatagtaaaaaaaatcaatggttcacagtatgtcaataccgataatctaagaaataaaattacaaattattacatggtacctctaattttctatttcggttccttcgtggcttggaagagtagctttaattctgcgttccttcatggcttgaaagcggtttataatatcacactccttgactttcaaaaacatctcacgctcaataaatgtgaccaagcaatcattcaagtattgatcccccatcctgtttctcaatttattcttcacataattcatggcagaaaatattctttcaacactagctgttgctactggaagtaccagaaccaatttgagaagcttgtaaacaatctcatgtctattgtgcaattttgtttcaacaatcataatggaaagattagcaagattttttacttttctaaacctttcatctatacgcatctcagtgaggaagagtttcaatgctgatggaagatggttcatctctgtgcttgagaaatcattaggataaaaccgtgcaagcttaatcaacttatctttgtcccaactagcaaagttatctataggactaaatgcagccatacaaaggagcaaatctgtgtttacctcatcaaaccgttcattaagctcttgtagttgtctatcaatgacacttagaaacatgtcaacatggaagcgatgcatattcttgattttaataaagaacctcctatctcttccaaccggccgatagaaagagtccatatcaggaatcttgatcttatgcttcacacaaaaagattgcacttcttgaagaaaatatcccatccaggatcctcg

SEQ ID NO: 73236 - DNA, 6156 bp, Oryza sativa
gggccgggccggcacgggcacgaccccagtcggcccgtcccgtgcctgggccgggccaatttgttgtgccttggccgggccgtcgggccccgggccttatggccatctataagttcgcccccagaaccagattattcatgcatgacttgggaatgaaacaacgtgtataagtggtctagctggcttaattgttgagcatgtaatgaagcaagtagggagcctagtaaaacttacacttgcatgacttgggagcctagtgggcctttctagcctggcccatgtgcttgccaaaaccgccggttttgaggtgtccggttcgccggtttgaaaaccgcccggtttatctgatttttactggttcaattgtatatctagtccttgcagcaaaccgaaccggttgaggagctggtttcggtttttcttggtccaaccgccgggtcaggcccctttttttttactaggatggtcagtgtatttgctacatgataaaatttttaaacacgtggaggctgctgcaattttttgtggcacatggacacgatatgccgtgccacgaaaggacgcagttcacgcaagcatgaaaagattcctaccagtaagaagcaatatgtttctagtactgttggacggtggcaccagttgtatatgtacaacaaccaaacccagtgtgtatgtacagctattgccgccgtccaacagtacttccaaacatgaggttcgaaacttgtacaggcatccaggatgtttctgtgaggtgaatgtcgaattgtcgatggtgctttctctagtaggatgtaccgctgcaataattagggatgaaaatgggagcttctagcttgcaacggtagtctcgcatactaaaattccatgatgaagtgtcctgcaatggtgatgatgatagtagaaaatagggaggcatatgtgtagcacaaatagcaacaattaatgaaccaaataaatagtcaagcagaggtgacgacaatagagatctgaaacgaacctgaatcttgtacgttaacaccggccaccacagaaactataaccataatgaatgaacctgactttagcatcatgtgccttgacgctagagagaatccactcagtacaactgagttttccctacttctacaatctactactgattttatcaagttgaataatatgctatcgtgttttcttgaacctatactacatgccatcgtcatctacaagccgttagttgaacatctgttagagctttagttgaacatctgttagagctgaaaaaaggcctatttaccctaactcatgttttattgtgtgtcagatactacttccttttacttctccgcgctcgctacctttgttttcaaacttacaactgcgttgaaattccactgcctttttctttcgaacttactgctgcgctgaaattccactgctattttatttcaaacttgctactgcgctgaaaacctgaaattcaccacattttgaccccccataatacgcttaacaattccggcattattactacctgcatttttttttcgcagcagcatttcgttcaactgcatcaaaatgtacatggacggatatttgtataacactcagaaaaaaaaaatccattcccatgccactttactcgcgcctcgtgagatgactaatacagattacaaaatgagagatgactaacaaacgttgattaccattcactagcaaagcaggagcaacggcataagtcccatacagccaggttcagagtcaaaaaaaaaaatcacaagaacagtagtacagtcggccggccagccagcggcgcgtcgatgggatcccggcgaccggccgccgccacgcttcgatggggagcccagcgcccggccgcgcgtcgatggggagccgggcgcttggcagcgcgtcggggactggggtagtcagcggcgcgtcggggacttgggcggccggccttccatcgatgggagtcggcaccgcctcacactgggcagatcaatttggggcaggagcacggctacggttttcagccaactagtgctatagtgaaaggatattttagtcattaagaaaaaattcaatacatcaaacgggtgccaactaacggcttgtggacggcgatggcacacagtagaggttcaagaaaacacgatggcatattattcaaattgacaaagttagtggtagattatagaagtggggaaaactcagtggtactgagtggattctctcacgctagagacccaacatctcaatgtcatggttcttagcactaaatactggttataagccaatatctctgacgcttagccactactagaaaaactatttttttcagatgatagcactgtcgacgggggatacccgtagaccggatatagagagtattggggtccgttagtacgaggatctacatagtacgacaacaggcaaacaaaagaaaagaattatactggtttaggccccttggtaggtaatagccctaatccagttgatatgggattatatgatggaaaccacaggttacaaagggaatagcggaactcaatgataccgatgagaccgtagtcgagttggttcaactagatctcctggcgacttggctcctgcacgctccggctccgtaggctgtggtggatgttttggcagtaatattcgatgccttaggtcctgccagggggtcccttatataccgcgggttagttgatcctcaagtaggactcggagatatcggacccctcacgatacagtaaagactcaatctcgaccgagtaggactcctcccatccgtagattatgtttctatcacgtgatagatttgcttaacgtatacggaaactatccgtatacgcgtgggtataccgtattagtatacagcgtacatccaagggtagagggtatatcttatccgtaacactgatagtagccccccgacttctgcttaaatgaactcatgttatcgatcgcaacttttgatgtcgaaattgttatcgttctcatctgatcgatctcggtgtaaaaaaccgtagagacaaagagccatcgacaacaccgcgtgaagttcaatggtcatgagtgaatttaaattgatgtctgaaaactaccgcgcgtaacagacctagaattttccggcggcaatctctctcctttccttgggatacgcaccatcgatagtgcgcttatttatagggatttcgggaatccattcgaagtccgtttgccagaaaactctcttgccttgtagcgctcttcgtcttctccgctccccgcaaagaaaaccctagcttatttccttcatcttattctccagcgatcctttggcggcgatggatcttgagtagtctaccttgaacaccgcattcctgaagaagctgtaggacgacggtgccctccctagtcgcgggactttgcaaagggaggctggaggtacagaacctgaactcatcttgggccccatgtttgtggtcgaggattatatttcttgcggttttctcccttcgccttccgaatttcttcttctagtcttgaatttctacggcctttctttgtttcacttgaaccccaattccttcgcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattgtagcaagtggcggacgagatggttctatctctagatagaaaactcggaacccgtccttgttgtccctaaggatcagccagaagaaatcccagagtggaccgcaaaaccagccctgactccctccctccaatctttcatcgacatcattgatgatctccgaaaacggcggttgtcgggatacgaagtcgctgtcgacttcgtaggtcggtggattgagccgctgcaggcccgtgcccatccggcctttgaatactctgggccagaggacacgacccgggtctctcctcagggtattttttctcgcatttctaattttgttccgagtgcatctgtttctcctgacttatcgagttctcgttctcgatttataggtctggacagcgacactgtgggacgtcacgttggtcagataatgatcagcgcatcctcgaaggcggacgatatccccatcgcactctgcaacaaggacgcgaccgaacgcgccgccgcgattaatgtaagtgtattcgatgattcctttacatctctcttctcggggtcgcatcgtgacttcacgttgtgcaggctctccctctgacgtacgccatcggacctctcgtggatcaccaggcggcaacatcgttgaaggagggcgttgccaaggaggcatctgacgctgttgctggtggcagtgttccgaagaaagggaggatattctcgtccgtggtcaggacccgctggaaagcgacaagctccgcggtaagcctctctctcgttctttagtgcgtagtcggaatgacttgacctcacaccatttcatcttactcatgactcggacgcatctcctccacctcagcaaagccagaggttggtgacgatcagcaagaagtaagtaaacgttcttgaggtcttttcattctcgaagttttgattgtctaccgtcatgaagtaaaggaaaatcttcgcagaatggcgcaggcgaaggtggcgcaaggtgggactgatgctgcttccagcgtgtcccctgtggcgacttcgactggagtcgtggtcgctactaaggaccaggaagcagcaccgagtagccctgccgtcagcctcgtgcctacccggggcttgtccaccgatgccctcaccttggggggagctccaagcggagatggagcgcatcctctaggtcggtgctcgcggcgtaggccgcgagatcaaggaggtgagggcggcggcgtcgtcggcgaatcagcgtaccgatcagctggcgcgcgatctggcggaggcccgcgaggacctcttaaagatgagggagttggtagccggaaatgagatgcagcggcacggacacgagcaccggatgtcggagctcgagggcgacatgatcgacatccgaggttcgctgtgaatgtcgttcactagcctgcaccaacttgccagggagtgcggcgccatgactaccatcccggcgaacctgatgagttctcactgacgtcatcactcacggaactggctacgacgatgggggaggtttgtaaggagctccgagttccccgtggagaacccgaggagtcagcgactggttacatctcgtggttgaatagggcctgcacacagctcgaagggattggcaagcgcatcgatgaggccctgaagcaggagtgccgtcgagcgagccgctatgccggaggacatgtgatggcctgtatccgagatcaccacccgcagctgcacctcgagttcctttgtgaagggttctcgcattctcggaggacgcccgcggagatcgacggtcttgtgtagtcgatggcgccgcttgccgagaaggttttctgctccatgcattggcgttggccgtcctggtagcttttgtatcctatagaaaaatatctcaaggaagcatgtaatatactttgaagtatttgtgacttgtaagaaatacttgtaaaatataaatggaatctatctaagttttcttactctgggtacgctgtgaacgagtgttttctcactttccgacttcagccagtcacttgagccatacactctccctagctttgtgaattgtcgcgaccgagaaaattgccttttcccgaacgctagtgtattaatccccatcccaggaaaagccggggtacaccacacaaacatgatacaaaaggccaacctttattatatcgataatatttacattattacaaagacacttcaggcctgacaaacaaaaataaacagcagcggactagcgggcctatggctccatcttcataggcgctcaactggggtataagccaggactccacctaggatttcttctccaaagcttctctttctgaaggggggagagatagagcaagaatgagtacaacccccgtactcagcaagtcacaccgggagatgcatgattaatgcaagggagtacaaggggtaataatataggg

SEQ ID NO: 73237 - DNA, 12049 bp, Oryza sativa
ttattaatcaaggccggtggacccacacggaacctgcctttagcccaaggcttacgataattcaagaccgacttggcaaaccggacgtgggtccaagctcgtcccaagccaaaccagggcaaaccttttcacattttagttgttaggcaaattttaagaattaaccccttaacttgggtacattgctaggattgcccatatcagagggcacggctattcgaatagatttactctgatcagaggtgtacatctttacccacaagacacatctttactccgcattccatggccttggaacccgtcataaacatgtgacataacccttcacccatcctagccgtgaacaaaagtaccgacccaaccctgcctacagccggtatcccgggacaggcaggccaggattgagccattagcaataggatatagaccgggtgcgccacacgcataggggtgagaccacccgcatactagtcaagtgccatggcatctcgactaacgggcatcgacccgtgtagtcttcatttgcctagacatctcgattaccgagtcatagctcgtgtagccttcatttgcctcagagatatccatcgtcgcaacgacttcatccatctctatccgtgtccttttgtttaggactagactgagcaccgagttaagccttacccattagacatgtggttagtacggtagtgctttgtaacagaggcccgaagaccggtccttatagtggccgaggtgttactggcaaaaccctgcacctcgagcccagcctaaaactattttgggagttttgaatagagggggaaggtgtgtgttcaattccaacataagccagccattccacagtgtccaaatgatatgagcattcccaaagtctaaagttataaaaccacctaatgttgcctaattaatcagcgaagcatctacctaaattcatactagtggaaccgttaatagagtacccactagttggggttttgtttatcctagggtgaacaaggtaataataaacaatagcaatgataaagctataacaaggattaataggaagtgctaaataaaatagtgataacgcaggaatttaaataaagcggtaatgcaataatttaaatcaaaataatttttaaactgggattcaatatgcttaagggtgatgtgacttgccttgctcagagagaacagccttccgaaccttcggcgacgaccgcaaaccacgcttcgagaacctccggaacgacagaagctacgcgaagcacacaagcaaagctacaagcctataaagaagcaataacaatacataaaaagaaagcacacggttctttaggttataacaaacattaagagacttgaacgggtcgattcggggttcgtatgaccaagatatgatcatccgaagtttattgctgttacatggagatttacggattattgtgattaggttttgcaaatataaaacatgtataagcgctagcctggaaaagacaggaaggctgtgccgttgacatgtggaccccacatgtcaacctaagggaccacagtagaccgagtacacagagacggtccatgggtcgacggaagcggatcccatgtgtcaaccgaggcgaatggccgacaaacggactcctatagacaccacacgggctgcacacgtggaaaccacgcggctaccgagcgggcacactaacacggtcaccacacgcataagcgaacgactaccgacaccagtaaacgggtaccggggtcgacaaccgcacaacgggtacggggcgacaccgaaaggacgaggacggggcagtgagaggacggatccttaccaccatgcgatgaggcgtgggaacgacaaagacgaacgagcgcgacggagacggctcagggacgacggaggcgaacggcgagggaacgacttcggcggcgatccttgcacgaaggcgagacgcggccagcacaaggcttgacgacacggagccgaggacgaagacaacgacggggctgcagcggcacacttgacggacgtggacgacagacgagaacggcttgatggagggacgaacgccacgacgaccgggaacgacgagaggacgacgactggaaccagcgaggaggcgatgagggcagccggcagcagctgcacggagacgaggacggcgcggaacacgccactgcgatgccgaaggtggttgaggtgcggccgaccggtgcacgggcgaggagggacgggcggctgaacaacttcgacgaggcggatggagaggttcgtggcgatgtgcggcggcttccgggcgaaaccgaggggtggacgaggtggagggctacgtcaccgtgccgagggaggggacggcagcgccggctgacgcacgggcatggcagaaggggctgccggaggagacgtcgacgaggaggaaggagaggccggtgcgggcaacggcgttctggcgaaattcgggcgacgccgtggcctggccaggaaagaggacggcgtttcggtgccgggagaggtggtggcgacgtcggccggcgcacaggggacgtggcagaggcggccggaggcggaacagtggcggcaacgccactgttgccggcagggatgcacttctggaggtctccgcgtgaaacagagggcaggccggcgaagaggaggcggctgcgacgctagaggaggccacggcacggccggccggcgtgctaacgcggcggcaggggcggctgaagatggccggcggcacgggagagaggggacgacggcgggaaggtggctagggacctcgggaagactcgggaggaggcaaaaacgagagaacgcaaggagggggttccaatttataggcgcgggtcgggagctggccacaggagagggtggaacggcggcggaaaaggcggccggcggccatggaaggtggccggggttggcgcgggcgttcccgacgattgggggcacgaatcaagggggaaattagggggaattgaagaggaaggaaaggggattaattccccctaatcaattttggaattcccggtttgaatcgcgtggattttggggaggaatggcgctagggttcacgggagagaaagaaggaggccgccggctggaggtcggggacgcgcctgacaggcgggacccacgcgggaggcgtcatcagcgcacgcacgtgcgcggcacgggcgggagggcgccgctcggcttgggtggggcggcttgggctaggacgtggcccaggcgggaggggaggaaaagggagctgggccgagggggaaggggaggcccaagagaaggagggagagaaggagagggagtgaaagagagggaggaagagaggactttggccgcgggccgagagagagagaggactttgggccagacttggcccaaaggaggaaggaggattatttttaggcttttctttttaataaactttgatcatagttgttgttgcttaataaatatttccggtgctctgaaaatttaagtaaaatttgagggctctttttagaccaaggagaatttaacaaaaattctccgggccacattcgaatttttcttgaacgtattttagtgtttgccaatttcttttcgaattttaattaattctattattctttttagaaaatgatttttatttcgggacaaatttatcaggacgtgacaataaggctcttggacccttgacctgctgtagacccccgattttggaaatcggaaatcttctgtgtttatccgtaccaatccctagatcagtagttggtacacacatacatagttggatcacaacatatcacgaatgagttcaggctaaaagagttaaatacttacattagggccaggtaggccaacaactatcagagaacaacagcggaagacaaaatattataagggcccggttaacatgccacaggcagtcgacaaggacttagaacaaaaccgcaatccgatcatcttcttggatacgcaagcgtaccgacaagggcttctcttcaacactctcctaaaagatatataaatagcaagggtgagtaccaaccgtactcagcaagccaccacaacaacaatgcatatgatagaggtatttcaaggaatggcttcaggttcctttgcgcaaagcaagttttgcaaatcttttcacaagcctaagacctagcatagactgattaagttttaataccagtgtttacattaaacaacgatggttctgtccaccatccattgtgatcccaaggatagcttcccgccattgagtcgtcatggttttctgaggacgtccaccttccctcctctcaggaagtggctccatcagcataaaattcatcatgcaatatcccatcccacacatgttaagaatttagagtctagccaagtgtaatacacgtcccggtgctcaataaccgcgagcacggctattcgaatagatttggtttactcacactgcagtggatgtacactttacccgcactccgtgtcacgtcctgataaattcatcccgaattaaaaatcattcgctaaaaggaataatagaattaattaaaattcgaaaagaaattggcaaacactaaaatatgtacaagaaaaattcaaatgtggcccggagaatttttgttaaattctccttggtctaaaaggagccctcaaattttagtggaattttcagagcacaaataataattaagaagaaataaacaaagttaaaaaggttttgtaaaaagaaaaaccctaaaagtcttctttcccccccttcccttcttgggccggctcggcccaactccctccctctctctcctctcccccgcggcccatcggctcctccccgcgcgcgcgccgctgacgggcgggcccgcccgccaccctcgctgacgggtggggcccacccgtcatcccctacctcgcgccgcgcccgccgctcgcccgtgccctagcgccgccgccgccgcggattccgccgcatcccgccgtccccgcgcgccataaagagggggaaatcactccccgtgattccctctccctttccccctatttttccctctctctctccctcggattcgttcggatttcctcccgcaaacttcgccggcgccatcaatggcggccggatcttccgcgccggtttctttctcctccggccgccctctctcactcccaccgctatttaaacgctccccgtgcctccctcctccgtttccgaccctcgccgcactctctctccgtcggattcgagcccgcgccgtcgtcctctctctccgccgtcgccgccgagctccggttcaccgccgtcgtcgccccggaccacctcccgcttcggcatcgcttgcttcggcatcgctgtgtccttgccgatctcgtccactcctctgtttcgcccgccgaccgccggagcaccgtcgtcctcgtcgacccgagccgcgccgccgcctctctccacttcggtcgccgtttccgtcgtcgccgtcgacccggggtgagccgaggaccgttgtttcacttcccccttccctcccctctctcggccgccgctccgtcgcgccggaggtcgccgccggtgaccatcggggcgcgggcgcgccgcctcccgtcggccgtgccggcgaggccgccttcgggcgcgccccgcggctgctaggtggggcccggccgtcagccgcccgcgccctcggtgcggctgacacgtgggacccacggcgccggtcggcgtcagccgcgtgcgcccggtccaccgtggaccgtgaggctgccgcgtgggccccggtccgcgtgtcccctcccctcggctgacgcaataaatccaattttaaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcacccttggataaataaaaccccaactagtgggtactctattcatggttccactagtatgaatttaggtagatgcttcgctgattaattaggcaacattaggtggttttataactttagactttgggaatattcatatcacttggatactttggaatggttggcttttgttggaattggacacacacctccccctctattcaaaaaccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgagggagatgtgtcttgtgggtaaagatgtacacctctgatcagagtataatctattcgaatagccgcgccctcggttatgggcaagctgagcaatgtacccaagtcagtgttttaattcttaaaatttgctcaacaactaaaatgtcgaatggttggcctgggttggcttgggacgagctgggacccagggtcgggttgccagtttggtctgaatcatcgtaggccttgggttaaggcaggttcgtgagggttcacggccttgtttaataacattgtgtagctctaggatcgtccttataaaatggctttgggcaactaagtgacttttaaatgctgtttactgcaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcaactgtaggataagccaagtggataaaacctaaggacatattttataaataaaactatttccgaaagtccctttttcctcctttcccctgtgctatttgcaaaaggtttactcccttcttccttcttcagatttcaactagtactagttggttagttttgcgaagaagaagatgtcgccaattgttcgccgaaggtccggaagaccgcagggtccgctagcgaagtggaggaagcagtgaagccagctgtgaaggagtgaggatcttgggaacccgtcgcagaacctaagccaccctctagtgtttcgtttgttgtgtgtttccttgcttgtgtgtgtagtgtgtggtttgcatcggtgggttgtgatgtgaccatgctaggttgtttgcttaatcaacttgcagaataagtgaaacaaataacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaacccaagttttcaactcaatccaccactggcctcaagagagttaaccagggcatacccttggtccattccaagcatgctgcttagttcacagctaccattagttggaagtcaagaccaaaatcagtatgtgtttgatcgagcatttgccacccaggtcaatgagcttccaatgctagaagaggatgtccccttttgtcacgattgtagagagcaaggacactatgccctgaattgtccatgggtatatgccaaagaagccccttcctttggtttagcagggcagacatcgctaaaccagcctcctcgcaccaagtcaagcttgcagcctagtgtacaaaggagagagcctaatggagagaatccattgaatcccgggaattgctttcctcctagcccttcgtaccacgtggggtcacgtgctaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcaccttctaagccatggtggcagagtatctgatagtgaagggtcagatcaagtctcctcggattatgaagatgagtctctccgacatctcggcgaggaagagatggaatcaaaagcatgcccccgttgtggagaaattggacacgttgctagcctgtgtttcacactctgcccttattgtgaggaagaccatccaccaggtaaatgtcccacccgcaaggtcacatgttttctgtgcgaaggtaccaaccatgtgcccaaggattgccaactcagtgtgttgttgaccaagaccgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctgcaccgacggcctcagcaaagaattgtcgtcgatggaagaagttgtgtctctccccgacctactccaggccgagcgaagggcaatcaatctcaggagtgcgataccaagcagaagaccgttattcgcctcaatcagcaatcagaaggaaacttctcttgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaatatattcatgattataaacaatgagtttgttatgtttatggaagattcatgttgaggatgcaaggtaccgatgttaagcaccttccctttttgtttaaggcagtgccttgtattcatgtaataagggagaaatgtgtaataaaaacaagttctatgagggttattttggaagatgctgatatggaattatgtgtataattgtttactgtcaaaggagacctagggtctcatttcagaggaactatgttctaacctcgagttaaaaaccaacctgatgatagaaaagaaaatgccgagtccgggaagatatctgttgcttcaattgtcaaggaatgggtcatttcgccgacaagtgcccaaaaccgagaaacatagctgccagcacgtcagtccacgcaactccttgcaatcagaagcttgctcctcagcgaattgtcatccatgcatcccgaagcagtcctatagcccgcattgcaacagctccaactccagcgagtgcattaccacaaggtgtcaatgctcaatttcagccccagccatcagttgacaagacagaggccagtatcggcattgtacctttggatgttccagcacagcagccaagaaatcaagtacaagatgaagaacccgaacgtaagaaagttattgtctgttacaactgtagtaccggttaaggaagcagacatgccaatcgccaagtggtcactggagcaaatgcagtacctgataagcctaacgttagtcagaagcaaccataatactcttatatcagtgttcaaatacttttgttttatagttgttccccgtcaatcatgtaataacagagaaacatgagataatgaatgagcttgataagcttatgaaggacccatgttaagattgcaagtgctgtgagttgtgcacgttttgttgttgattagggagacctagggtctcattttcgtaaacccatgatctattaggaatcaaatagcctagcgattgatggcgaagaaaatcaagtgatcaaccaaagagacatttgtttggactaagagtttcagatgtgtctcttcggatcaaaggcaacaatcgtcagtctagcttttgacgaactacttcaaggtttctctgagagacagcacgcccaaggacctcattgccccagaagcatcctcaacacccggagcgaagagtacctggttgagaaaggtcgaaaggtgattaatggaagagatcggaaaagatgtttggttactgggaaaagaagtaggtcgaaaggtgattgataaaggataacgagaaccatgatttgtgtcactcgaggaagactcccgatagcaaaacaaccctacaacagttgcccggtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagcatcgttcaacgcactttcctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaagccatttgggaagacgtcaaagtatgtcaagtgggataagttggttctctggtgaagcataattcaaaggcaaagttatcgacccttgcatcaaatagcagaagtagctatcacccggagaccaggaaagctaatatgaggcagttggtggcaagttagaagtaaatgacaagcatgatattcttatgatgacaaacatggtatcctagtaatgacaaagctgatgtcgacgcatgtcacgaaggtggtaacttgtatgaggttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagacaagtttgttatagaagacagagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaggaataatgaattaatttaaattcggaaagaaattgggcaacactaaaatacgtacaagaaaaatt

SEQ ID NO: 73238 - DNA, 2921 bp, Oryza sativa
taagggttcacggcccttgtttaataacattgtgtagctcaagaatcgccctaaaaaaatggctttgggcaactaagtgacttttaaatgctgtttactggaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacactccgcgactgcccaacacatgagcctcgtcccgacacatgagacgcgtcacggcaaagcttttcgataacctcgcattggcagtacccgctccatgaacataaatcctcatgaactctaggcgtccatgtttctagcagtgagaggagttctggcgctcccgggaaagagaaatctcacatacatattatattagggttcaagttaagttctctctcacacacactcatggcagtcctaccaatggcgacaccgatgtagggctcgcctctcggccctacctcaacggctgttccaccgtagcgcacctgcctcactctggggtgaaccatctatgcagggatactgcctccgctcggctatctagtccgctaggtctatacccatacgagaagtgtggttgtacgggggtcgtttcatgcttaacttcatggctcagtccttaattgaccggggacggtactagccttttccagataccacccaaatcctccgtccgccccagtcgaaaacagttgttcccactttattttcctttcacaaatcatgtcatcaatttcatggcaatgtggcgctcatgtcttcacatgccgcatctcaattaccttcccaaaggtaattgcccaagcatttagcatttgataaatatgagtctgcatgatcctagaatagcatttctaagcaattgtcataattgactggggactcatacgtaaacatggttacgaaggaataagggataaacaataatcaaggcatggcataatcacaagtaggatgttcatcattgcatgcaattttatttataaacaaaataatttcgcaattaggatcaacatgttcaaggaatagtgatgacttgcctgctcatgataatccttattctcgatataatcttgatcaaccttcacctcctggaagttgctgacattgcctcacgactaaccgatacataaattctataatacgcaagaaaaaccaatattcaaacaacaaccaaatatgcacaacaaaatatactattcgtgtctgcttaatggattccaatcacgctaggggctaaggtttcttaatctttctattgtcaacgtggcctatttaggagttaaccaacatagcatttatgggatacatatatttttggctaatcggtggtttagtctatcaaatggctatggaaggattatggctatgtatgcatctatctaaataggacggttatatactagaggttctgttgttagatggatttaggatcaatcaaataattacagtgaatcatttgtattattattttattgatggaagctttactttaattatgaacatattttacttgtcacaataaattataaaaggttaataattatccatgctttgtatgttagatttgtttaggttaatcatattatggttacagattatcccatcacaaaattttacaatgaataatcctaatttacagttgaactataattataattatatgaggtgaagatttataactagtatttatctaatatacatgtttgtcatacactccctctaaattaatatatgcaacacgcaaattaatactataccgtacaactataatgggatgtatagtatatgtgtaagcaacaatattttattattagatcatatatttgagtatttgctttttactgtaagctatacaatacatgttgattttaagatggctctgtttggttaactaatagatatcaaccgactatatatatatattctacttcacatgacattgtatcaactaatttttaagtagtccaaatacaactagctctgtgattactctcctaaacaggttaaagattcatctatgtgtgtttatattttagttacaaaatatgaggctaaactttatgtaagtaatttataagtcatggatttagttatatttggacataggctagtgaatggcactaatattttcctttacacccattaatttgaaggattgattataactaatttatttggttgctacagtgacaagacatattaaagataattatgctactgtacaatatccatttttatttattggcacactatttaggttaactattatctaatcatttgatattaattaatttataattataaatatattttattaaatagtgaattatatatctttggaaagcttatgaatttagatgaatttaggttcaagtttcactcaaatccaagttaaaatgaataagttatgctagtgtaaagattcaaatttgaattaatccgagaaattgcgaaaagctactgttcataaacgattcatttttaatctaagacatatccacagccttgtaccaactgacaagtgggaccccgggtttatttctttttcctaccgaattattttctaaagggaaataggaagagctaatgacaagtggggcccacatg

SEQ ID NO: 73239 - DNA, 16114 bp, Oryza sativa
acggcgacgggcgcgcggctcggggcagcgcggggctcggcgcgcagtgatggcgacgggcgacgcgacggcgacgggcgacgtgacggcgacggcggaatgtcgatgggacggcgacgcggcgacgggacggcgcggcgcggtgcggggcttggcgcgcggtgatggcggcatgacggcgacgggcgacgcgatggcgatggggcgtgacgcgcggaggggtggggctcgaggcgatgcgaccggagatggcgacggcgcgcggcacgatgggacgtgagggggcgcggcagcggcgaagtgatggcgcgcggcggctcggggcgcgaggcgcgcgcggcaggggagatgggacgggcgcgcgacggggcaggggcgcggggcgcgaggcgacgacgcgacggcgacgacgatggcgacacgagcggcagcgggcagggggaggaggaggggtaggacggctaggaaccaaatcgaacacctagggggctaatgaacagtgatagccggctatttaaccctattttagcctatttcctatataaattttattctataaatcctaatttttacacaaatgaagtttactcaatatttgtgttattctaaccaatggattcaccctatattaatattacccatatttatttatttatcacacaaacgagttctttttagaataatttagattattggccctaaagtgaacttatatatttttggaagactttggggtaaattgaatttaatataacgacctgtcatgattaatacattagtagattggtcaagtttagttgtatagcaatatattttacacggataggttcaatctatttattctataaatagtaaattgagactcggcacaatattaatctaattgtttaattaaaacctcacataattttataaagcttaatttaattatatgaccattatttcatgtgaattggtttacctttatatagaccattataatttagtaatatcccattaattactcctagtgaaactatgttatagatagagttccactataaatggtcatcatttcatgtgtatttagatgtcatggcacgcaacacatggttcaagtatttagtaattaatccataatttaaattagtaattaaccttccgtttgtctggctttgttttcttgtgcgtaattatttgtagggttaacaattaaatattcacgtaaatttatctattacttaaattttagatccttactttactttctttgtgatcatttacggtttggcaagcaataacaatcataacaaccagcatgatgcaaaagttttaaaaagttcaaaatttttgtgatttttattgtcttgaattttcaggatgttacacctgccttggttgaaaaagcactgaccctagcccccagccgtgaagttggaaaactcaatttccgattacatggatggtgagaactcttacaataccagatcttacatggtcgtttgtctctgcatgatctgacaaggccttatccgctctgggcgtccccagccgaagttcccttaggttcctcaaaggccttgccaggacggcgtaaagggacatgaggataggtttcaactctaggtgtcgtcgtggtaagggatcgtcgggaaggaacactttgacaatattctttacctgaaatcgactttattgaaatcgtgagatgtcttacaaatttggatactattgatttatatgtaaaatttacataattgatcaatgttccaggaatttgctaactcgcgaccctcgccatctgcaatcttgaatgcgctcggccacaagacttgcgtgaccgtgtatggtccttcccacttgggtgagagcttgttgcgccctgcttggctttgaacccgtcagaggacgtaatcgccgatcgaaagtgtgcgtgttctaatgcacttctcgtggtatcggcgaagggcctgctggtagctggctgctctgacggcaactctttctcgatgttcctcgagtagattcacatcgtcgcttcgctgctcctcctactcttcgtcggagtacttctgtactcatgtgctctgatgtcgtagctccgtggggagcatagcttctaagctgtacacgaggaagaagggtgtctctttattcggtgttgtcagtatggtacggacagcccatagaacagaggggagttcttcgatccacttcttattgtgtgacatgagtctgtcgtagacgcgggtcttgatcccttgtagtactatatcgtttgccttttcgacctgtccattgctttgagggtgagaaaccgaggcaaaacaaatcttgactcccaatccaatgccgtaatcctggaagtcggcactgatgaactaggagccgttgtctgttatgatgcggttaggcaatccatatctgtagaatatccctttgataaacttgatagcattgtcagccttgatttcccccgtgggcgctgcttcaaaccacttggtaaatttgtcaatagccatgaataggaatttgtagccgccatgtcctcgtgggaatggtccgagtatatcgagcccccagcacgagaacggccaagtaagagggatagtctggagtgcttgcgttggcatttttgtgtgtttgctgtgaaattaacaggcttcacaccgctgcaccatgtcgcatgcgtctttgagcgcggttggccagaaaaacccttgtcgaaaagcttttcctaccaatgtccgtccgccggcgtgtgacccgcagaccccttcatgtatgtcgagtaggagatgtttgccgtcatcggacgagatgcatttgagacgtactccgtttggcgcctttttgtacagatcgttgccgatcatacaatagatcttggcttgtcgggttatcttcttagcttctgcgtcgtcatcgggcaactcgtcgctactcaggaacttgatgagcggggtccgccagtcgtctgtggtctcgatatcggcaacgacgtgttccgcctctgtagcccccgagctgatgtcggggacaaccgtgctaccttcgtcgtttgcctctttcaccgatggttttgtcaggacgtccagaaaagtgccaggttcgagtggctctcgtctagaagcacgccgtgctacgtcatctggttcgatgttgtccttatggtatacgtgtcccatcaaaccttttctccagcttcctgacttctgcgaggtacttggataactcggggctagagcacttgtagtctttttgcacttggttcgcgactagttctcaatcccctttcacgattagtcgtttggctccaagtgcggctgctgctcttatcccggcaagtagtccttcgtactcggctatgttgttggttgccctgaagttgaggtgaattgcatgcttgaactgatctcctgaaggtgatgtcaagatgaaccctgcccttgctccttggctgttgagtgcgccgtcgaatgccattgtccatgtttcgctgtcggtttgactgtttgacatgttttcaggcatagtccattcggctacaaaatcagcgaggacctgggtctcaatagctattcgtggcacgaagtggacatcagactggcttagctcgactacccatttcgcaatgcggccgacaacgtctttgtttctcacgacttcttcaagggggaaggaggaaacaactatgactctgtgggcttggaaatagtagcgtagctttcttgatgtcataattaccgcataaagcaatttttggatctgtgggtatcttgtcttcgcgtcgtggagagcttcactgacgtagtaaaccggtctttgcactttctctctctcgacaacaatgacagtactcatagaatatggtgtggcggtgatatagaggaataattattcattaggttggggagcaacaagtacagggggatttgacaggtagcgcttgagcgcgatgaacgcgtcttcggcttcctatgtccatacaaatttgtcttgtttcttcaataaggcgaagaaaggttgtcctcgctctcccatcctagcgacaaacctgctcaatgccgccatgcatccagttagcttttggacttccttgagtcttgtgggcgacttcatgttctcgatcgccttgatcatctcaggatttgcttcgatccctcttccggagacgaggaatctgaggagcttgcccgatggtactccgaacgtgcatttctctgggttgagcatgaggcgatatcgtcagagattgtcgaacgtttcccggaggtcatcgatcaatgagtcgctggtcttggtcttgacaacaatgtcgtcgacgtaggcctcgacattgtgtccgagcttgtcattgagtgccccttgaaccatgtgctggaaagtgtttcctgcggttatcagtccaaacggcatcttgacatagcagaatacaccgaaaggcgtgatgaatgatgtcttctcctcgtcctcttttgccatgctgatctggtggtagccggagtaagcgtcaagaaatcttaacaactcacaaccggttgttgagtccaccaattggtctattcgagggagagggaagtgatccttgggacacgccttgttgagatcggtgaagtcgacacacatcctccacttcccgttggccatacgcaccatgactggttttgctagccactctggatggagaacttctttgatggaaccaactttgagaagcttgtcgagctcttctcgtatggcttgcttttgatctggtgcaaatctccgcagtttttgttttactggcttggcatcgtgtcgcaccatgagtttatgctcgatcacctccctggggactcccagcatgtcggacggctgccaagcgaacacgtctgcattgtcgcggaggaaggtgatgagcgcgagttcctatttctcatccagtgacgccccgatcttgacagtcttgtcggggtaggcactggagagcggaatgatcttgattgcgccatctggctttggcgtcttgttggttttgctcactttcttgagcagctcagctgtggcggatgggttgggagtgtgctcgaccatgtcgaggctctgcttgtcgcactgcactgccagcttcgcgtttccctgaatagtgattgttcccttcggcccaggcatcttgagcacttgatacgcatagtgagaagcagctatgaacttcgcgagtgcagtcctcccgatgatggcgttatatgctgtgtcaaactcagcgacatcaaagatgtttgcttggccaaaagtcactggtagcgtgatcatgcccaatggcttggatgatgactgaggagtaatccaatggaagggttgatcagtgggcgtcaactcgcttcgtgggatccccatcgcgtccaaggtactggcgaagagtaagttgatgaagctgccgccgtcgatgaaaacccgtgcgaccttgatattccgaataatgggcttgaccatgatcggatatcgccctggagcgactacagtcttggggtggtctgcctctgagaactcgatcttctgctctgaccacttcatcttggacgcagccccctgccatgtcgaacaaactttgcgctccactttcttgtactctcgctttgaggagtacgccgtggaacctctgaagatatgcgaaacatggaggtcgaagtctgggtacgctgagtctgagtcctgagtagccgcttctgcggccttctcgactacacgtactcgcttgcccttctccaacgccaattgcttcgtgagtgcctttttgaagacgaaacaagtctccagagagtgcttgtccaatttgtgtatagggtaccatattttcttcgtgtcgtcgccttgtgggtatgggtacttgggtgggtcaacaggttctgctgttaggacctccgtttgagctttccgtttcccactcctgcgactgtttttcttgcttgactcaggtgcgtccttggctgatttcttctctcctcctgtctttgccttgtcgttcttgcgtctcagtgcgtcgtccgcgtgagcgcatcgatcgacaatctcgaatagtttgtgagcagttgtgatctgtcttgtcgccaattcctgggttgtgtagcgatctcggacaccagacttgaaagcgcggattacagaagcatcggtgatttcgaggatcgtatttctgcactcattaaagcgccaaaaatagtccctcaatgattcgcccgaattctgcatcaacgcgtgtaggtcatccttaatcgcgtggcgcttgtatgttccttggaagttagcgacaaactgttgccacagatctgcccacgaggaaattgagtagggtgggaggtgaaccagccatgaatgtgcagatcccttcaacgctgccggtaaataactcgccaatgcgttgtcgtctgctccggcagcatagagtactgtggagtagacctgaagaaactcttcagggtcggtgcttccgtcatatttctctattgctcccagttgaaacttctcaggccatcgaacatcccgcagagcaggagtgaaagccctacacccgccgccaggggcagtaggttgccggcgatcatacgctcgtcgtggattgtcacgtcccaaaacgaccctaaaatatatcctctaaattatgcctaaaataattaaaatccgtgtgaaatcctccaacaattaaaagtcaaataaggcttagaggatttttgtatatttcctaaaagcctaaaatgcgtaaataaattttagtggaattttcagagcacaaataataattgttaagaaataaacaaagttaaaatgattttataaaaagaaaaaccctaaaagtcccccttccctcccttgggccggcccggcccatctctcatccccctccccctccctctcctctccccacggcccatccggcctctccccgcgcgcgcgccgctgacgggcgggcccgcccgccaccctcgctgacgggtggggcccacccgtcatccccttcctcccgccgctcccgccggctcgcccgcgccctagcgccgccgccgccgcgaatcccgtcgcctcccgccgtccccgcgtgcaatcaataggggggaattattccccgggatcccctccacctttccccccttttttccctccctctctccctcggattcctttggaaacctctcccctaacctcgccggcgccattaatggcggccgggtctcccgcgcccatttccccctcctctggccgccctctctcactcccaaccctatataaaccctcctcgagctccccactaccgtttccgccactcaccgccctctctccccgccggaattgagctcgcgccgtcgctctctctctcctccgtcgccgccgagctccggtccgccgccgtcgtcacaccggaccacctcccacctcggcgccgcctccttcggcttcgccgcatcttggccgacctcgtccaccactccgtttcggtcgccgacctccggagcaccgtcgaccccgtccacccggtcgccgtttccgtcgtcgccgtcgacccggagtgagccgtggaccgccgcttcgtttccccctttccctcccctctctcggccgccgctccgccgtgcctatggccgccgccggtgaccataggggcgcgggcgtgccgcctcccgccggccgcaccgacgtggccgcctccgggcgcgcctagcggctgccgcgtggggcccggccgtcagccgcccgcgccttcgggtgcggctgacgcgtggggcccacggcgccggccggtgtgagccgggtgcacccggtccaccgtggaccgtggggctgccgcatgggccccactcccgtggacccggtccgcgcgcccctcccctcggctgacgcaataaaccctttttaaaattaaaaatttaaatgaagaaattcgcaaatattcatttaaagagcatataaacttcaaatggccataacttggcaatttgaactcggaattggatcgttcatgtctctaatttttccttaagaagtcaagaacctatttttgtgctttgtttcagcttgttatatggagtttattagagtaaaagccttttcttttccattggtcgtgtagacgctgcagcttcggacgatccgctcttcgtggaagttgaagccgatgtttgggaaagcgagcaaggcaagtcacataatccttgaacatattgaatcccagtttataaaattattttgatttaaattattgcactatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatggttttaggctgggctcggggtgcatggttttgacagtagcacctcggccatataaggaccggtctttgggcctctgttgcaaagcactactgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaagggctcagtcctgcctacctgtcccgggggttctggccgtaggtggggttgggtcggtactcttgtctatggctaggatgggttggaaactatgtcacatcttccgtccgtataccgtggtggtatgtggcacgtggctacacgtgaggaagatgtatcttgtgggtaaagatgtacacctctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctaggatcgcgtttacaaaatagctttgagcaactaaatgtctttaaatgctgtttactgcaaaccctaaccctttatattataactcccttgtactcccttgcatttattctgcacttgtgggtgtgtcttgttgagtacggtggttgtactcagtcttgctcaatttttctcaagcccagaagaggagttcctggaagatgaaggctttggtgtctagctcgtgcctgccgtcaagcgcctgtggtcgtcgccctagtcttccgctgtttttcgtttgtctttgtgtgtgctgggtcttcgccgcccatgtaataaattaattaattacgcttccgcttgttaaactctgaattgtatcaactttggtctaccttgcctcctgggacaaggaataatgcacccacgtaaggaacgcccattgggttatttccggtcgtggcataattcttaaataaaataaaacatgcaaatgctatgtttagttcaccgattgaaatcgcaagactacaaccaagtttgatcaccgattcacaagatatgcaaagcaaacgcttatttagatgcttagcttcgacttgggcttttgcaaggcccaacgagatggataatcacaacggaacacgaatagatcacgtcgcttacgtcgcatacgccgtggtcgtatgacagtcagacatcgtagtcgtgtgtgtagcattttccaaaaaaatattcactggctataacaatgaaggcgcgccaattttctagtgtgttccgaatcggacgtggtgtttgtgtaaagggaaggagacaaattcgagtctgcccatgcgaacgtgtgggcggcagcaataaaaaggaaactcactgtggagattatgggtacctccacccatacccacatggcatggttatccgactagttatagaggatagtttatatctatgaaatatgtaacatatcatgacttgtatattatggaatggcctaaagtattggttaaggtttctatcttgtaatcttgccccccatcctatataaggtgggcaggaggccctctagggggcatatgagcacacatgatcgtcagatctatactacacccggtggattcaaatcctcaaaaaggagtagggtattacctctcattgagagggactgaacctgtctaaatccttgtctccgcatccatccacttttaggtctcgtgcgctacccccttttattattaccgaattcatgtttcgacagttggcgcgccaggtaggggatgcgctgagttttctgtcgacgagtgtgatggaaccaatcttcaaatcgctgggttggtcgttccaatctattgctgttagattaattttttgcatcagattgatccgttttattgtcttttggcgtgcatatactggtgcctgatgcttttgtcgatccaatgaatgacactatcatctacaatcttcacgcacgattctgcgcctgtgtgatctcgcgtcggcctcgtgcatgtgtagatgcatcttgtgttcatgcatgcctgggattgatcagcagagaagcgggcatgcgtgcattgctatatgcatctaatcttcatgctacgtgctaattagattgattttggattatagattattaatcctaattttgctggttatttttgcctgcatgtctacgctggttgacgaggactgatgatcatgatcactgtcgcatcaccttgccgatcgcaggaaccgctgcgagccgctgtacgtcaagaagccgtccacgcagaggacgcgcgagaccaccggccgacagccgccgcacacgacctcgcgcgatttcgcgtggtctggcatgatcaggccgtccgtcttggttgcatgcaatgcaaggcattcagctaacgattggtctacatgcatgacatgaccagtgataatctgggagcaagcaaacactccaagcattctttgactttgcatctacgtatatacatatgtatttaattcattgatgctgctgaaattgtttccccttttttgtttgcacatatactcggggaacggcgccgcatgcccgggggttcatcctttgcgtggctgacgcggcccgactacacccgtggcgcatgagtccggggcatcccgccgcatgctcggggggtctcaccaaccggccgcctcgctgccgccgactggtgtctccacctgcacggctggcctattatgctgccgttgttgggcgtctacgccttcaccgaccggccgcctcgtccgccgccgactggtgttctcgcctacacggtttgatggtcacaccactgttgttgggcatctacatcttcaccgctggcctgtctccgtcgctgccgactggtgtcctcgcctatatggttggttggacacaccaccattcatgggcgttcacgtcttcaccaaccggcttgccttcaccgccgccgactagtgtctccgcctatacggctgcctccgttgctgccgactggtgtctccgcctgcacggttggtcggtcacaccatcgaagttgggcatctacactttcaccgccggccgctgtcatcactgccgtttggtttcttcgcctccatggttggtgttctccgccgccattgctgttggcgaccatgtcttcactaccggctatagtcatcgctgccgactggtgttttcgtcaccattgatggacgattttgtttccacatcggtcacctttatcgtcaccgaggaaaatatcaaaaagctaagtcatcactaattttctttttttatatgatattttccttttcctctgcctcactacgtcaactggttcgccgttgcctagtgagtcggggggctacagatgttatatcatattttttcaacaaatttcataatatttatcttgattgctcgcgacataatctgagtacaaaagtgcctatcgagttatggagttccatcttcctatgctttccgtttggtttgctaatggatagttgcctttgggccgattcctagcacccgggtgctcgttggatggaccgaataatacaaggtgctaagtattattcggataaatcaaaagcatagagataagataatttattttatgctcttaataattgcaaaagtaccagagtagtaaactccgatctgtgaaactttgttccattaatgacgaactcatgtcacttgtatgcatgtttgggaagtgcctatgctgactcccggtgcgcgggggctatgattagtcaggtagagtgtttaaacgtaaggagtcatctgctcggggaaatcaaaattgacaagaggagaatacatatttataaacattttaaaatacttgaattttccttgagtattatatttacatcaggtactactcatcctatatgtttgttctgcaagattcagatccggatatgcataatagggattcatggctttaagcttatctcctacgcttcaggaatagatcagtcagaacaccatcaccggctcaccgtcgtcgccgccgactggtgtcttcgcctatacggttggatggtcacatcaccgttgttgggcgtctatgtcttcacagccgacttgccttcgccgccgccaactggtgctctcgcctatacggatggatggtcacaccaccgttgttgggcgtctacgctttcaccgccggcttgccttcaccgccaccgactggtgtctccgcctgcacggttggcctattatgccgccgttgttgggcctctacgtcttcaccgccggctgccttcgccgttgccgactggtatctccgcctgcatggctggcctattatgccgccgttggtgggtgtctacgtcttgacagccggctaccttcgccaccgccgactggtatctccgcctgcatggctggcctattatgctgctgttgatgggcgtctacgacttcaccaccggcctgcctccgtcgccgccgactggtgtcctcgcctatacggttggttggtcacaccactgttcatgggcattcacgtcttcaccgaccggcttgccttcaccgccgccgactggtgtctccgcctacacggctggcctattatgccgccgtttttgggcatccacgtcttcaccgatcggccgccacgtctgtcgccgactggtgtctccgcctgcacggctggcctattataccgctgttgttgggcgtctacgtcttcaccgaccggccacctcgtatgacgccaattgatgatatagtcttcatggctggccacgtcgccgtcaccgctaataggcgtcatcatcttcaactcaagctatctacgtttgttgccgactggtttcttcacttccatggccgcatgattctactagtgttgattggccttatcgtcttcatcgccggtcgtctcgtctggtgctgactagtgccctcaccactacggctattttatactgcaaccactactgatggatgtcatcatcttcattgctggccgccttgtttgacaccaactggttttttctggagctgaccggagtatctatcttcacaactacatgtctttgccaccggttcgtttctgtcgccgccgactcgtgttcacttcatcacggctatgcaactttgtcaccatggtggagctacttcatcttcattgtcttcggcaccgacaaactttattgctgctacttcgcaagttttgctactttaccagccatgacgtctacaggagcttcgacatctcagaatatgatgccgtaatattttactacaacaagtggtgttccaatattcaagatttatacctggacatcctcaatacatatattcactcaagtgatggctactcgacgatgagaagctacagttctcgactctatgatcaattgctttccaattaaccaaagagtcgggggctacacaaatacaagactcaaaatttgacaagttttttttttgtcaagatgaagcaatcaatcaatcaacgagtcaactttgggagttattatctccgtctgcgcttcagagccggcattttacttcagcgactccaattattacatcggcaggtcaagattaaatttacatgtctgggagtttggagtcatcaaccaatcaactcagatcagattcaatgagttgaacaacagcatatactttcctctaagtgaaccatctgcaagagctatagcaccaagttctactgccatcttcataaatcaagaggcgttgcatcaatcttcgtcgcacacatgccaacattaagaaaatacttgagcatggatttcttctcaacagtttgatggattgttgttactgacatcatcacctgcacatctacttcaacggccctgatgtctccgccattgctaagggatgactacgtcctcaccgtcggttgcttttgtcatcaccgactttcatcactgacttgttatttcgtcttcacgattggcctactacgcaactgccaatagaggatctcatcgttatcatcggctgctacaccgctattgactggatcaccaacatcatcatcttcatcaacatcctgtcaaacctcttcaacatagcccactctactgctattgatgggcaacttcgtcaacatatttgatcatatctattgctgccaatcgtcattaccatcggttgcatttgtcgtcgtcgactatttcatgcattttcatgattggaggatttcgctatcgttgttgatctgtctcgtctgtctccgactgattatttcgtcaccatggctacaaaactctgtcgctattgctgggtgccttcatcttcactgctagttgatctgactgttgccaactgatttctttgcttccatgccgattgcatcaactatcaccgatggacaatttgaactactccaaaaggataagctatatgcttaggggcttatgagctcaagcacaaggatcataccttcaagttggattttgttctagatacaggcaacatgcactcgtagtcctgaaattattttctatgctcgaagactggaccaatcattattccccgtaagggctatcaaccgaatacttgcgccagtcgggattcaatttttatatctatttttgagtatcccataagggataatcactcagatcagaagctattcatatgagctacacttggtctatatcacccggaagatttattactcgggagcatgttacatgcgtcatcctttaaagggtgtcgaaggcctaggcctaatatgtctgcagcccatatgttcaggtgtggcctatcacgttcttttaaggacttagacactttttgattaggccaaagtgcgcgtgatcaagtgcccaataccttaaaatcattttataccgcagttactcaactttttaggagttggtacaatgcattttaaaaggtgcccaacagtgaagtttttcatagctgtcccgctgacttttttatatagtcaaggcgctgtttgggtttatcaagcaattgattggatacaatatcgttactttttgccacgtaagtgtgcatttttattgaccaatattatggcttaggctgattatatattttggtcattttctaggcggttggtaaatcctttatgagtttatttactcggattttataccacatatgccatatattttcaggtgtggtgaaaccatgtgtcttttagggactcaagcacatttgttaaatcagtgtgtgcatggtgtatgcccaatactttggaaatttctttattcacaacattcaagcttctttttagctattttgctatgtgaattttcaatgatgtagtcaactttaggttgcaagcatcatattttacaaaacaatcggtatatcactcggatcatattattcagggattcacaccacatatgctatgtattgatatcaagtcacttgg

SEQ ID NO: 73240 - DNA, 8592 bp, Oryza sativa
tgctttgcgacatcaaattttaatccatcgataatcatccatgtgcacacacgatgtgaacctaactcaaaacatataacttgatagaatggttagtccacaatttgcgcttgtcattaattaccaaaactaactacgggggcctagatgctttagaggcccacctcgactgacccgtagcatatatgcccatataatgatacttaataatctagacaccacatatacattattaaatactactctacatcccccgagatgacatagagtaaccgagtaatcgaacattaaactcacaccactgcatctctctggtaggttaactatacgactgtatcgatgtagatataaagtaaagacgttactcagatatactaaagtatcaaaagtatattaagaatagtatttcattaattccaaaagtcttacaaaagaaagaaggaaaactactaaagccataccgaaattcctccgaagactccgaggactacgagagctattctattctaatccacttaacactagaatacaaaactaaagtgtagaagagatatcttgagcttgtttgagtgtgtgaagtagtggaggtggtgagggccttttatagctgaagaatgatggttgtggcagttggaaaggttggtaataccctccaaccgccattgggagtgaattcccaccgtctgatcaaatgcctggatcgaatggcgctgggactggttcggccgaaccctgggctaggccaaccagcccagtactcggcggccgtctcctcttccgcttctagacttagaattgtgaattatgggactttttgatcgtgtcaattttgagtttttggcccatttgtccataagtctgatagacagtgtctaattgattgtttgagtgttttgctgtcggttctcctccatattgtatctctttatctacagacagatagacttcaagtacaagtggaaataagttattctaaaacaaatatgcattgcaagcatagctagttctcctttattttagttatattgacggtcgaaattggtccatcaagagtagtttaatacgatctctttgtacttagtttcttttagaaaatcaacacaataactatggtagtttgccaaattgtcatcaaattttgatcaactacgaattactttgtaccgttcaattgtttctcccttttttaaaatgacagctcatcatggaggttcaaaaggaataggatacaagaaacttaggtaagtttgttgtttcatgtgcaagcaccgaaattgtgtaagtttgtggcagtgggaatgtgtgaatgtctatgaaattcttgtgagaacttggaatgcatgtgtgtgatgttatttttgaatgatgtgctaagattagaaacatgtattattgcgggattctgtgatggttctgttttttcagagggcgtggctagcaaatcctgaggctagccaatattttgaaattaatttattttcaaaattagctcatcactgacgggtcgtaagcaaaggccgtcacagttggcatcagctgtgatggctagctaaatcaatccgtcaaaggtgagtcacttgtgatgggcttcaatgcagatacatacatgtgatcatctgtgacgggccatcaacttcggacccgtcaaagatgtgtcacctgtgacgggttgcaaccatgagtgacttgaggggggccctcgcctgtgacggcccagaaagtgcaggaccatcagaggtgatgctcatttctgacggtctgccacccgtcaaaggtgattggagtcaccagcgatctttattcagtgaccaaggccataaccgtcaaatgtcaccgtcacatgtagggtgatctggtgtagtgagaatcatctctattttttataataggtaaagatttcacgaggatttcatgtatatgaaataacttttaggctgactgtatcttacttaccaggcctgtcataagaaaaaaaaaatctttacaacggggacaattacaatggtgatactggaagttgtaatatgaaactcttccgagaaagaattcggttcaaaagtactctttggagaaagaagagtaaaaaatctaattaaaggcacaataaataagcccaggaattgaaatcttgagccacatacctaattttctactcatcatatatgatactcgtaaccctgctgtactcatcgtcagatttcatctgtcgtcgtggtagtagtagtcatcgtattccatattttttttggcgtaatagtcgtcgtattcgtcattgtcggaatagcccggcttgttgtccattgggctccggtggcagctcatgcagcggaaagatttggagattgccgcgccgcaatactggcattttcccctggtcggtgatggtcgcttcactaccggtggcggcggcagaatcgtcggccgctgttgttttgccggagcaggccgacgcatctggacgacctgaggtcgcttcggtgcgctcggttgcggctttggcggaggacctggtggttgttgcctctgcgtcgtcttcggtggcggttcaggaggcctcttggccgccggtggcgtcgccggcgcggcggctgtaggcttggtacgaaacaggtcttctgcccgcatcggaagcgtacacaccgaggcggcggcggcggtggcccccggcgggggatgcctggtcgacagcacgtcccaggctgtctggacgagcttgaacgcaccgtcggcggcggcggaggtgttcttgtcggggtgcaccaggaggcacagcttccggtactgcttcttgacggcgtcgtggtgggtgaccaggtcggagcgcggctggggcaggccgagcatggcgtaccagtcgggcccgcagccggcgaccccgatggccttgagcgccgcggcggagtgcacgttgtaggcggccgcggcctgcgcgacgccggggaggtccgggtccagcttcagcgcgttctgacaccatcgcttcgctccagctacgtcgccagcgaggaagcacctctcggcgaggtttttggcctgcagggcacgatcttgcttggacgacgacgacgacccagccatgactggcaatcgatgatgtctgtgccgcccacctttcccagtttccaccaatatataagagcaagtttaatagtagagctcactacttactattagtcaatgttaaagctaacatgtatagtaggttggctataagtttatctttattttcttcatcctctctctttctctcaccatgaatttaatgcatatttcttggagtttgtgtgcagttagctcttgcatgagagccaacactccccacttttgtttatctctctcttccacataagcatatagcttgcttatagcccactattatccttgctctaatggcacgggtagagaatcataaaagtatccgacacggaggtgaatcagaggcagaatcgtatccgattccgatacgcgtcgggccagattagagtaggtataggctataagcaagctataaatatattttaaagagataaaagtaaaagagagaaaagcagcggggctacaaatatatagccagctgcagcatggacaataagacgtaatgtgtgtatgactggtgggaccaggtattaatagtatagtaagcaactattgtatgaattagccattacattggttatagatgatttggagcaagtttagtagtataggcaactactagctccaaatcatctatagttaatttaatagccattatttagaaacatatcactactggaaaaaccatctttggtcagtcaaccaaatttcacaatagtaccggttgtattgaaaagctcaagggtacttttcatttttagtcgcggtttaaaagaggacaggcggtgtcagacccctatattttctttagtcccggttggtgttaccaaccggtactaaagatcaatttgtagtgccagttgataacaccaaccggaataaaagatcggcatgcgcggagatcgaggcatgggagcagatcggatcgaggatcttccttccagttctatctcctcctctccttttaagtcctctcctcctctccttactcaccctatctcttcctctcctcctccccctcccccctcctctccacttctcgatctgcacgaggcggcggcgtggccggctagcagagggctggtggagggccgggcgacggcctacttgcggcgtggctgcgttgcaggtggcggccggcgcggcggcgtgccggcggccggcgagggggctaccaatcggaagtaaaaaccacttctccaccagtgtatactacactattaatatatggtcccacctgtcatacgcacattgcgtcttggcgtccgtgctgcagctggcaaatctgtagcccactgctcttctttctcttctcttatctcgtaaaaatatgtttatagctagcttatagtatgctattgtacctgctagagtcacttcaacttctagcgaacacttccaaatatacaaggacagcaggtgaatgactctgaatatggttatttcttagcaattctatgtttcctttgagtggtttcgaatagatttaaattttaaagcttttaactcaaacttttttaaaacataactccctaaaactctacccaaattggaaacatgcatcgatttcaatattctttgaaactttctaactcgattctaatttgtgtagctttcaacttaaaattttaaactttcaactcatatttaaaaacttttaaatcatctctttttattattttatttaaaatataaaactttcaacttaaattatgaaactgttctactcagttttttgaatctttcaacttatattttacaacttttaactcaattatgtatttattattatactagcaattataaccgtgcattgcagtggggagaaaaatcgagaaagttagagagtattgttggcagaaagctgagtaaaataggttgatacagtataagttatcaaaggctagtcctttaaaaaagaagatgcatgtctttagcatgataccgacaatgctaacaatgtagggataatgcaaactagtatttttacttacatttcaatggcttaaaaataccatgtagtggtaagtgattgaaattaccccgagtcttttcacaaactaacggacttgaacgttgggcctcgccatatgagagctcttttacatgctaaggcattaacagaatgattgaaatgtttatttattgggaaaaaaatattgaaatgttactacaggtgaaaagatcacttcactaattaatatggaattaacacaggagaagagggctaaaaagatcattgctggctacatgtgtatgggaaataaaaagagatatatcagtacacattaaatcatacagaagattgtcaaaggcctgggcgtttttggggttgcgcgtccaaacccagccgcttcgcccttgtggccgtgccgccgagccgagaggaacaccgacgagaggacgagcgcgtgaaaacgtcacactcaacacccacgcacacgtcttgtagagattatgggtaatgtttacaccctattttgacacttgggattaaaatagggttagtttgatctacgccattataaatatgtcaaattaaaaaaatactattactattcgcgatatcggctgaatgccactgaaattttctaaaattcgatccatgctactgccgtttacttttccatcatcgccgtcacatcctcctcgtcgcacagctctggatcacgccaccattccgaaattgctctaggccaatcagcacactttgtcttgccctcatagaccaacactagtcttttctgcacagctcgtgtgtactggggaaaaattgctctaggcaaacacgcttaacctcagagttctttggagatcggattccggaaaataagttgcaacttattggtatgagtattctattaatcatattaagcccaaggccggaatgtcacaggtgtggtcgcgctctgcgccgccaacatcgtgactggagagcatgtagtggttggcgctggcggatcggttccagaaggggtggtgagcgacgacgacgcggacataaggatggtcctgggagagtgggcagtacacgaaggaaacactgaacgacaagaagaaggtatgggcgtgtgtagggtcgcacgtgcggacgccactctagcggtgacggcggcgccatgaggtcgagttgttcgtcgatgaagcggccttcgatggtgtacatgtttggacggacactcatgcaggatcggtggctcgacttcgtcgtacatgtacaccttgaaccgcttattcatctccaggtaactcatgcatccatggtgcacgctcgtgatcgataaaaacgacaccggccccaccgccgtggacggatgctaagctaatcataccagtagaacgccgccgggttgcggtagacatgcgaaaggagcgcatagtccggctcgcgtagaacgccagccagttggcggagcggacgtcttcaccctcacctccgcatccgcggcggtgatgttgccatgcagcacgtcgtatcgcggcgcgtgccacgttgagctcctcctccacggtcggctagaagagagaacaacacaaagctatatcttagaacaaaccgctggtccatggacgacatcaaggctatcgggtccgcccgagctcgacatcaccggccgcaagctcttctactccgaccactccatgaatcatagcgtaagcaagcaactcaagattattaacagcactctctagcagcaattagttcttgaatctcgatgagctagttattcagtagtttcctgagacaaaatggatgctttggtgacacgacgcaggtatcatatcctccgagatagaggtgcgtcgagtttcgacgagtgcgatgaagccaatctccgacatcgccgtatttgaggatgttcttttcgtctcggattcaatccagccgaagggattagtcccggcgatttcattgatttaatcttcaaaatcatttggctttgccgtttcagtagttagattgttttataactgcagattaattttctgttactctcttgtttttgtatgccgactgagaacaagatcaatggctgccatctcggtgtgtctgcccaacacctcgtgttcccccatgcaccatgtacagatgccggtgtaatccgacacgggagtaacgtggaaccacaggcagtgctcacagctcacacacgatcgagatcgccagctaccatgagtcatccacatgcatgtattgaccaatcgacatcatccaggacacctcgccggaatcatgcaccaattaattcattaagcatgcttttatgttccaaacatatatacacgagcttatataaataattttgcttatggtactaaacagattgatctgttaattgttctattttgaagtatccggaccggttgattctgctgccgccgactggtatcctcgcctatacggttggttggtcacaccacctttcatgggcatccacatccccaccgaccggcctgcctccgtcgccactgactggtgtctctgcctacacggctggcctattatgccgcctttgttgggcgtctacgacttcaccgccggcttgccttcgctgccgccgactggtgtcctcacctacacggttggttggtcgcaccaccgttcatgggtgtccacgtcttcaccgattggcttgcctttgccgccgccgactagtgtgttcgcctccacggttggtggtcacaccaccattgatgggcatttatttatcaacaccgccggtcgcctcagctgcttacacggttagtgttttcatcatcattgatggactacttcgttcccacatcggctatttctgttgtcaccgagggaatatgaaaaagctaagtcatcattaattttctttatatgatattttctctttcctctgcctcactacatcaactagttcgccgttgactagtgagtcgggggctacagatgctatatcatatttttttaataattttcataatatttatcttgattgcttgcgatataatccgagtacaaaggtgcctatcgagttatggagctctatatccctatgctttccgcttggttgtcgatggatagttgcctttgggccgattcctagcacccgggggctcgttggatggagtgtataacacaaggtgctaagtattactcggaagaaatcaaaagcatagagataagataatttattttctgctcttaacaattacaaaagtataatttattttctgttctcaacaattgcaaaagtacccgagtagtaaactctgatacgtgaaactttgttccattaatgacgaactcatgccactcgtatgcatgtttgggaagtgcctaggccgactcctagtgcttgggggctatgactagtcgggcagagtgtttaaacgtaaggagtcatccgctcggggaaatcaaaattgacaagaggagaaatacatatttataaacattttaaaatagttgaattttcctcgagtattatatttacatcagatactactcatcctatatgtttg

SEQ ID NO: 73241 - DNA, 1959 bp, Oryza sativa
tacccacatggcatcgttatccaacctagttataggggatagcttatatctatgaaatatgtaccagattatgacttgagtattacgttcccttgtatattatggaacggcctaaagtcctggtttgataatattgtaaagtagatttaggaaatcgataccgtattggttaaggtttctatcttgtaatcttgccccgcatcctatataaggtaggcaggaggccctctagggggcatatgagcacacatgatcgtcagatctatactacacccgccagattcaaatccccaaacaggagtagggtattacctctcattgtgagggcctgaatctgtctaaatccttgtctctgcatccatccacttttaggtctcgtgcgctacccccttttattattgccgaattcatgtttcgacactcatgcagctcaagtcgttcttgtttttgggaaagctcgattcgatatctccgcggggcgcgccgatgtgtttgattcgaaacgccgccgagtagtttcgtgagatagatctgctggcggccatggcagctgatcctccatgtaaggaggtggagcaggcggtgacgccatgggaggtgtccgctccggggggagggcggcaccatcgactacgaaaaaatggtggaccgcttcggctgcaaccgcctcgacgccgcgctcatcgactgcatcgctcacctcacctcccgcctgccgcatcgcttcctccgccgcgggatcttcttcgctcaccggtgttcttctgcagctaaattggaggagttggcgactgaattgcagatggtttttgtttgttggatagggatttgaggaggatactggacctgtacgaggcgggggagaaattttacctctacacagggagggtgttagtgatatgccctagaggcaatcatagagataattgtatcacacactctgtttacatacttatccgactttgttccttgaaatagataaactcattattggttaatgaatatgtgattctttcatgagactctttatgttgtgtgttgctatttctaaaggatccctgatcaaatatcatatgtggaacaaatatgtttagatgatcagcacatgtattaattgatgatcatgtctcatggatcatggtatagagataccaaattaataatgtggacacatgttagtgaacatgttgttggatagatccaacatgagacactgcaagagccatatgtgttgtgtcatcaatgatctcatttagtgttggtgttgaatccttagacttgagattatcatggttcccaacatgtgaagcagcttacttagggactgctaaacgctacgccgtaattgggtagttataaaagtactttttgggtatgctatgaaacatgtagtgggatatgaataatcaagatgggatttgcccctcctatggagagatatctctgggcccgtcgatgttgtagattatggaagtgcatggccatgtcaaaggtgattgaggagtcaatcacaagttatataatctgtcaacaggtcgagtgaatgattgagctattagaggatggcacatatctagccttgagcttaatcgatatcgtgagtcaaatggttcatacaagtatacactacaggttcagccgatttgatctttatgtatgcctggtgggtcaatacgttctgctaggggccgctgttgacacgtggaccgaaaaggagttttcgggttacagctgaatatacatgaacctacagggtcgcacgcttaatgggctggaataaggggattggatggagatccaatatgagcttaattcggataggcatccgaataggagtcctacgggccttggaggctcgagtgatggatcctatatattcgtgaagggtgtgactggcggaggcattgcatcacgtgagaaaccctagccgtcactgtcacgtcctgataaattcatccc

SEQ ID NO: 73242 - DNA, 10782 bp, Oryza sativa
agccccagagggcggcaaggggctaaatgcaatttttgcagacggcggcagacagcgtcgtcgagccttcatttgccacgttagcttgccgcccaccactagggcggcagggtctatttttgtaattttttgcgccgatagattatttctgtaaatattaaaagaaaaaaatttaaaaatgaaaaaaaaatcgcctccctcctctccttcgagcccctctgcacgcgcggcgcatgtgcacgccttgcgcctgaccggtgggtcgacccacccggtcgtcttcaacctccagccggccgctcctctctgtccctctcccgaacggaaaaaaattctatgcggcagcgtcgcaccaagcttctcgtgcggcactgcgtgaactggcgacgcgtgtccaactgcctcccgcgtgaggcgcgtctatcgcgatttttagtggagccgagccgacgcctatcactatggtggagccgagccgagccgtcgctctcatctgctatggcgacagcggcggcggctgctgctgctgcttctgaaacggcggcggcgcgcttgagtccccctacagcgggcgacggcgcatcggcgcaaggccacgaggcgcgagcggcatggccttgctttcctttcaataattcatttagctgcacttggcctgaataatttcatttttttataaggtctcttttgatgcaaacgttgatgataatatgcatagagatttttcgaacatggctgctcctcctatccatggagactatacaagtcttttgtttcgacttgatcaagatgccttgacttttctgctgctgctccctgcagacctgcttgctcctgcggtgctgctgctgctcggctgctcctgctctcgcgcagcgcggtcccgcgcgcgccgccgccagcctgctgcattgctactcctgctcacgtgctcccgcggctccacgctgccgccggcctgctgctcgcggttcgcgcggccgctctgatgctcggctgcccgcctgcctgtcggagtgtcggttgccgccatgcagccatgccgctcacgcctcgcggccttgcactgacgcgccgtcgcccgctgtaggggggactcaagtgtgccaccgccgtttcagaaacaacagcagttgccgccgtcgtcgctatagcagatgagagcgacggttcgacttcaaggtgtgggcctgcggcttggactcgttgtgataggcgtcggctcggctccaccaaaaatcacgatagacgtggctcgcacgggaggcagctggacacgcgtcgccaattcgcgcagtgccgcacgagaagtttggtgcggcgctaccgcatagaattgttttccctcccgaaccctagcgctgccatccttcgatcccgctccactgcgcaagttccggccaaataaattgcaaaaacggaatccccatcccttcctcattatttcccccaacttttcccctttaatcccgcccccaatcaccaggatttaatccctcttctttgaccgccattgatgccgccggccacgctctccggcatcgttcccgtcccctccagtggtcggcactcccctccattgcctataaaacggagccctagtccacctctccttctgttttcccccttcccgacctccctagccacaccgtcgccgacctcctctctctcctacgccgccggccaaatccagctacccctgccgccgcgtcagcacgccggccagccgtgccgtcgcctcccccggcatcgtagtcgcctccccttccccggcctgctctccgtttcccgcgaacacctccggaagtgcatccccgccggcaacagtggcgttgccgccactgttccgcctccggccgcctctgccgcgtctcctgtgcgctggccgacgtcgccaccacctctcccggaaccagaacgccgtcatcttccccgtccaggcgtcgcccgtatttcgccggaacaccgccgtgccgcgccggcctctccatccgccttgccggaatttccccggtcggcccttcctcctcccatgcgctgtcggccacgccaccaccaccttcagcatcgcagcggcgaaccggcgacgtcgtcctcggcatcgcctcccctccatccgaaccccaccgccggtgtccgtcatcgtcttcactgttcatcctcgccggcttgtcgtcccgcggtgctgcctccatcgtcgtcatcacagcggtgtgttccgcgccgtcctcgcatccgtgcagctgctgccggctgccctcgtcgcctcctcgccggttctggttgtcgtcctcccgtcgttctcgatcgtcgtggcgttcgtccctccgtcaagccgcgttcgttcgtcgcccgcgtttcgtcaagtctgctgcagcctcgtcgttgtcttcgtcctcggctccacatcgtcaagccctgagttggcctcgtcctgccttcgtccaaggatcgccggagaagtgtcgtccgttcgtctccgtcgttcctgtccatctctgccgcgccgtttgtcgtcgtcgttcccacgcctcgtcgcgtggtagtaaggatccgtcctctcactgccccgtcctcgtcctttcgttgtctccccatgcccattgtgtgtttgtcgaccccggtacccatgtaccggtgtcggtagtcattcgtgggtgcgtgtggtgaccgtgtttgtgtgtccactcggtagccacgtggtttgcacgtgtgcagcccgcgtggtgtctagtggagtccgtttgtctgccactcgcctcggttggcacacggcgtctgcttccatcgtcccgtggatcgtctctgtgtacttggtctaccgtcgtccattaggttgacatgtggggtccgcatgtcagcagcgcagccttcctgtcttttccaggctagcgcttgcacatgttttataattgcaaaacctaatcataataatccgtaaatctccatataacagcattaaacttcgtatgatcatatctttatcatacgaatcccgaatcgacccgttcaagtctcctaatgtttgttataacctaaagaaccgtgtgctttcttcttatgtattgttattacttctttataggttgtagctttgcttgtttgcttcgtgtagcttctgtcattccggaggtttcggaagcgtgattcgcggtcgtcaccgaaggttcggaaggctgttctctctgagcaaggcaagtctcatcatccttgagcatattgaatcccagtttttaaaattattttaatttaaattattgcattaccattttatttaaattcccgcgttatcactgttttatttagcacttcctattatcacctcgttcaccctaggaaaacaaaaccccaactagtgggtactctattcatggttccactagtatgaacttacgtagatgcttcgctgattaattaggcaacattaggtggttttataactttagactttgggagttctcatgtcatttggacattatggaatggttggcttgtgatggaactgatacacacacctcccctgtcacgcccggaaattcactagtaatttccgaacttatttgtgcataaaaccctcgtccaggaatcagccgaggtacacaaactgacaatttaatatacaaatccatcataataataactttacataattacaaaagaaaagaaaacagcagcggaattacggtctagcgaagctccagctccactcccacaggcagctcaactggggtataaaccatacgtcttctcctttgcaacttgtcttcaactgaggtttgattgattattgcaaggtgagcatatgacatactcagcaagccacacaacaaatatgcaagtgcacaaggataccaaaaggatggcataatatagggctcatttgcaaaagcagcatttagcaaacatttgagagttgtaaaacagtagagtaattaatcatcaatattaatcaacactgaacagcacacccatgctgctcaggcccaaccatcctgaacaaccatacccggctgcacagatctatctccaaaccaggaatgtaccattccaaaccaggagctaaattaattaccatcaattaccacattattattaatgagtagtgtgggactaatcaagaaagacattgttcgacccgcccataaccacgggcacggctattcgaatagttttactctggccagaggtgtaccactgtacccacaagacacaactccacaatatgtcaccatatcatcatgtgcccatgctgaacatgtcaccattagtgtagttgtgacaagacccctcgcataactcaaccaaaagcagtgcaccgttcctggatcgtagtcaccccctcaaaaaccagaggcatggactccccagcgacccttgtgggcttatctccgccacttctcagtctggtgctccgtaatgagccttgttatacaaagtgtccagccgttgcccattctggcttgtggttggcacgggtaatgtttcacaaccgaaactcgtgaaccggtccttaattgtcataagtacgaccatcaaaaccatgtgctcacaacccaccattatcaagttttagttggcacattaattaaccaatcacgattgaccaacgattgaccatcgtgagctatcattaaatatccatcattaagtaatagtgaaacattagttatcccaattgtgtgctaatgtttaacatctagctgaaccaatatataaagctcaactagtcaaattataataacccaaggtatgaaggaatagagtaattaatgcaaattggccatacaaaggaataattcacaccacacggtgacattcgaaaataaatgcacagttgaaataaatagagaatttaattataggatcaacatgctcaaaggaattgtgtttgggatctgtgtgacttgtcttgcaataacatgtcttcaattaatcttcttgaacacttctggcgcactcgcgaaccttcgaaacgacggaaacgacaagctaacacgcaaaacaaagaaaaagactaataaaaaccaaataaacaatacatataaagtaagcaaacatgtaggtcataattttagatgaattatgagacttgaacggcctcattctgacttcatatgaattaattatgaattttacaagatttaatctaattaaagcctatttaaaaaggattaaataaaattaattcaatttatggataatttaatatgtagatgtttattttatacaacttttgcaacttgaaccacattaaaccaagttacaatgattatgaatttataaagattaaactggattaaagcatttatatggattttaattgaattatgacgcaataaagaattatttttgaaaggaaaaagggatttattgcgtcatcaaaggcggtccacggtaaaccgggttcaaagagacggtctacgaaaccaacggccgagatctaatctaagccgaacggacggccgagatcgatccggtccaccacgggctatggatgacgtcagcaatgacatcagcgatgatgtcatcgccggcggcggctcgagaccacgggctcgacggcgaacggcagcgaggcggcgcaaacggaggacaccaacgggtagagctcgactcggcgaactcaccagcggcttggatgatggcaaacgacgacggatgacgacgttggcgaggttgaagcggcggcggtcttcgggtcggcggtgacggcggcgctccgaagggaaatggcagcaacggaggggtggacgaggtgctgctcctcctcgcgatcctgatggtagcaacggcgaccgaaggcggcggctgcaatagcagtgcggcgcggctgcaacagcggccggaggttgaagacgactgacaggtggaccccacctgtccgtggctgagagagaggagggagggcgcggcggattgggccagctgagccggacgcaagcaggccgaggagagggagggagaaacttgggccgactttcggcccaaagccaaaaggggacttttaaaacctttttcaatttaaattattcatgaaatgatattccattgattaaaaatacttccttggctcaaatagatcccagaaaaatctaggaactatagaaacaagagaagtatttaacaaaattttatctagcccacttttatgttgagatttaacaaattaaaattagatcttctcttttaggcttttaagatcatttctaataattccttttaaacaacaatttataatttaaggatttttaaacaagaaaagcacttaacataattataattagatcattaattgattaactaattactgaattgttctttgtattattaaaattagaaattgagctccgaaaaatccgagaaaattccagagagtataattaaccttggagaatttaataaaaattaaatccatccatgctttatatttaggaaattttatttcccacatttaacttcacttgtaaattaatgaacatttaatataaattctattaataatttattaaataaattataaatcctaaaccaaaaaatcaggctgtgacatccccctctattcaaaactcccaaaatggtttgaggctgggctcgaggtgcatggttctgctagtagcacctcggccactgtaaggaccggtcttcgggcctctgttgcaaagcactaccgtactaaccacatgtctaatgggtaaggcttaactcggtgctcagtctagtcctggcaagagtacacggatggagatggacgaagtcagggctcgatcctgcctacctgtctcgggggttccggccataggcggggttgggtcggtgcttttgtcacggctaggatgggtaaaagggttatgccacatcctttatgatgggttccacggccgtggaatgcggagtaaagatgtgtcttgtgggtaaagatgtacacctctgatcagagtataatctattcgaatagccgcaccctcggatatgggcaagcctagcaatgtacccacgttagtggtttaattcttaaaacttgcttaacaactaaaatatggaatggttggcctgggttggcttgggacgagctgggacctgggtctggttgccagttcggtctgaatcatcgtaggccttgggttaaggcatgttcgcgtgggttcacggccttgattaataatattgtgtagctctaggatcgtgtttacaaaatagctttgggcaactatgtgacttttaaatgctgtttactgcagaacctaacccctattattatccccttgtacccccttgcattagtcatgcatctcccggtgtggcttgctgagtactatggttgtactcattcttactctatctttcccctcttcagtaagagaagctttggagaagaagtcctgggtggagtcctggcttataccccagttgagcgcctgtgaagatggagccgtaggcccgctagtccgctgctgcttatttttgtttgtcaggcctgaagtgcctttgtaataatgtaaatattatcgatataataaagatgtgccttttgtatcctgtttgtgtggtgtaccccggcttttcctgggatggggattaatacacttgtgttttggaaaaggtatttttccgggcacgacaagctaatatcagagacatctcgactgtaggataagccaagtggataaaacctaaggacatattttataaacaagactatttgcaaaagttcctttttcctcctttccctaatgctatttgcaaaatgtttactctcttcttcctccttcggattttcaactagtactagatggtcagctttgcgaagaagaagatgtcgctagtggtctgccgaagttctagaaggctgcaggatccactagcgaagcaaaggaagcagtgaagccagatgtgaagcaggagtgaagatcttggagaacccgtcgcagaacctataccaccctttagggttttgttagtcgtgtgtttccttgattgtgtgtgtagcacatggtttgcatcagtggggtgtgatgtaaccatgctaggttgtttgcgtaatcaacctgcagaataagcctaacatatatcataacagaaaaagattagatctgttaaggtcctatccttagtttctgatctctttctttcctccaattttctctttccccctctctaaaccttgtaacagatggctgacaatgagaaaggaagtaaggtcagaaatcagaacaagggtgccccaagctcccgagtgaatgaagcaccagacaccagttgtgtgacagtggtctaacacctgattaactagaacgaattgcttatagagctaccacagcagcatcagatgccaattctagacccgagtcagatgcaacctcaagtgcagttggaggcagtccaatcactcacaccacaagttagcgcaccgccagcatcccaacaagcccatcgtgccatgccacatgtggactcaaaagaagcaagaatcatttgttttatctatgttgaacaagggcactatgcaaggaactgtccttagcagaaaaaaaaagcaccaatgcgaaccgaagatgaggtccgtaagatgaccattaccggcacagaatggcctccaccaggaatgacaaaacgtcaaagaagaaatttcttccgaggtgcaccatagttgacggaacatcttttagctaatggaggtagagtgtctgatagcgaagattcagatcaagtctcctcacgggttgaagatgagaagtctctccaaggtttcaaccagaataaaaaggaacatatggcatgctctcgttgtggagaaatcggtcactttgccagctcatgtgtcaccacttgcgttcattgtgaggaagaccatccacccgacgagtgtccaacaagcaggattacttatttcttgtgcgaatgagctgatcatgtacgaaaagattgtcaattcagttttctgctgatgaagaagatggccaaccaacccgccagttacaacagacagaagcatcaaggcaacccaaatcctcgacaagactacagtttcagcctaactccaatgccaggacagaggaatcaaaatgggaaaagaaaatgccgagtctggaaagatatctgttgtttcaattgtcaagaagtgggtcatttcgccgacaagtgctcgaaaccgagaaacatatttaccaacacgtcagtccatgcaactccgcgcaatcagaagcttgctcctcagcaaattgtcatccatgcatcctgaagcagtcctatagcccaagttgcaatagctcccactccaatgagtgcactaccacaaggtgtcaatgctcaatttcagccccagccaccagttgacaagacagaggccagtatcagtgttgtacctttggatgttccaggacaacagccaagaaatcaagtacaagatgaagaacctgagagtaagaaagttattgtttgttacaactgcaaagaaccagggcattactccagggactgtccctaaccaaggaaaaaaatcggcctccacattttcgccaatttacaagaaacagacatgccaatcgccaagtggtcactggagaaaatgcagtacctgtcaagcctagtgctagtcagaagcaaccataacactcttgtatcgatgttcaagtacttttgttttatagttgttctctaccaaccgtgtaataaggaagaaacgggaaataatcaatgagtttggcaaatgtatgaaggatccatattgagactgcaagtgttgtgagttgtgtacattttgttgatgattaaggagacctagggtcttatttccgtaagctcataatctgttatgaatcaaataacctagcgattgatggcgaagaaaatcaagtgatcaaccaaagagacatttgtttggactaagagtttccgatgtgtcctttttcggatcaaaggcaacgacagtcagtatagcttttgacgaactacttcaaggtttctctgaaaggcagcaggcccaaggactgcattgccccagaagcacccacaacacccggagtgaagagtacctggttgagaaaggtcaaaaggtgattgatggaagagatcggaaaagatgtttggttgctaggaaaatgtcacgtcccaaaacgactctaaaatatatcctttaaattatgcctagaataattaaaatccgtgtgaaagcctctaacaattaaaatgtgcaaagttaaaagtcaaataaggcttagaagatttttgtatatttcctaaaagcctaaaatgtgtaaataaattttagtggaattttcatagcacaaataataattgttaagaaataaacaaagttgaaaaagttttataaaaagaaaaacccttaaagtcccccttccctcccttgggccggcccggcccatctctccttccccccctctctctctcctctccccgcggcccactcggcctctccccgcgcgcgcgccgctgacgggccggcccgcccaccaccctcgctgacgggtagggcccacccgtcatccccgacctcccgccgctcccgccgttccgcccgcgccctagcgccggcgtcggcgcgaatcccgccgccttccgtcgtccccacgtgcaataaagtgggaggaatcactcaacgtgatcccctctccctttccccccattttttccctctctctcttgcgttcaaacgggcggatttgcccccgcaaatctcgccggcgccattgatgggggccgacctcccgcgccggtttctttcttcccagtcgtttcttccccttccaaacctatttaaaccct

SEQ ID NO: 73243 - DNA, 6513 bp, Oryza sativa
ataacttggccatttcaactcggaattggaccgttcaagtctctaatttttccttaagaagtcaagaacccatttttgtgctttgttcctgcttgttatatggagtttattagagtaaaagccttttcttttccgttggtcgtggagacgctgcagcttcggaagatccgctcttcgtggaggttaaagccgacgtttgggaaagcgagcaaggcaagtcacatcatccttgaacatattggatcccattttacaaaattcttttgatttaaattattgcattatcgctttacttaaattcccgcgttatcactgttttatttagccatgcctatttacctttgttatgaccttattattattgtcattgatattattaccttgttcaccctagattaaacaaaaccccaactagtggacactctactcatggtaccactagtatgaatttaggtagatgcttcactgattaattaggcaacattagggggttttataactctagactttgggatattcatatcacctggacactatggaatggttggattattgtggaattggattcacacctccccctctattcaaaatcctcaaaatggttttcggacgggctcggggtgcattgttttgatagtagcacctcggccatataaggaccggtcttcgggcctctgttgcaaagcactactgtacttccacatgtctcgtaggtaaggcttagtttgtggctcagtctggttataaacaaaagtacacggatggagatggacgaagtcgggggtcgatggacatctctagggcaaatgaaggctacacgagctgcggcttggtagtcgagatgtcatggcacagggctggtgtcctgctgctaggggctcagtcctgcctacctgtcccgggggttccggccgtaggtggggttgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccatgttcacaaaatagctttgagcaactaagtgtcttttaatgctgtttactgcaaaccctaacccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaattatttacgcttccgcttggtaaactctgaaatgtatcaacttttggtgtaccttgcctcctgggacaaggaataatacacgcacgtaaggaacgcccgttgggttatttctggtcgtgacagaaaagaattaggtcgaaaggtgattgataaaggataacgaggaacatgatttgtgtcactcgaggaagactcccgatagcaattaaccctacaactgtcaccatgtcatttaagcagaagaattcgcgagtaagcaagatgaccataggtagaagtgattctatgaggacaaggatggaaacttttgtgacatgaccaagaagtcaagaagttaacctgaacagctagaaactaaagctcggttcaaccttgggctgtgtatcagatgctaccagagtaaaagcaattgcactagtatcgttcaacgcactttcctagcgattgatccatctggaaagaacacatcaaggatgaaggtgtaaaggaatatgttgaatgctaaatgacgacaatatgaagagaatagtggaaagtaaaccgattgtaaagaaagtgaatccgagatgtctgttcgtgggagctattcccagttatgaaccaagtgatatgttcaaggataatctacagaggtcagattaaaatcacatccaataaagaagcttcagatttggcaggataacgatcagacaataacaagtctagcagtaaagttatttgggaagacgtcaaagcatgtcaagtgggataagttggttctcgtgggaagcataattcaaagttagagtgatcgaccctcgcattgaatagcgttagtatctagcacccggagactaggaaagctaatatgaggcagttagtggcaagttgtcaatcatggtatccttggtaagcgggatatcatagtctaaagcatttggtggtaagttggaaggaaacgccaagcatggtattctcatgatgacaagctggtaatgacaagcatggtatcccagtaatgacaagttggtatcgacgcataacgtgaagttggtaacttgtatgagattgacaccaagggtatgaattatgagaagtcccggaactgaagccccgtcttcaagtgccgcatcccagtcgaagtcagctcaaggtgcaaccagggacaagccaggtgaaacgaagattccatctgcaacaggagatcaagccaagcagttcagagtggggaagttttgctgggcaagtttgttaaagaaaacgcaatggaagaagtcggaccagaagagaagaccgcccaacctatcttcttgctagccttctcgaatctcgggggcgagattcctgtaagggggtggatttgtcacgtcctgataaattcatcccgaaataaaaatcattttctaaaaggaataatataattaattaaaattcgaatagaaattggcaaacattaaaatgcgtacaagaaaaattcgaatgtggcccggagaatttttgttaaattccccttggtctaaaatgatccctcaaattttacttgaatttccagagcaccggatataattattacgcaacaacaacaattaagaaagtttattaaaaaggaaactaaaaataatcctccttttcctttgggccaagtccagcccaaagttcctttcctctctccctcggcccgcggccgaagtatcacttccctccctctctttttcctcccctctctctccctggcctcccctcctcctcccgggccacctcttccctcctcttccgcttgggccgcccctgccctatcccggcctagccgaccagccgcctccctcctttccctcgcgcccctctgcacgcgcggcgcatgtgcgcgcctcacgcctgaccggtgggtccacccaccctgtcgtcttcaacctccagccggccgctcctctctatcactctcccgaaccctagcgccaccatccttcgatcccgctccactgcgcaagttccggccaaataaattgcaaaaacggaatccccatcccttcctcattatttcccccaactttccccctttaatcccgcccccaatcaccgggatttaatccctcttctttgaccgccattgatgccgccggccacgttctccggcgtcgttcctgtcccctcctgtggtcggcactcccctccattgcctaaaaaacggagccctagtccccctctccttcggttttcccccttcccgagctccctagccacaccgtcgctgacctcctctctctcctacgctgccggccaactccagccgccctgccgccgcgtcagcacgccggccggccgtgccgtcgcctcccccggtgtcgcagtcgcctccccttccccggcatgctctccgtttcccgcggagacctccagaagtgcatccccgccggcaacaatggcgttgccgccactgttccgccttcggccgcctctgtcgcgtctcttgtgcgccggccgacgtcgccaccacctctcccagcaccgaaacgccgtcctcttccccgtccaggccatggcgtcgcccgtatttcaccggaacaccgtcgtgccgcgccggcctctccatccgcctcgccggaatttccctggtctgcccttcctcctcctgtgtgttgtcggccacgccaccaccacctccggcatcgcagcggcgagccggcaacgtcatcctcggcatcgcctcccctccatccgaaccccaccgctggtgtccgtcatcgtcttcaccgttcatcctcgccggctcgtcgtcccgcggtgccgcctccatcgtcatcatcgcagcggcgtgttccgcaccgtcctcgcattcgtgcagctgctgccgactgccctcatcgcctcctcgccggttccggttgtcgtcctcccgtcgttctcggtcgtcgtggcgttcgtccctctgtcaagccgcgttcgttcgtcgcccgtgtttcgtcaagtctgttgcagcctcgtcgttgtcttcgtcctcggctccgcatcgtcaagccctgagtcagcctcgtcctgccttcgtccaaggatcgccgctgaagtgtcgtccgttcgtctccgtcgttctcgtccgtctccaccgcgccgttcgtcgtcgccgttcccacgcctcgtcgcgtggtggtaaggatccgtcctctcactgccccgtcctcgtcctttcggagtcgccccatgcccgttgtgtgtttgtcgaccccggtacccgtgtaccagtgtcggtagtcgttcgtgggtgcgtgtggtgaccgtgtttgtgtgtccgctcggtagctgtcacgcccagaaattcacaagtaatttctgaactaatttgtgcattaaaaaccctcatccaggaattagccgagatacagaaactgacaatttaatatacagattcatcaaaataactaaagcgataaatacttacataagaggcacttagtcctcaccatgaagaaaattgcagcggaaaataaaatctagagaagcttcagctcccacaggcagctcaactgggatataagccaaaggtcttctccttctggatcatttttcttcaactgaagtttgatgattattgcaaggtgagtacatgcaatactccgcaagccacacaggaattatgcaagtgcacaaggataccaaaggatggcataatatagggtttatttgtgaaagcaacatttagcaaagatttaagagtagtaaaatagtagagtaattaatcatcaatattaatcaacactgaacaacacacccatgctgcacaggcccaaccaaacctgaacaaccaaccctggttgtacagatcaaacctccaaaccaggaattatccattccaaactgggagtcaaattaattatcacattgttatcattaatgagtagtgtggaactaatcacgaaaaatattgttagacccgcccataaccgtgggcatggctattcgaatagttttactctggccagaggtgtaccactatacccacaagacacgattccacacatgttgccatgccccgaagtaccaccacggcactgcaaagggggaaatcgtgacaatacccttcgcacaacacaactcaccacagtgcaccattcctggatcataatcaccccctcaaaaacaagaggcatggactccccagtgacccccacagacttctcgccgcttctcagtctggcaccctgtaatgaaccatgctatacaaaagataaagtcgttgcccacgttggcttgtggttagcacggttaatgtttcacaacagtagctcacgaaccggtccttaattgtcatgagcacgaccttcaaaaccatgtactcacaaccaaccattaatcatattttaattatcaattaattatcataacacgattgaccatcgtgagctaccattaactataaccataagtaatagtgaagcatgatttatcccattaatgagctaatgtttctaagcatgactaagcaactgtcataagcatctagctgaaccaaaccaatatataaggttcaagctaatcaatttattacccataggaaaataaagtcatattcggccataattaattgggaaaggctcactacccgatgacattcgaaaacaatgcataagttaaaataaaacaatagctttaaacaggttcaacatgctcaaagggttgtgtgggatctgtgtgacttgccttgcgaacaagcgtcttcgattcgtcttcaggaacttctccaacgaacgaacgatcctccgaaacaacggaaaactaaatctagaacgcaaaacgagaaaaaacactaataagaccaaatgaacagtacaattaaagttcataaaaaggtagagcttgaatttacatgaattatgagacttgaacgaccttattccgagttcgtatgaattagtt

SEQ ID NO: 73244 - DNA, 8311 bp, Oryza sativa
  unsure (1)..(8311): unsure at all n locations
cgtggtagactaggtaagggtaaggagnatggttaganacaaagtaaaccgatgttttattcagtttacaggattttagatttttctgtctctttctttgaagttcaaattgaaagttagaatgatgctaaaaattttgatgatttttttggtaataacctatgctacccagattccatttctcaaaatttcactcaaaaatttgaaatattttaattctgacaaaaagatgaaaaggggtatgttgagaactaaattgaattttgaggtcaaaactaagggtaaaaattcttgaaaaaatatattaactcttgataagtactctagtatttgaataaattatgaaacatatatccttcagttcaactttaggcacatttagatgtttcttcattttaccaattaggtttctaataaatttagtttgactaccttaactgctttacttgaggtagtaaaaagtttgataaaatcacgaaaccttcatagtggttatcttaggttggctaagtgacaagaggatcttcatggatgtgtgttgcttagatttgttaaatagtctctaggtttatttaacatgcatcaaccaaccaattatgaacggcataaacatcagtcaagccaataaattagacttcactacaaacaaacaagtacacaagcacacaatcactcactagttattaattctactagccagttgctaagcatgatcgggtagattatccaaagagcgaaagattaacgactatactacaacgtttcttaactaccgcttgaccatttaatttggttatatacaaagaggcttggacaaagcttagaagctaaaaagtagaagactccaaacaccagagcttcatggattatctagtattgagtcagcttggtctcttgaaacaatgttcccctcgtggaagggaaaacacaaattagccgagctacgcctcaaaagtgttgctagattttattagcaccaaaacactctctgaacgctggacgagtcatttaaaaaaatagttttcgtttatctaccaaaaaggttgtagggtcattagtctactataatgatcactaaagtttcatattaactcaaaccaatagtttgggaaaatggtttcaatttctatccatcttttttatacacaaattaaccagatgaggtttttgaacccaaatagctttaaaacatccaacttttactaaggacataccccgatttccacctaagttgattaattaaaacttccggatgttacacttttgggctttaatctctatcaattgattaaggtttttccgttattagtaataacacagagcatcttgtcaaattcataactaaatagtcgaagctccattttaacccattcaaattgtagtaaattcattaaaatgtcaagaatccactaaaattggttttttttttgctgtttcagtagctttttagcttgtatttattgtgtgccttgtttgtcatttggcaaaatttgcaacaggacaccaaaaaattgcggcctttgctgtgagacacctgaagatcatgaatcttttcttggaatatcgtaaaaaagtggtaattagatgctggacactcctcccattattttattattcccaatcaaaatggagagagaaagagttatgtaagtaccaaaatgaccttgctctctcttcttttcttttcccgtcttcttcctctcgcttgctactgagccgagcagaggcgcgatgcgcgcagccaacgcggccggcccgagccgggacggctcagccatggcggggcagcggcggtggcacatcgccggggttcactgccaacggcgacgacgcacagcggcatcctggcgcacggcgcggcaatgcacggtggcaccgatctcttggggagctcggcggtggcgcaatggcgactgggccggcacggatacagcggcgcgtgcctcaaatcaatggggccaccgacttcttggctgctaggagtccacgaaggcattctgcgcgcctgaagctgttgtcgcggtgccagtcaatgtcgacatagatgacgcacctgaagctgccgaggaactcgtttatagggagcacgatgtcattgacttagcagaagccattggccttgcacgcggatgcatggtgcatgttgcccgaccaagttgatggcgatgtcgaaggcgccgtcgacgagcacgcaagctgcagcgagctacccacgggcgtaggcgcgcaagtacttccagaggcggtcgaagncggggcaatcatcatcgccactgagtaaaccgatgccgtggtcatcctcccccttctgccgaagcgcggcatcgttgacgtagctctccgggatgaggtcgcggaggcggcgcatgtcaccgagcatgccataaaagccgacgaggctatgcgccatggcgacgcaggtgggcctgggtcgtagtagtagcacacccgccgctgtcgtcggtgcacgttggagaccattccagcatgcgcgacttgccgccatgggcccgcacgcctcccacgcttctcttggtcttgcccgacgatcgctctccgcaccacgcccctcagttcgactcgcccgtccggccgtccttccagctagccactgtacgtgctatctagctgttgcagcacacgcatgagaaagagagaacatgaagaagatgaacagagaaagagaggaagaagaagaacagagaaagatgtagcacttcacctgggagtattccaaggtatcgattttccatagggaaagagtgtgctcagctcttctccatgttcatccaaggacacgaagcaaacatagacaacgagtagagaggatttcctagtgagaaatagtatctacggaaagcttaatttaatcctatagcggtacttcatgcacatgcttgctcgctactaccagaacatgctctattccgtaccccgacaatgaggacttaagtgttcttgagggctgtcaccacctctacacatacctctaactatttgtgggatacacagcaatcactggaaattaatgtttacggtctttaaatcatagtttttgaccatcaatacttgcatataatgaaataaaatatggcatccaacttagtggtagggtttattactaatcattttcactagtgttggtgaaatatgtgtatgcaggtattttgaggagaaaacacatccgtcatgcgacaaaatgcacctttgcacattcaggacgcgtttacacggattggagggcccatatgtcaaccaaaaccacttagaatggagacaaatcaaagtacatgatgttgggggcccaataagctacctaccagccaaaggagaggtcaggaagagggtttttaggttcagtcgaaccaccagttcggccaaacctgtttcgtggccgttgatcaccagattgcacgtttttgcttaaccaaatatatctttaaatgaaaaacacaaaaaagttaaatactagagagggatgttatgcaagttagttttaggaggtcccgctaattatattttcctaggtttagcaagttattaagaacataagaaacgacatgatgcatgattagaaaatagttaattttcatgatgttacaccatgccaactcaggcgagttgtttggttatgcacacatctcgggtgcaacaaccttgtaccttcaaggcgtgatccatttgtacaatgctgtagagtctacgctggccgccactgatcgttgactgcccacagctggcgccgacgtcaacgttgtgccgtgtccgtccttctttacccgccaacactcccggtgtcgccgcgtgtgcgcgccaccatggatacccaatcaggagacgaggccggcgccgttttcttttcccctacgtagccggtgccgtgccttcctcgtcttcctccggcaaattgacccttgtgaaccaacgtccgccgcctataaatagccggtgaaccctccccttttctctattcaaaacagagccgagctacttgagctctctctctcctcccatgtccggccgtcgccgccgacggtcgatctcctccaccatagtgtttctatccttttccttgtgccactatgttggtctccctccggcgaacccattttaccgatctcccctttttttccccttcactttaagccaccaccatcaccacccaaactggccggagctgagctcttagctgcgccgttccagcctcctctctcacttccactgccgaccactaccttccctggatgtgcgccgacggggaacacgttatgttgccggcatcgccgcatttcggccaccagagagccagcgccccgctcgccctctcctctctctctctctcggctgccaaagaaaaggaagagaagaggcaacgggaagaagaagaagaagaagaagaagaagaagaagaagaagaagaagagaaataaaaaggaaaagaaaagaagattccctgacaggtgggtccctgcacagtgacttaactcattttccccatttaattcaaaacccaatctttagaaacccatatctcctaaaccgtagacccgattccagtgaaacttggacctaaattcatttgaatccaaaccctatattttgataccaattttgctattttactatttggacctaaattcatttgaatccaaaccctatattttgataccaaatttgctattttactatttggacctaaattcatttgaatccaaaccctatattttgataccaaatttgctattttactatttggacctaaattcatttgaatccaaaccctatattttgataccaaatttgctattttactattttatttgaaattccttaatgccatttgaatgtatatttgattttcaaatatttcctttttacccaaaaaatacccctttagccagtaaaaagccgccgattggaactttacaccttccatgcatggggacatttgtggtccactaggccccgatgtcgaaccgttggttgtaaagcccggcaaaaccaaacctaaggtcgaagtgttgctcctagcacctcacgcctcgatgcgtataacggagcttcactaatccctcgacctccacggcacgccgcacagttagctctcgggctctatgtgatcctaaccgctctgccgccactcacggttgtcggagtaacacttccgccccgctaaatcagcacaaacctcctatccatctagctgttatgctctctctgttgacaccggctagagaagataccaaatatagtcgttatgctacccaactctagcaacgactagcaaacaaccaaaccctagccaatactagccacatttccgtttaatcagttagactatccgctataccccctactatccatcaaccaaaacctgcacatgaaatataagcgaccctggttgcttaatcccatctagcctccaaccctctagaacctccacataaaatattagcccaataatccctatacccaataaaaatgagatatttatacctcaaacccagcctttctcgctcttcatcgctttcttgccatttcatgatttttattcaatttggttattcctctttcttagtagagtctattatcttttggatggcaactcgtggtatttcgaggatcagataatcaggttgcctatcttagatttatttgcgttggagtaaggcaagttgttattcctctcctttgagcatagatgccctatattctatatctccgatatctcatgcattagtcatacatgatttcgaatgcataacctgaacatagcaaaccagatgtgctagcttttgcttagccctgcctagttagactgcataaaaatataatgaacttatattgggacagtacgtaggagttggttgatctccgggtggctagtactgtctcagtcgatataattgttaccaaatacttatgtcaaatgaacgagtacgaccgcagcttctagaatggggacagacctagttattatgttaattaacaatgtggtacctctgtatagtggttctatttttaagtcctcgcgcagtaggcaaacttatgccgagcagggcaatactgtgatatttaccgaggcgcaggtaaatatatatttgagataaattgtgatcacgtttgtgaaccctgattgcgatgacatggtgtcatacaatcagttctctctaaagacctcgggaacgctagaactcctctcactgctgataacgtcacgttcagagcgcatgaggactcaagttcatggaacaggtgccattattgttagtaacctaatactgggccatgactaagctaatgattattggcaagttatggactgcgggtaaagcatacatctattacagtagagtatttatgaaagtattcaaatagccgtgctaacggatttgagtatcaaggctcatatgtttagaaacttaattccatattttattaaatattgttgcatcaaaaacattgcaggctttctcgctctttattctcagctttctgcaattaaacctagctctactcaaatattaccatttcatacattcattattgaatataatagcttgctgagtacgttgtactcacccttgcttcaacccctttttcagagtccatttgatgtttttgccgaagctgggagttcaatcatataagttagtctcatgtcaacctagttctcaagtctagattagttagatggtttaagtctatagtaaaacatcaacgtcgagtccttctatagcctctgctggattagttagccacaagcttgtaaattcccctattattttatgtaataacgtctcctttggagccttgaccaagtgcatgcgatgaagatccagattgttgaacctgcatcaatctaccaatccagggcttgatacagttaaacatgtcggtttccaaatcattagttttgggacccgacatatggtcaaagtgccttcctccgctacaatctacattgagatggaggagaaatcgacaatcataggtgaccatgccactgccccagatattccaatatatacgtcatgctggcgctaagtacactaaggtatgcgaaagataaaacaaggttcaccattctttttactcaaacttatcactatgtgaatatggcttgatcatatatgttatgctccttatgtccatttttgtatgacttgatttgggtgtattatcgatgtacatccataggctttttaaattaagcatggtgctgttaacgaccaaatttggtaatataagcatcggaaaagaagattatatcgaagtggagtcgaagcggagatcgattcgagaacagagcaagaatcggctggagtccagatcggctacgattaggattggctgggtccgaatcggactaggtaagccgatgcaacggattccgacaatacgacttggtgtacaacatcgggttgagttgatatgcttcaagatgattaccgcacgtggatagagtcctgagaaggcaattgtatctattaattaggatgttttatgtaatttccttagagatatgtttagggcaaaagtctaccgtaaagacttatggtatcttagagtttgttagagataagagtcgtgtccgacatggacatagtttgtaattttcgggtataaatagaccccgaaccccatgtaatcaaagaacacacacgttcaatacaatttcggcgcatcgccatccttttgcttttgttttatttcgacgagttcttgctttcatgttgagctgtatcggtttcgatcttcaacaagaggtaaaacttgttatgacggcttgcgttctcgggattagtgcttccatctttatgatactctaatcttatttatgtaattcgtcgagttaccatatatcttacataatctctagaaatatcgccatctaacccacaatcggctaacatctgttaacagagggcagccgattaagttagatatcgacgttggtttagattatataagatatctaccactctatgaaacttccagcgacttgattgtctagaaattggtcttcttttcatacttaaggctgcatcagttgagtttgatttattaagtcgtgcttagaatatcaatctatagccttgcttcttgttgccgattagggtagtattggagtttcagccgatcttacctgatgtatctataattgctctattatgcttcattgacacgttaaatctgccctttatgtcaagaatttattggatataagtttataaagctttgtttggtatattctacttgcttaacatcttaacatagagtcgtatcggagtatttacccaatacttgc

SEQ ID NO: 73245 - DNA, 7298 bp, Oryza sativa
  unsure (1)..(7298): unsure at all n locations
tggaaaggaataacagccgctgacgtcagcgatgacatcatcgccggcaacacactggaccacaaggttgatggcactaggaagctcggccgggctatccgagaacaccaacgcggagaggacgacgagacgccctcaccgaggtcggcacgaccacggacgacgatgggagatggccggcgacgagattgaggcggcggcgtggctgtgtccacggtgactgtggcgtttcggcgaggggaggcagcaaccgaggggcggacggtcttcacctcgctcctgcgatcccgagggtagcgacggcgagcgaaggcggcgatggacggcgacgagcggcacggctgaaaacgagtcgacggaagattgcctcgggttgacagcgacgacgaagctccgatggtttgcagcggtggcgaaggggtggacaggcttcggcttggcgttgcgatgccgacgacagcctcggggaggtccggctaccacgggagaagcggcaaagcttcgccggagatcaaaacatggcgatggttcggccttcacagtgacggcgaattccggcggggttcggcgcaaaagaacgggtggccggggtagctctcacccttgcgaagccgatggaagtggcggcgcaagtcggcgacgaccagagaagcggaagacggcggctggaattggtggcggcggtggagagagaaggtaagcgtggcggcggctctagggctagggaaaaaaatcgggaaaaaggaggaaacggaagaggaggccgaggggctgctatttatagccaaaggaggaggagatcggctcggatacaggaagaatcggcgacggattagttagggttcgccggaaaaatggagctcgaaaccgcgtcgaattcacgcgatatacaacggtattcaaaggggtttcttagggataaggtagaggagatcgaggggactccgtttttacaaccaattttggaaacttgctctgtccggaggtagaagatggtactgtagcgaggggacgtaaaacagacttcttgccgggcttttttttctcggcttgattagaagagggaccaaaactggacttccgctaaataagagaaagaggaagagagggctgctgcgggctaaggaagagagagaggagaggagtgggctgaattcggcccagactgaggaagagaatttaattaactttttataatttaaataattgctgaaatgatgtttcatttattaaaaatacttccaatgctcaaataaatccaagaaaaatcccgaaaatacttgggcacataaagtatttaatgaaattttatctagctcaagtttaagttcaaatttcttatagattttattcccacacttactttgattattaagtaatttctaaaaattcctttttcacaacgatttataatttagcgattttcagggtgtgacagtacccgcgtggtttccacgtgtgcagcccgcgtggtgtccagtggagtccgtttgtcggctactcggctcggttggcacacggggtctgcttccgtcgacccgtggaccgtctctgtatacttggtctaccgtggtccattaggttgacatgcggggtccgcatgtcaacagcgcagccttcctgtattttccaggctagcgcttgcacatgttttataattgcaaaacctaatcataataatccgtaaatctccatataacagcattaaacttcggatgatcatatcttgatcatacgaaccccgaatcgacccgttcaagtctcctaatgtttgttataacctaaagaaccgtgttctttctttttatgtattattattgcttctttatagggttgtagctttgcttgtgtgtttcgcgtagcttctgtcgttccggaggtttcggaagcgtagttcgtggtcgtcgccgaaggttcggaaggccgttctctctgagcaaggcaagtcacatcatccttgagcatattgaatcccagtttttaaaattattttaatttaaattattgcattaccgttttatttaaattaccgcgttatcactgttttatttagcacttcctactaatccttgttacagccttatcattgcaattgttattatcacctcgttcaccctaggaaaacaaaaccccaactggtgggtactctattcatggttccactagtatgaatttaggtagatgcttcgctgattaattaggcaacattaggtggttttataactttagactttgggagttctcatgtcatttagacattatggaatggttggcttgtgatggaattgaacacacacctcccccactattcaaaactcccaaaatggttttaggttgggctcgaggtgcatggttctgctagcagcaccttggccactataaggaccggtcttcgggcctctattgcaaagcactaccatctaaccacatgtctaatgggtaaggcttaactcggtgctcagtctagtcctggcaagagtacacggatggagatggacaaagtcggggctcaatggacatctctagggcaaatgaaggctacacgggctacggcgtggtagtcgagatgtcatggcacagggccagtgttctgctgctaggggctcaatcctgcctacctgtctcgggggttccggccgtagtcggggttgggtcggtgcttttgtcatggctaggataggtaaaggggttaagtcacatcctttatgacgggttccacggccgtggaatacggagtaaagatgtgtcttgtaggtaaagatgtacacctctgatcagagtataatctattgaatagccgcgccctcggatatgggtaagcctagcaatgtacccaagttggtggtttaatttttaaaacttgcttaacaactaaaatgtggaatggttggcatgggttggcttgggacgagttgggacctgggtctggttgccagttcggtctgaatcatcgtaggccttgggttaaggcaggttcgtgtggattcacggccttgattaataatattgtgtagctataggatcgtgtttacaaaatagctttggacaactaagtgacttttaaatgctgtttactgcaaaacctaacccctattattatccccttgtacccccttacattaatcatgcatctcccgatgtggcttgctgagtactgtggttgtactcattcttgctatatctttcccccccttcagtaatagaagctttggagaagaagtcctaggtggagtcctggcttataccccagttgagcacctgtgaagatggagccgcaggcccgcttgtccgctgctgtttatttttgtttgtcaagcctgaagtgcctttgtaataatgtaaatattatcgatataataaagatgtgccttttgtatcctgtttatgtggtgtaccccggcttttcatgggacggggattaatacactagcgttctggaaaaggtatttttccgggcgcgatagtcacttctctccccgagcaaaaccctagccgtgcgcgggtgctagcacatctgcgcgtggcgttccgtccatgtacgtgtggataccggtagaggcggcgctggtttgcggtgctgattggcttgggagtacggcgaggagaacgcacgaggaggagaaggtcaagctggtgcgattgactacttcctctacatcgacgcgcgctacttcgcaagagttccttcgacttcttagcgtcttcttcaactgcgcagcgcgtcgagtggtaactatctatgatctaatacttgcatggttcctggtttacgtgatagaaaatttaatttatgctatcgtagcctacgcgtatcccaaccgaggggaccctcatcggaggcgctacacctcggccacctcatccccttcatgttcacaaaataagcattgctcccagtcccggatacaagtgaactgaaatcatttgtcaactagtatttattaacaatcaagatatctcttgtcaggtgctccctccatccacaaaagttacacctatttcacatttgagttttttccaaataagttgtttctatttgtagtctttatgcattcaagacttaaatgaagagataaattaaatgttttattagaacccaaggagtcatctaaatactcattggttgcatgtttacattcactctttgatcttgtaacatccaaggtgatttaatttcttcttggtcttggtgagggagtacttgcaggatgctttcaaggtgccgcaggtgatacagctaaaagctgacgatgaaaagtttatgtggaagaacttgactattgccgaatgtaaaaggcttgcccatgaaaatgccaaagacattatcacctgtggatttgacattgaaaaaactttcatttttacagatttcagttatgttggagggtaagattactagtactccctccgtttcacgatgtaagtcattctaccatttttcacattcatattgttaatgaatatatatatatatatatatgtatatatatatatatatgtgaacatatatatatatatatatatatacacatatatatatatatatatatgtatagaatcgttaatatcgatatgaatatggggaatgctggaatgactttattgtgaaatggaggaagtacttcctaactgtcgattaaaatataaatgtctggctggtcttttttttttcactcagctagcttctattctatgataaagtagtaaccctctatctttttttacagggcattttatgaaaggggcaattgtgtttttgcccttgctttacgattcaattgtgattttacccctgttttttagggtttgtgattttgcccctgtttttttaaatgaaggagccgtctgccccagttttgacagaagtttggtgggtccggaatttcagaattaaacaaagatagaaaatgttattatcatttatgaatgaccattctacccttggttcaataaaagagccaaatccccaatcccttactgtcccgattttcactccaaaaccctagctgggttgcaagcggcggcggcgacgcgcggccagcggcgggcatggaggagtgccggtggggccagctgccgcggaccagcgcccgacggagtcggggcgcgggcagggaggcgctgcggcagcgcatggaggcgcggcgtgncgccctcgcgggtgcacgcgcagggaggcgcggcggccggcggccccgtggccagcgcggcggcggagaggaacggcggctccgtcggccagcgagccagcgagcagcgagcaggtagcttggcggcgggatggcgctgttaaaggatgtaggcaggcacggcggcgtcctcggtctgaagcgcaggctggggaatcagggaggcgcgacttgccgccggcgggctggcgctcctaacttcttgcgggcgcagggacgaggcctaacgctattgcaaatacaggattaggagacataatggagtaaatcttgtgcatggtggaaatctgctgcaaatcccctgttttctttcccattttcatgtcttgtatctgcgagagatttgtttggtgaatggtgatttcttcctggtaaatgtgatgaatctttttggtgaatttttgcacccgatgcaagttctttgaaaatgctgcagaaatgatgttaaattcttccaaaatttgtcaaagtttggtcaaattcgaaatatatgcacattatatcaagaaaggagaggcaaatgtgtaaagggtatacaagtccttctactgctaagttgacgctgttaagtgatgctaacagaataggggcaaaacagggacagaacagagcttcgtttcaaaaaagtgagggaaaaatcacaaaccctaaaaagttagggtaaaatcacaattgcaactcaaagtgaggacaagaacataattgcccctactaaatatgcttgaagtttccaaccgtgtgacatataacaatgtgagaactattctattaagattgttctctgctcttggtgttcttgcttaaatatttgtgaacaccatggagattcattacttatctttaagcgtcatgttttctaatactcttactcttggatgacagcttaaagggatatttggaattagtccggaagatcaaattggcaaggtcagctttcctcctgtgcaggctgctcaatcattctcatcatcgtttccacatctctttcatgacaatgatgaccatctgccgtgccttatcccatgtgctatagaccaggtatgatatctctggtctgattatctcgacagtacaacataattgcttttgtatctacttgctagtatactgataatatatagatttttcagcacaaaatttggacttagtttgtttcttcttgttcttttccatctctaaatttgaatttgacccactcccatacgcaaaagccaagtttagagccttgacttgtaaacatttgcatttaaagataccaaaatgttctacatgtttgtatatagccgtatcatccatgcatcgaatatgactgtcaacattcggaaatatcaatcattaatgttggaaataacccaactagcgttataccacatgtaataaaccagtaaaaagaacttccacgcaaggtggtgtctgagaaagggaatttctaggcagcctgcccttatctgacataattggttgtatatcttcttattggcattaaaatatgtagagagatttatctggcagctctaaatttgtactgagtgcttgtcaagtaaatatttttccaatacttgatttagtgatctactatcatgaaagcatatccgatatttctcattaaaggtactggagtgttggtacatatatgtatttagtttggcatattttgagttgcctatttaatcttaatttatatttatgcaggatccttattttaggatgacttgtgatgttgctcccaaacttggttttcagaaaccttcactgattgagtcaagatttttccctgcacttcaggtatttcttttagggagagcttggatgtaggactgaacattagagctggtgcaatttgacgacttgtaattaacttgctcagaattttttttggttttacttcgaataatcataatttcacgtgcattactttatgtcgattgcttgatttccttttaacagggggagagcactaaaatgtcggccagtgacccaaactctgcaatatatgtgacagataattctaaacaaataaaggcaaaggtttcatctggaatatttactcaatcacacgctttagttcggccatttaaattatggtatcttgtagttctattatttcat

SEQ ID NO: 73246 - DNA, 5460 bp, Oryza sativa
gttaatcaattttctagatttttctggtaattatttgagcaaggaaagtatttttaataaggcataaatgaaacatcatttcacaaattattttaattgaaaaagtctttaaaaccatcccctaggccgttgggccgtttccggcccaactctcctcttcgcgcgcggccgtgcggcccaagccgagccgccgccccaccctctcctctcaagccgccgacatgtggggcccacatgtcggggtcatcttccacctctggccggccgagccgagcccaagcgccgccgcctccccttcgattccgccctagccagccatctccgagttcgattgcttgaggggaaatcatctcatccttatcctctccctttcccctaatgtttcggagatcaattttgcccggataaaccgaatcgaattcgttttgagtttatctctccaaactaaccctagatttttccggctcaaatcctctcgtttggagtccgatctctctaatccaagcctatataaagcatcccctagtcgtcctctacgtttctcctcaagtcccaagctccaccgttgctcgtagcgccgccgccacgttgccctagcgccgccgccgccgacgccgttccagccgtgccgcgccgccgctatagccgtcaccgccggcttccgtcgccaccaccgggttcgtgaggaagaggagcaccccgtccgccccttcgcagccgctgaagaccgtcagagcgctgtcgtcgacgttgacccgagccgagccgccgtcggacctcgtcgccggccgtcgttcgtcgtcgtccgtcgtagtttcttgcgccggtgagttcacgtcgtcgtcctcttcgcgtgggtgttctcggatagcccaaccgagccctctatcgccggtggtcgcgtcgtcccgtgccatggccggcgatgatgtcatcgtgacatcataaatcttttatttaattcgtaataattttctgtattagatgaaaattgattaaacttcggaaattcataactaaatcatcgtaactcggattcgagtggttcaagctgctaaattcatctaaaatcaagatctacatgttaaaaatatccacatgtactttttatgcttgtttttgtactgttttgttgattttgtttatttgctttagtttctgacattccagaggagagcgtttacgtcgaggaaggttcaggagtggttgaagaagctcaaggcaagtcacacagatcccaaacaaccctttgagcatgttaaacccgtttagacctaatgttttatttcaacttatgcattatttttgaatgtcattgggtggtgagcctttcccaattaattaatggccgaagatgactttattttcctatgggtaataaattgtttagcttggaccttatatatcggtttggtttagctaagtgctatataggtataattgcttagccatgcttagaaacattagctcattaatgggatgaatcatactacattattaattatggttatatttagtgctagctcatgatggttaatcgtgttatgataattaattgataattaaaacctgcataaaggtgggttgcgagcatatggttttgatggtcgtgctcatgacaattaaggaccggttcacgagctactgttgtgaaacatttaccgtgccaaccacaagccagcgtgggcaacgactttaccttttgtatagcgtgattcattatggggtgccagactgagaagcggcgagaagtccgtgggggtcgctggggagtccattacctctggttttgaaggggagagtacgatccaggaacggtgcactgtggtgagttgtgttgtgtgagaggtattgtcacagctcctttccaaggtaccgtggtggtatcgaggcgcatggtgacatcttgtggagctgtgtcttgtgggaacagtggtacatctctgatcagagtaaaactatccgaatagccgtgtccgcggttatgggtgggtctaacaatgtttttcatgattagtctcacactactcattattaatgataatactgtgataattaaattgactcctggtttggaatgatatattcctggtatggaggtttaatttgtacaaccagggttggttgttcagatggggttgggcctatgcaacacgggggtgttgtatagtgtttatttaatattgcttaattacttaactgttttactattctctcaaatgtttattaaatcttgtttatgcaattgagctgtattatgccatcctttgttatcctgtgcacttgcatatttgctgtgtggcttgttgagtatgtcatatgctcaatcttgcaatattcattcatcagaggaggagtacttcagtgaaggtgatgatatggaggattaggttttgttcgggtcaagttgcttgtggagtggagtcgccatacctgttccgtctattgtttttatttccgctgcgtagaattttattcttttgagaggaactatctacctctgtaataattatttatttcgcgagtattaattagatatttgatagtactctattatcaatttgttattgtgtgcctcggctgattcctggacgaggatttaacgcacgtgtaagcgtttggaattttggataaaaattccgggcgtgacaaagaatcatccaatttggagttcatatgattgagataaactagtttatttttgcagacggctccttaaaatgctcgtatggaaaaattgattttttcatgtgggctcttaagtaagccgcatgcaaaaatgagctcatttttgcatgcggacctcttaagaggcccctatggaaatattaattttcccatacaggtgtcttaaagagtcgtatgtgaaaataaagatcaatttttgcagacgctgtcacttacggtccgtctgcaacctaaaggggtccttgtacagaaaattctttttttagtagtgagattattcaaaataacaacgaggataaactgtgttggaagcatacttctaatggcacatgcaacacaaaaagtgcatacaaggagatcattaaaaaggggagaaactgtgttggaagcatacttctaatggcatatgcaacacaaaaagtgcatacaaggtgcatacaaggagatcattaaaaagggggagaatcaaaatctgcagcaggtaagtgctcaaactacttacgtaatcaagaaaatttagaaggatgaactcacccttccaaaggtcaacgtctttgcttggagacttatcagagaggcccttccaacagctcaatggctaaatctcttagaatttctgatattttggctgctgcttgttgtagacgtggtcaacctgaaactgatttccaccttctctttggttgtccctgtagtaaattaacctggagaatttctgaagctaatctatctgttggcaactttttgtgacaagtcgaagcacgatcgcagcaccaaaacgccttgtggtgatatggagtcgccaactacctcgatctagccaaacggccaaatcaagatgggttttgtagaaaaatagctaaaccggcaagcggagccgatttagatatcaaaatcagcctctaggccgatttagatctatatgatgagaactatccgtctcgtgggcaaaacagaaggttttcaggacaaacctacaaataggtgtcgcactctcgcagcggcagcggacgatttacggcgcaaatcgacaaaaatggactacaactagagtaaagtagaaaacgtgattcaagtagattgtgtgttcggggtattacaattgaaccggccttgtcccttaaataggggttggtcttgccctctataggcccttctccacgtccaactcgggatagaaaccaaaggaatcccgaaacatgctttcccgagcaaggaaacccgagacccgacgaaaacagactcagactcggaccctgacagtctgaccggccatatacctacagtcagaccggagttcaggccgcggtcagaccgcctacatacttgcggtctgaccggctctgtgaaggaaacccggcactttccaaactttggcaattttcccctattttgtcgatagatgccaaatttggatgtaaacactatctactgacatctttactgataatttccctctggctcatattattgcttatattgcctctaatagctcacatcagttgggtttaaatagaactctcatcttaatgtggcagatgtggaaagccaggaatgacttgaaatttcagggaaagctgaaagagccaactaaagtttgttttgtatctgaagctatggcaaatacatacaccattttctctgctcataagtctttgcaggatgatcatcaggatatggagcaagaaagaagaataaaaaacattcccaatggaaacagatgctatgtggatgctgcatgggaaaatggcttcaccggcacaggaatcttgtttcacatgttgtcttcacataatgctcttttcatgctttgtggctcattcatctttgcaagccgaactggtgggtttgcaactgacaatgcactactacaatagctatttttccgtgcggttgttttgattttggcgtgcggttgttttgcccgtctggaacattgcgtctgggaaaatcgtgattttcttgtgcaggtggcgcaaccgcacgtgaaaaatccgattttcgcgtgcggctgcttatgcgaaaataaaaatccaaaaaaaaataaattttcaaaaaaacaaaccctaaccctagatctagatccggcaccccaccgccgtgccggccaccaccgccgccggatccgggcgggggactgccgccgccgccagatccgggcggggggcagtcgccgccaccggatctgggcgcggggagggcggcgctgctcccagccctgccggccaccgcctcctcccgctcccggcacacgtcgtcggcccgctcccggccgccgccttgccgccggtgtcgtcgcgcgcacgccaattcaggccaccacctcgtcgtcgtcgtcggccgcgtgcacgctgctccgagccgccgcctcgccgtcgtcgtcatcgtcgtcggccgtgtgcacgctgctcccggccgctacctcgccattgtcgtcgtcgtcggccgcgcgcacgctgctcccagccgcctccccacgtccgcccgccgctgccgtgagcccgccgcgagccctctgcgcccgctagccaccgtcgacccctccgccgagagccgcccggaggagaggaggagaaggtgagagagagagaggaaaatgagagaagaggaaactgagaagataagggggagggagagaggagagaggtgggcggggggagagagaagaaaagtccaattttttttgaataggatgggagggaagtgctattttcctatgcggttagattaggaggcccgcatgtgaaaatagagctttttttgtgtgcggcc

SEQ ID NO: 73247 - DNA, 5458 bp, Oryza sativa
atgcaacaattactgacagtgccaaggatgattttgatacaggtcattggagtcttaggggctgtttggatgcttgcttcagtttaccaaagttctatagctaaggtgtggcatgccacaatttatgtggctaagaaattcttgaccacaagttaggtaaatgttggcaaaggtatgtgcctatgacaagtagggtcacaaaattaaaaagtgtggcatgataaagatgtggcaatcaagcaaacactaggctaaattggtcaaagtagcttgccaaagttgtggcaaagtatggtcaccatccaatcaaccccttagacttctttgaagccaaattaagagtgtgatcccagaaaatcctatgcatgtggtttggatctcaagaaaaatcaacagtgtagctgataaaatggcctaataagctacttcctccgtttcatatcataagactttctagcattgccaatatttatatatatgttaatgaatctagatatatgtgtgtctaaattcattaacatctatatgaatgtaggcaatgctagaaagtcttataatatgaattggagggagtagaactcagcataacactgatccttctcaactgtaacatctcgcacattgcatctcgcacattgcttatcctaatagagattgtcatgctagaaatcttcaaaatgatttcgtttcggtgaactatactattaactatgtactacctctgaaattactattaactatgtactacctccatttcaggttataagattttctagcattgcccatattcatatatatgttaatgaatctagaaatatatatatgtgcctagattcattaacatttatatgaatgtgggcaatactagaaaatcttataatatgaaacggaggaagtactatgtttcttaaaaaaaaaggggagagacgtgagaggtggttgaacatagcttatagctatgttcccaacccctctcccgcattttccgcgcgcacgcttttcaaactgctaaacggtgtgttttttgtagcaaaaaaaagtttctatacgaaatttgcttaaaaaatcaaattaatctatttttgaaaaataatttagctaatatcgctccgttttccgtgtgggagggtaaggttcccaaccatgcccagcaaacacaggcatagacctctagagcgcggcggacgaccccatccacgtggtaggttccatatattgccttaacaccctcagaatgttgggattcaaaagattaaaaagaggtgccgccacacatgattttttatctaacaaggagaacttttacctctaagaacttttatctaataccggcctaattacggtgtaaaagcacaagagaacttttgaagaccgcattttccccattgtagatatatcacctctatatttttaccacgtgtcatttaaccattgggagccatttaaactgcctgcaaacaacttttgcctcttgtatacaatgatatgggaccatactgcaaacagcaaccgtctactatgtacatgccacccctaacaacttatccctaaaccgaacagaatcctatcatataactacaagaatttatttaatctatgacgaaaaaattcgtcatggatcactgaaaattcgtcacaggaattttcccatgacaattatacttatcgtcatctattgagcgtcaaagattaaatttgctgacgttttctccgaaatcgtcacagatcagcacaatctatgatgttttttaaccgtcataaaatgcttatgggctcgtgtagtccagcccaggcccaacctttgtgacgaaattaaacgtcatggatggttgccatgtggcggctaacatggcagttgacgtggtcgtttggacacgtgtgcgatgacatgtcactgatgacgtggcagctgacgtggttgttttgacacatgtgcgataacgtgtcactgatgacgtggcagctgacatcagcaattgttttatacggcccgttatttttttgacggcccattaatttttaaacagcccattaatttttttaactggcctattttaaaataggcccatttcagaactagcctattttgtcaaccaactatcagatcaaagcccactaaacagacccattaaatttgagcccaccaaattcaatccaatttatcatacaatctcagattcaaaccaacacatctcaacaaacatccaatacaacacaaaatttacaacacagttaacagccaaatctagtcacaatccaaatacaatcacagtaaccaaaatttcaccggatgtcgcatgaccaagatcttccaagtgagcttagcagcactgcatatgcacaagataaaacatcaataactgccatatcatcctagtttcttctactgttcaagcacttaatagatgaataaaaaatattcatgcagttactgatgtcacggacatgctgcaatgtcaggatcgggaggagctgtctccctctgtatgttatctccacctgcacttcgcacatttctgaaattttcagttcatctcagttcagcattttgtaacaaagaaactaagcatgctcagagatcaggcaaaacaatatatatatatttaccccttttcactgtggaaataatggttttcacgcatgagggagaggcaccctcaaatttccttactaaagtaacagttataggtgaaaaaaacaaccctacttccgatcctgctaccaaataaatagcccagttctttcgtgaactctgaaaagatattgaaatgcttttgcacttgtacagtggaaaaattggtaaacaaaaagaactgccagccctggtttcttcctattatcccttaatttaaaaggaaaagactgacatcatgctcacaaatttccaaaaattgggtataaactgaggcatcttaaactgcaatgcaactgcttagcatagtataacatgagaaagcacagccaaaagtttgctagatagccaaaaaaaccacttcacatgttaggaagaaacatgccactacagttttgacattcctgagcaccacatatggtggcaaccaatcctttttacatgaataagataaaaggagtcatcagatttgacattcataataggatttcacttattactttctaaaaaaaggtgaccataggactcataggaactcaccaaaagtgaccatgggaaggatgaaagttgaagcaaactcagcaattcgcacaggaaaaacagcctcatttcaatttggagcacatccaaaacctctacacagcacaccaatacatctctagttgcatctgtagcccatctaccgcagcaagaacagcaacaatcacgagggggaaggaagattagggaagcgagtagggtggatataccttgatgtagatgttctctgtttactgatagtttgctattactgtttgttaaaaggaaaaggaaagatggctagtcctgtttttgtagaatatttttgcagcatgcacatgtttaattgctaattgcaaattgcagtacataaaaaagtggtaatcttttatttcaggtggatatgatccagatatatatggactattggagattagtacttttgatttcatcttactgttaacatttatatatttcatattttctgaaagtacgttgaagtagagtttaccattcgatatataggaattgtgaaaactgctcaagtgatggataaataaaacactacataatgcaagtctcttgttcaaaagatcatgtcttacagctatatgatattatattggtttctcattctgcttgcaggtcagatgataattcattgaggttgattgccatagattgataattctacaggttaggagtagtacttataacgtatagatgcaattcagtttcaacagtcatgaagtgttgatgaattatgaagagctcaagcaatacatctctagttgcatctgtagcccatctatcgcagcaagaacagcaacaatcacgagggggaaggaagattagggaagcgagtagggtggatataccttgatgtagatgttctcggcagccttttcctcctcgccgagcaccttgccgccggaggagaggagccgccacagtgtgagccacgccgccagccttgcctgaaccccctcgcattgactcccttgcctgaaccccctcgcattgactcccttccgccgccgtaccaggtcaccgccacctccaccgaccccatccacgccggcccgcctccgcggctccgccaccgcctcgctgccggcctgcccgacgggccctccgtctctggcgcgccgctgtcctccgcctctgcgacggcgccaccagatccgccggagcaggctgtcactgtgcccgccgcccgccgccgagagccgagctccttcctagggcggcggatccggccttccctaggacggcgccgccaaatccaccgccgcaggtcgttgccgccgcgcctccttgctgccaccgccgctcccgctagagttgggacgccggcgagattgccgaagaggggggggacggaggagcggcgagaggagcggagggggaggcggaaggggcggcgagatccgagggggctgtggatggtgggcgaagggaggaggacgatgaccacggcgtggtaggcggcggtgtgagggtggggaaagagaaggtgaagaatggatggctagggtttggatatatgtataagaagctatgttgatgcgattttaccagaataaccctggtatctggaaacctattatacaagttacttggacaaaatggtcatttaacgtggaaatttcaaaattttgaaacttcaaatcgaattttatcataataaatgaacttatgtgaaaaagttgtttgaaacaaagttgtataacttactgagatctaccaattttattttggttatttctccatctgagtttcattggcctatataaaatttgaatttcaaattatgacaacttcaaacaatattttcaaaaactaaatgatctcaaatgaaaagttcatcaacaacaaaattgtataactcatcaatatctataacttttattttggtcatttttctatatgactttgtttcaacggtttgaatttgaatttcaaattatgacaacttcaaacaaaatttacaaatactaaatgatttcaactcaaaaagtcatcaataacaaagttgtataactcatcaatatatataacttttattttgatcatttcttcatccgacgaagtaatttgtaacattgttcacaaaatctacatatctctcttattttttataaacgtataagagatatgtacattttgtgaacaatgttacaaatcacttcgacgaatgaagaaatgacccaaataaaagttatagatcctgatgagttatacaacattgttgtgatgactttttcagttaaaatcatctagtacttgtaaatgttgtttgaagct

SEQ ID NO: 73248 - DNA, 5127 bp, Oryza sativa
tagcatactaaatgaacatatgtgaaaaacttgtcaaaaacaaagttgtataacttattgagatctaccaattttattttggttatttctccatctgagtttaattgacctatataaaatttgaatttcaaattatgacaaatttcaaacaacattttcaaatactaaataattttaactaaaaaagtcatcaacaacaaagttgtataaataataaatatatacaacttttgttttggtcattttgctatatgactctgtttcaataatttgaattgaaccttgctatacacacgaagaaatctatacgaaattcgtacgaaaactacctgcttacgtgatttccatggctagaacactagaagcccacacaagatcacaggcctacaacactctagattattcaataagaaaagcccatatcaaattgacaggttcaatatcatgctactcattcagacttcagagcttcgtttgagtggagatgcagaaagcaaggatagaataaattcaatcagttctaaaaaaaatcaattcaatcaagcatatgagctaggtggcggctatatgtctaggccttaccgcctcagctgccgccacaatcagggtttacgattccgacaggcccttctatttcgggcactggcggaatttggaatttcgcgaaatccggtggaaaaccggtaaattccgaacaaatttcataaaccaaaatttgaatgcaaattccctgagtttgttgacaagttctcgaaaacctgtcggttttagcgaaattctgatcaaaatttcgatctgtaacctgtaatttggaccaactactaactgggcctagtacatgcaattcgggccatgtaagtgttttcttttttttaattctttattcttttctttcctggtgtaagttttagtaaatacacacaatacatcattttttttagaatatttatatcccaatatgttctatgaatatcatagtatttataagattttatttgtttttttcttttttttatcaattcaaatttgaatttggatgaaactcctcgaaatctcatacggtttctactttcgagcctcgtcggaatgtcgaaatttcgcgaaatccgaccggactttgttggaatcgtaaaccctggccacaatacgagcagtattgctttgcttcctgcataataggtacgatctaccatgcccacactaataataaaggcaaattttgtctacaggacactgtaatttcgtggttttagccgtaggacactgcccgaactcacttttggaggaaaacactctataaacatggtaatttggcaatagacatcgtgctgattaaaataataatttttggttgaagaggagagagaaatggcatgaaagttctaaaatacccttgggcccatatgtcatatcttccatctcttatctctatccccgctgcgccgccgcctcgatcgaggacctcagcgctgacgtcttccaggaacagcttgggcatcaccgcgctgcccaccctgaacgacgacgacccatcctccttcctgacgtcggcaaagctcaccatgaccatgagcttggtcgcccggccatggccgagcaggagcagcacggggtagaggctgtacagcagcagcagcagaagtccgcggaagagtcccccgacctccagcgcgacgagtatgaagtacgggaaggtcgacggcaacatgagctggccgccctccaccttgcacaccgtcacgtccgccgccgccgccggcagctcgtaaacgacgacggccgcctgacgacgcgtggcggcggagacggaagatgagcatggaggaccgctgctcgccgacgacacacggctgccgctgctcgccgactacgcgctgctgcagggcgccgtcatcgactatgcggcagcgccggcgacgatggcctcctgacgacgtgttgtggcggtggaggaggatgtgcatggaggaccgctgctcgccgacgacacgtggctgccgctactcgccaactacgcgctgctgcagggcgccgtcatcaacgccgccgcggcgccggcgatgacgacagcctgacaacgtgtggtggtgggctggcggcggaggaggatgggcatggaggaccgctgctcgccgacgacacacggatgccgctgctcgtcgcgctgctgcagggcgccgtagtggacgctgctgcagcgctagtgtccgcggagtggagcgccgggagcagattcaccggcatctccactgacccggccaccgccacggcatcggccatggaagtgtgggaggtgaggatagagagatggaagtatagttggccatatggcccgaggcccgatggcccggcccaagcacggcacggcccggtagcagtcgggcccgtgccggcccggcacgactattgggccgtgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataagccagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcgtcctccaccgtccgccgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccaaatccagccttcctcttcgtctctttcccgtttgttcttcttcgccagatcccttggtcttctcgtagatccgtgagcctatcgtcttcaacggcaactccggtgctccggctgcgcaggtacaagcatggaaccattgtttttattttttttttctccatttccgaccctaaccttgagtgttgttggctgcttgcaggtcacaagcccgttgcttagcggcagccgccgttgagggaccagagtgcctgcgatggatgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgtcgactggctctagtgcgacttgtaccaacaagaagaccaaaacctccaaggtatgggatgactttgaggaactttatgaaacgaccaatggtaatagggttcgagtctctactaaatgcaattactgtcataaaactttgagtgctcgttcttctgctggcactggacatttgcttaggcatattaagtcatgcaaacctagaaagcttgggtctaatgctttgcctcagtccatgcttagatttagtgcaaatggttctgttattccatgggaatatagtcctgaagatgctaggtttgaattgtgtagattgattgctagagaggatcttccaatcagttttggtcaatctcctgcttttgtgaactatattaaggctgctcataaccctagatttgttcctgtctctagacaaactactaccagagatttttataagttgtttaaggatcgtcgttctgttattattgatcgtctcaattctgctagctctattgctttgacatctgatatatggtctggtcatgctaaggaagattatttgagtgttgtagctcactttgttaattctgattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatgatcacccttactcctgctctgtctggttatattggtgatttatttttgcatcaacgctgggcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattggacatgtgctgaatctgttttgtgtttccttgaacaattttatgattcaactgttgttttgtctggtgtttattatccaacatctccattaatcatgcatcacattttagagattgctggacatctaaacacatatggcaatgttcaaaacatcgcaaatgttgttggtcccatgaaaactaagtttatgaactattggtctaaaattccaattctttattcatttgcatttatcttggaccctagggccaagattagggggtttagtaaagtgcttcagattatggctcaactcattggtgatgattattctgcttatttaacaactgttagagcttcattgtttgatacttttgctaagtatgaaaaaaagtttggttctgttagattgcatagttccactattccaggcccttccactggtaagaaaaggactgcatgggggaagatttttggttctgttgttgctgctgggcttggtgctggtaatgcaggtgccagtccaggtgctggtaatgctggtgccagtccaggtgctgggcttggtgctggtaatgctggtgccagtccaggtgctgggcttggtgttggttcattatccaggatgacatctgctactgctttgcttcaggcagcttcttca

SEQ ID NO: 73249 - DNA, 40866 bp, Oryza sativa
aaaacaaaaaataaaaaacataaaaggtccatcatgggctcatggcaaaacaattaaggaacctctctcagacatctgctgcttgtcaacatctttcatgagcctgaggggtatgtatatcgtatttagctccactggtttgcctgaaaggaatgaattgagcatgtaaagagtatgctgcaaaatgcttcggccttgagtttatgtaggaaatgatttttgtagtcatggagaaggcatgatgcatacccgtaggtggcacattcaacactttctcatacttcttcatatggtgcatcatggcacagtgtagagggggaggggggaagtgtggtgtgtgcagacgctggatttaggaggggatatgtggcctcatcactaccattatttacggctctactctcatgcaccttgcgtgtacttttttttttgttattgagtacccttaattagcatatttaaccgtttttggtacatttgtcatgttaaattgttattgggtatggacattgggcattgtcatgttacagcaatgctagtgcatgactatggccgtgctcaacttagttggatacaatcgcaacatagtttcccctactcatcactaccattgtcgatgcactacaacctattgaaaatttggtcataattcgttatattttaatccaaaataacaagataataaacatgatatttataatgggatttgatccattgatagtggtgaatgtaatcaacatgagtatgcttaatgtagaataagcatcaacaatcacataataacacaatattgacattgcgatgaacattaatagtaaaacttctaattgaaataatgtaagaaggttataccccaagaatagtcctccgctggagtttgaggcagtattgcctccgttggtgttgacgggagcctccttctccttgtatccagtgttgccgttgtctccagtgttcaacatattggtgaaggtgaagtagatgttgacgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgcgttgggattaccgtagcagtaacagcgttggaaaaaggatgaaagtgtgtcttcctctttcgcgggagatcaaatccattatcattttataagaggaatggaagatgaagagtaagagtcatggaatagaaagaggaatagagtaattaattctcatcaattagccatcaactatcctccactacacaaccatcaccgatggaataggaagaggaatagagcaactaattgtcatcaactagccataaaccatcctccactacacaaccatcaccaatggaataggaagaggaatatagcaactaattgtcatcaactagccataaaccatcctccactacacaaccatcaaccatccatcaattaggactaattgatataagttaccaattccctaatcaaatggattaattctcaaaactcttcatcccattgatatcccataaaaaaataaattcacatgaattcctagcataatgagccttgaaatttatttgatttaattgatttaaatggatcaattacccaattaaatctaacacaaccatagcaaacccaaatcggactcaagtgctgatatgtgctgctcaggtgcttccttgtgactttgcctgttagtcgccagttcgccattgaatcaagacttaatttagggagcttgtcagctcggagccgctgtggcattgctagccacgtctgcattgcactgcgttgtgtcgtcgcccgtcgccatgtcggtcagcccctcagcaatatgagaactcctccttgctctacgagggccctgagacgaaagcgctggcgtgaaggaggtcgagtcgaagcggttttttttagataatggaataaatattccggcctttgctcattagagctacaattaattattacaaggaatcacacaaacactgagtaaaatggagctacacagcgtaggtgggaccaggggcaggaaggtgaggtcatatttatagttgagctttagaatagggtcaaataagcaattgtcttataaaatatagatgttgttctgtggtgacacatgagagccatatccggtccatcttgacctctagatcatcatcaagtgttactgacgtggcacaccatgtctacccaaatatgatgactcactcgatcgggttctcatatcgcacgctccttttgagcttaatagcgggaaaccacctcattaacacaaacaaataacatgtttaggtagccaaacccttgttcccccacctttttttattcctggtccaccaacgccacaaatcttgcacctgacgtgtccaagtctagagccaatcgatccaggtagacctgttgtcggggcccatggaagctttagttttggagcttaacaagcgtgtcaaaaatctgactttgagcctatttgcttgggcccactccaagagtggcgcttagagtgaagtcgtggagcgacttagagcagcgcttaattgaacttttagctcaccgagatatggagccagagttggagcttaccaaataaaccctttaggagggaagaaactcccatgtgttcttgcatgtttcataaagtttactttctctataccataaaaaattaacctaatagcagatgttgatatatcgtagtattatgaatctaaatatattaggtagttttagctctggttaacccaattaagctttactactatgaaatggtaatacacacacacaaaaaaaaaaaaaagagaagtttcattcttcgtataagagcaaattggtaaaaaaaaatgatgattggctgtgatgggctccaacaaaagacactgttgaaattgggcgatagatagaaacgtttactgtccaacgtgaaacattattaattgggtgtttttgcctaattatgctcaactgttttttgagctatcgttaatattattcgcgaagcggcatacttccatatggaaaataatttataaataaaacttttatatacgcgtacttagcgatataaaattaaaggctaaaaaataatcttcgatagtaaaaatctcaaaatcaagtctaaatatatttaagattgaaaatttaaacttttactaataaacataaacatatgcgaaaagttagaggccagtatacgttaagaacaagggtagatcaattcaaagctgatatgatgattatttggaaagatggttcactttaggtagaagggacagtagcaatatttatttttggtaaaatcgcccagtttatcacggcctcacgggaaaaatttaaattttcaaacgttgttatgaacttgtaattttatttaatataacctagttttcaacatttgattctaataatttcttaagaacacaaatataaaaaaatatttccaaattaattttaatttttagtaaatcaaaccaatgagtctgttggtgcgttacgacgaaatcactacacagaactgttaatctgggcgggctaacaatcagctcattcaaaataactatcaaaagtgtacaacgaggaatggttagatatcgtaacatcgcgtgttcttctcgatgggccagaaatttagtgtgcttgagagcgacgtacaaaaaacaactgcaatttccaccgaatttcattcaattctcttcgaaacttgatttaacttacaaaattgtaattttacatagttggtaggagatttaacattgcaagccgtcaatacaaatgtttttactaatgggcgagtttgtgcagattcagatttcctctaatgggcgagtttgtgcagattcagatttccgtcaagagggaagtccgtagatttgaattcgaatacaccaacggagtttaaatcgcgcaaggttcgaagattcctatttccataaaaaagaaaggtttgtagattagagatagaatacaccaatggagtttaaaccgcgcaaggatcggatattcacataacacagaaaactggattccaaaatagaaagcagatgattgattgaaaaaaaaaggaatggtttttggtgctcagattctatgggtgtataggagtcgatcacgcagatctcccatcaggacgaggaatgattttataatcactgcaccacaaccaaaccatctcccaaatcaatcgcacaagatccaaacagacaaaatgcagcaaaccccaagaatttaaagatagaagagaatttggaggcgagcgtaacccaatatccaactggaaaacccacggatgagggctctaagcgccacctgatttcatctcgggagctttcaaatcgaaacgagaccgagatccaccctagacgacggtggccggcctttgggacagtgctcccatgaacaggtaaacatccaaattcctatccaacgccagatgaaaccaaccccaaaaaacaaaaaacaggagaaaaatcacatctcatctgaatgaaacaagatcgagagagagcaacagagaaggagagcgtgccgccgcgagcgcgaggatgaggagatggagaggagagaggcatggtggtgtttatataatggcggatggacgcgtggaagccctagccgacgggttcggcccatgggccttattctctcttcgtggatagaaatgggccgaatatattaaagatttggaccgaaagtgttgtgcagggtgtccaaatagccggcccactatttatttgtactatattttttctccgaaaacaaatggagagatattacgaaatggagggcatatcagcctctctcaatttacataatacccttctaaaacccatatttatactcctcctaattttcgagaaatttgaaaagaaaattaaggaacttgaaattatacgcattaacttaacactagtcgacgtgacgacggaaaccttcaagctactaccattccttcccatggtgctttctctctttctcctacgtcatcaacgacgccacgccgccgttcgacaactgggccggggcggcgccgccgtgggcgccgttcgccgtcgagcgtaggaggcgggacagccctatcagcacggcggcgttgcgctgcgcctcgccgaggcggcgccggagcacgcccgcctcggcgtggtgccgcgcgttcgcgccgcgcacggcgagcgcccgccgcgccgtggcgtccagcctcgacgccagcgcgcgccgctcggcgcggagctcgtccgcggcgcgctccagctcctccacccgctgccgcctccgcgcccgcgaccgccgcgccgactcccggttcgagatcttcctcctcagccgccgccgcctctcctcctcgccgtcctcgccgccgccgccgccgccgcctccgccgtcacagtacaacaacacatcaccaccaccaccactcccatcgccggcacctaccaccggcgacaagccggcggccgcatccgaggcaacaccatcgtatccgaacgccgccgcgtcgacgccgaacaagccgaagccgacgtccatgtccgggaggccgaagtcgagcggcatggcgtcgtggagggacagcattgcggcgatcagggacctatatgtaatatccgaaaacttgtgggttcgaagcgcgagtagttggggttggggaagagggggggagggaagacgaagaaggcgagggttatttatacacgccaaaggccactcctacccacgagcttcaggtgggcccgcttcaagtggggcccactgcgacgtggacgttgtggcgattcggccgtcactttagtttcggcgcggcgaagccgacctcctcctcgtacgtacgtataagtgtacgtatacgtacgcctccgtggcgggagagcacgtattgtacgtacgtattggaatcgacggctgaggagggaggtcagcgtgtggatggacggcggatgatgtgggtgatccggtgatctctagcttaagagcgaagtaatggtggggatgcaacgggagggacacgtgtagggctctccttcgtcgctgcacttcaggtgtttgctttttagggcttgttttttttgaagattttctttctgtttttcttttcatcgtgcaagctttatatgaagctagctatgagcccatgcaagatggtatatattgctatgtgcattgcgttacttaatcctctacgcattgaatgtacatatcactgggactactttcctaggttttgcaagaaatttacaggattatatcgtacaaattagttcaactcctgtaaaaatttcttcaagatcaccttccattttattttaaaggaggcttcttagtactacctccatattttaatgtatgacgtcgttgattttttgtccaacgtttgacccattcatcttagaaaaaaaattatataattatcatttattttattatgacttaattcgtcatcaaatgttctttaagcatgacataaatatttttatatttgcacaaaaattagggagtacatttttttggtgaccaaagagtataggaatgccgtattgataaaactaaggatcaaccacatttcctagtcaggattcagttggagaaaaatgtagacacacgaaccaaacgtagatcggacttgagcgggtgtgtgcgtatgacggggctatgtccaattatgctagtggagattacaataacttaaagtgttctaaaatcccgatggatagtggataaaactaagcttgtaacaatcatgcgaggacacaaataaataaattgataatattaaaaagaaggttgaaagaccaatgcaatgtaagatatagtttcataagaaatgtttatttagtgaataaagattatatatgtaaaaaatgtactatttaggatcttaagatgtttttaattaatccgatgttgcattctaagtccgataagttgcctctctttgggggggaaagagagataagaaagcgaagaagcgagtcaagttggctgctggttgaatacaggcgggcatgggcgacaacgatgcaaaacgaatatcttcaaaaccagtgaatgcaagggagcgattccctccgttaatttattccgataatatctaacatctcgatccaagttactgtcattttttgttttttgagctatctaacgatcgctaattcgctatatatgcatgtaggggcgctttgttctaatatgacccatcaatctatttctttcatctcttttatgtgttgcttaccagctataaatggctaagaggttcagtgttttgggttataagcttttttccctttctcaaaaagaaaaaaaaaacatgacaacgttagattctttctttctgtgatattaactgctactatgaactttatagtatatatgatatagcaataggttttatctctgtcggctgtggtattatatatgtactaagtgattccccgagttttgcttaaagaattcctaaatattttttttaacaaatgagctaaaaaatatattagttattaacaacaaataaaactgatttgtcaaactatgttcagagagaaatatatttagtacactctgtataagattgtagatgaaaaatgatatcccacactttggttatatatggatgaatatatgtttagtattataaaaatgatggatatatatgttaaaaatattataaaaaataatggaaggaagatgattggatattgatttgtagaattcaatgaataatagatgatgttacatgtttgcataagttttgtatgttactattgcttatggatgatgaggtagaatgtttgcatattgagctttagatttaggagtcctactccggtgctttctactcggagtagaaagtaatctaggccctttatcatatttaattatagggttaagatctagttctactcctaccagaattagtggaagtagaaatgtggaggggtgtttttgtccaagaaaaataattcgcgaaggggtattattgttttctgatccatagatcgatcaccatgtcatcctcgtcggagttggtcgtgcaagatcttaatcgatccatgtaatccatgaaacaacacagtgatcggaaatggcaagaagacgaatgagccgagacgacgccgccaagcaaatgacattgcgtgcgtgcgtgacactgccgccgaagcccaggccagaatttttactaccgccagaactcctgctcaagatcgtcgctcgctcggacgccaccacactcgtctgctcccagacggacgatgcgactgaggaagcagacaaggcggcaaaggcggggaatacggatggcgacggagggggcggacaaggcggcgaggccgggggaggaatagcgaggtgactgcgtgcaacggagttcggacctgatacgatgcgaacagaagaaaacatcccatgccaaaattacccctaaacgatattaggagattacttacctgccctttaaaataaacggtcaagattaattctacttggagtaaaatactgcaagtagattgcaccggagcattactctagatttagtgggttataactttgtagtaagataggactctactccctttatcccaaacttcacatccggtactagatttttatattttaggacagatcaagggagtaagtagtttctttaatcaacctatgattttgttgtttgcgcttattcgatgacctaccatgcctctgtgataattggttatagtttattttgaaacaaagtcggaatgaatcttattataaaaaaaattatatcataacggcatatgtataaatacttgtcaatgatataatgtaggagtacgttgttaacaccaaaagcacatgcatttcgttaatgaacaatcattagccaataataatcagctttcgacttgctgtaatcttcccaccaaacgtatctcaggtaggccatcctgaagccccctgaactacacttggcttaattctattcagagatagctaaagtgtgtttagtttccattagatagcgtgttaagggcccaataactttttcccaaaaccatcccattgaatctttggacatatgcatgtagtattaaatatagataaatttaaaaactaattgcacagttagaggaaaccgcgagacgaatcttttgagcctaattagttcatgattagccataagtgctacagtaacccacatttgctaatgatggattaattaggctcaaaatattcgtctagtggtttccaggcgagttatggaattagttttttcattcgtgtcccaaaacccctttcgacatctggtcaaacgtccgatgtgacacccaaaattttttttttcgcggaggccctaattccctgatggacgagcagcgatatgatggtacatcgatcaagcagaaacttgccacgtggacaaatgaacctgacatatgcatattggcttaattaattgattagttattttgttagattaagtgttgcatgctgacatgatatactgcaaaagtaatttcagaaaaagaaaatgatagtagtacccaaagaaggagacaggaaacaaccgaatggaaagtgccctttaatcaattattatttgtgttcgtcaactaaaactaattaagcaagccgtaagtagtactatatgagaatatatacaaaaagctacagcaaagttgagaattatttgagcaatgggtgcacttggtactgtatacattatggagcagcttcctcttttgggattttctttgcttttttattttctctgaaatcatccaggatccatccgatgcatgcatgaagctttcacgccacaaaattatactatccaataacgaaactaattaaaagatctagctagttaattagctactagcgccgaaagatcgaattgcatgtattgatcttcagttcatcctgaatctgtcaataaatccaaaggaaataattgtactactgatctgttagaaacttaattagaataaactgatttacatctatcgactagatacatatatacattgtttacagaacatggagctagctaggccggcttcaaagttcagattcttcagatatctcatctgaaaaaaggaattttcagtattcctggtcaggtgaaggacacgcaggggctgagctctgctttgcatgcatatgttcgtcaagaaaaagttgtattagtacttgtaatatacacgtgtcctgctcatagatttgtagacttctcacctgtcatctctgtacatggacacactactactgctactgctagctgatctatcctgtttcttctttactggaacttgcagctactagctaacactagtactctgctccattcatggtgtcatcgacatataatcagttcagattgattatgagcatgagcatggaaggttcttataaaataatcaaaaggtaattgctttctaagctactacaacttttgttattatggatcatgcatcatcctttgtgatatcctctctctttcctttagtctttagataacaatagataggagcatgatgttttggagacaatgtatatatgcagagcttaagcagcttagatagatatggccatggaaattcagatatgaagctgcagaaggaaggagacaggaggctggtagctgctgtgcgaaagccaatcacgagggccctagctaccataccataccactgcatgccaatgcaaagttcagcttcagatcggcgtcacagtcagagtatcacttggaaactgatacgtggcaatgcaagaacacgggttcagtacctgcaaatgcattgtgtttgtgacaatttgtggtgcagggttccttggcgatcttgatctcggttggtccctgaatgtataggtgctaggtctctttctcgaggcttttggcattgatctctgcatctgcatgttgacacatgtcttcttgagtgtcttctctttagtgaaacgggaaaccgagcagcatgcatatatgggtgtgatgttgaggaatgaggacgatggttcagatatgcaggttagaacaggtgcaatagcagactattagttagctataaacatattttaatgagataaaagatgagagagaagagcagcgagctacagatctatagccagctgcagcacgaactataagacgcaatgtgtgtatgacatatgggaccatatattaatattatagtaagcaactattgtatgacttagggcctgttcactttgatgccaaaaaaaaccttaccaaatttttggcattgtcaaaattttggcatagttaccaaaattttggcaacttacccgaattttggtaggatttcttatatagttactaaaatttgatagcaaactaaatgtagtcacttttttgacaactttactaaaatttggtaaggttgaaaatggcatcaaagtgaacaggtccttagctattagattggctatagatgaattggagctagtagtgggctatactattaaacttgctcttattgaaatgggacagtgcagaatggacaatgcaccaactgctgcagcaaacagaagagtgcatgaaattgcatacagattcagagatgcagacaaagcagatggagaggagatagatagtagtatgctttgtgggctggaatttctttttagcaataattggaggcccattcgattcacagaaactgttgcatatgcccccaactatgcatgctctttcagtcacctcttgcaacaggtaagcaaacacgccctaagcgaaaggtggctaattggcgcagctgcgctcacaatgtacacacgcttgtgcacccttgtactctcgtgtatttcctcagttccaaaacaaacggacagtgatatatcctaatactacgaatttgaatatgtgtgtcactactagaaaaaagatatttcatggcgtcaccctattattttctttggcggctatacgtaaaaaccgccagcaaaaacataacgaggggtgggaggctacggaccgccagcaaaaatagattttcgctggctgttagataaaacgagccaccagcgaaaatatagcatcttcgctggcagtgcacttaacacaccgctagtgaaatgtacaatcttctctggcggcaggtagcgtgggctgccagcgaaaaaagtgccgacgccagcgaaaaaatccaccctatttaaaatctatccatagctccaccacccaccctattaagaacacgcaagagatatttcctaacacattcactcctcaactccccctctcccgtctcctcttcctcaccacccactcacgtgcagagctcctctcagcaacgggaggctccacagctctcggcgacggcgaaggccacggcggcgacggtaggggggaggcggcagatctgacgatggcggcgacgacgacgtccgcgaccgccaggtgggcggcggcggcgacgccaggtgggcggcggcagcgacgacaaccccaaccgtggcggcgacgacgacgacgctgctgctcccctcccctccccccaaccgaggcggcgacgacgaccccaaccgaggcggctcctcacctcccctctccctctcccagatctaccctcgggggtgaggggggagggggcggcggcacgagaacaaccgtgacgacgacgaccgtgaccgcggcgacgacgacaacgacgacgacactgcgcgctggccgggagtgcggatctggcggctccttcccttccctccttttccctctcccagatctagctagaggggacgaccgcggcgacggcaggtgggcggcggccgatctgacgacggcggcgacgacgacggccacgaccgtggcgacggcaggtgggcggcggcggcggatctgaccgcagtggcgacaacgacgaccctaaccatggcagcgacgacgacgacgctgccgctaccggcggctcgatgcgtggccggtggttgtgatattgatttttgcatgttgaatgcttgttgaaaatgtggtgaaaattgatgtattgttctctgtatgtggatttgagtatggatctgatatcgatttgatttgattttgattttggattgaaaaaatgcagctgctcaggatgtcgattgcttttttttattgggaaaaaatcttttcgctggcggttctcttaagggtccgcctgcgaaaagcgaaaatagattttcacaagcggttctcttaagggtccgcttgcaaaaatagattttcgcaagcggttatattaagggtccgcttgtgaaaatatattttcgccggtcctcttaagcgtccgcctgcgaaaatcgattatcgcaagcggattgcaaccgccagcgaaaatattagatcttcactagcctttactttgtggcggctcggaataccgccagcgaaaacccaaaatgactgccacgaaaaatggttttcctagtagtgtgttcagattcatatatcacatcatgcattatattggtttgttttgggacggagggagtagatcactcatgaaccaaaataggcatgcatgatgtttaaagcatttttttattaagcggtttagaataggttaaaatttataagttgttaaaattttctatttgaaagttatttttggattatttttttaaaaataatagttttaagtcatttttaatacttattaattcaagtaagaattttgcaataaaccttttcaactgaaatttttattttagatctggaattcttacaatcaaatttaggatactatgtataatattgacactaagtatgagttatgactcagatatataaggcctcaaaagtaccaattaacctagacgatcgaagttaaatgaaggcgcaaacgggacttgtaatattgtcaaacaactcaagcgatgaacatgcacatgtgtcaaaagggtcgaaatgtcgatattaaggtttgttcgtatcgacgacttaaacttccgtacgacgtcgaaagattaatttgaagattcaaataagcagaaactaagcatttttctagatggatcaaggaggatagggacaaataaaataaatactatcaactttatagtatacacagagtactcgaattaataattaatctatgaaatgtatagtcatgcgatcgatagacaatatattcaacgttgtactcgaatgcgttaatggtggttgtgccaaaccagattaacgtaaaacagcccggatcaaaagagttgaaaagctaaaatttcttaaaaacgcaatcaattgtgctcaaggacaattaatttaaatcggcgggcaaaaaggtccagattaatgcattgcagagtgcttcttgtagtactttgttgcatcgcgaatattaattaacttaggaaactaaatcgatcgtattcacagtttgaaattaatttgtatacgcaaagcatctcattcattcgccaaactgtttttatcttctccgttttggatagacgatgaggacttatagcacgtacgaacatattctctgatcttggcatgcatgcgcctacgtacaaccttggtttttttactgcacatatcatcgagaattttttactgcacgtactgcacattttttactgctccgttcttaaatataaatatttttaaattatttaacaaagattaataaacaaaaaaaatatttttcagtcgtcttattagttaatttttaaattgcttatattcccttcttaaatactaactagtctgaaaatgtttgaattccccttattaaaagtcggtgttccaaaaatggttatatcatgtcaaattttttgaaggatatgaaataaatccgacctttatatctaacttgatgtgcatggtcaatattatgtttatgtacaactttttttttgctaaaagcttaaaagtatttgtattcggtggagtagcaaagatggattcatatcctacacatgttataccagtacgtgacaacaatattgtcatcacgtcatatagtatagtatatggccgagtttctcacgctaaatcatgcaaatatacatacacacatatagtcagtggtggccacaagctgtagtgtgacgtgcacgttggtccaataatagttataacctggaacggatggagcattaaaatcggtgctccagaaatacttatgtacaaattctttttaaggatataaaatgaaataaacccgacctctatatctaaccgatatacacggtcaatattatgtacaaccttttttaaaaactttaaaagtatttgtattcggtggagtaggaaagatggattcatatactacatgttataccagtgacaacaatattgtcacgtcatatacatacatagagccgagttgctgacgcttaaaacatgcaaatatattgtatatacacataatatgtagtcagtggtggccacaagctgtactgcgacgtgcacgttggtccagtaatggtttatgcttgttgcatatgcatatgtgccaaattgttgccggccgttgtacgcacgtgactgacttttgtagtctgaacgtacacgaaccggccggatcctatattgctcaagccttttcttttctaccatgcatagctggcttggaaattaactgaccggccggtctcccattaaccaatcaacgacttgtgcagttgatttggtccaaaacagagtaaattttttaagttataatttatctatttttactatatgtgcacctcctcagtgtaaacttaagcacccacgtcagcttaaatttggtccaaaacagagtaaagcaaagcatgtggcaccctctctatttcactctagcttcacccctagcagttgttctctggagtagctggtcatataattcgcttataaaagatggatgagatagtgtgctactgttaacttcttcttcttcttcttctttttttgggagaaagggagagcacctcccccgttttcattaacgaaaacgcaacgattacagaagttccagagtaattcaccgcaaaagcaaaggaaaatagaaaacgattatagtgtgcaattgttttataacttcttgatgtagtaatattgttttcgtttcattgtttttctttgagcaagtcgaattagagtcgtatggtagtttggagtctaagtactcgtttatgtcaaacattggttttgtctctctatgtgtaaggagatgaatgttgagtctagaaactcttgtatgtttggttggttgtgtacatccgtttggatgtaggctggtttaatccattatctaaaaaaaatagggaccgcacaaatatataactttgtaaggtttttctttcttttgccatgtacatcctggttgaatgtaaaagtcacgttttaattaatccattataacaaaaaaaatactaaccttgtaatctgaaagtacgatcataactatgtataagtaagtactctaagagtggatcctgaaaagaaattacggtttactagtgtttcggtatcaagatacattagtttcactcggtaaatagtatcactttcattcagttagttatggattttactagagatcgtcgtactgtcgaggcttgttgaccccgctgaatgtaccgtagctccaccgatgtgtaacacatagcgcaaagtgttctactagtcgatttgatcatctccatcgacattacttgagaaacgcccaggggtcttctggctagctccataagttgatgggctagacaacctaggttcaaagcctcacccttctaattatttgatattaggttattccctgatattcgcttccatcgacattacttgtcttggtataagtacacgctaggtaaagtctctatatggcctatgcgtacatatgcagagatgcacgtcatgatctcgatcgtactgatgattcagtgagacactctagaaactagatatatttgcattaaagatttagatatatttcagatatgatcaatatcaagtcataaatacagcaggattttactcttgccttgaccaacatccaatgagatcatcacgaaacaaacacgcccacaacaaagggtggctttaaatcacaaatagaaataaaccacaaacgacacgatctgtagaagtacatcaaacatagcctattacgcatacctaataagtatttatatctatcaacacgtgcgtaaaatcataccttagatagatcacatctttctataatttgttgtcacgtcgcatcctctttgggggcaccgctttggagaaacctcttcgtgcaaggatattgtcattggtctatgcattggcttcgaactttagtcctaggcctggacgaggccttctagctccacattttgttttgcttttctcagtttgggtcatctcttctcttgtttgatgtgttcaacttgtcttcgaactacactctcttctggagtggatctttgtaataattggctatagttctttttgagcaaaggccgggatattatattccattatctaaaaaaatattttgtagtcactaaaaaggaacacaattgatttttcctcccactctaaaaacctcaaaaaataacacccgcgttgtctctcgctggcagcagtgcctatgagactatctcagaaggtaacgggcagccaccgacaaagcgggcccacaccaccctcacgttgggcccacgtgtaggtagcccccatacacgtggcgcgtcgtggaccgtacgcgtggcacatttccccccgcgtggaccgcgcagatgattccgatcgctcgcgtcagaggagtcaacagcgccgtttcgtcgtcgtcggctttaaatacccccgcgccaccaccaccgcttcctcctccacgccattactgctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggtacgtatatatacgcgatctcctcgacctcatctcgtccttctcgttcatcatggatggatgcatgttcgatctgatcgatgattgagaatgaatgaatgaatctgcaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagacagatcgatctctgcttgaatggtacctgtcccaatttcagactttcagattctaattacaacgcttctgattgatgagatgctttgaaacgtaaattacgtacagtggcatgcttggatagatcgacgaggaaaatccaactgtgtactgcatggttgaacatgtcaaatttggaccatcggtttcgaggaatcatgacagagcagtactactacagtagtaccaggaatttcgcagcatcttttgcaattgattctttaccatgattggactaatttcgattcgcactaggctttactccattccattccaatttggttcttggccaattgctatgtaattttattttttttaagataatgagttgctatggccgagtttatttctaaactttttcttcaaactttcaatttttctatcacattattctaattttagcgtgaactaaacacaccttatataatttctacccctatgtagatcgcacacttactttccacccctatgtagatcacagacttactgccttatgacttcgagagattagcgtatgtggaccccatgattagcggactcatcttagaggatcgtatgtctgggagtccattcgcaatgatttggctattctagcccatttccactctcaagtacaggtgcaactagtgggtcgactcacgattcacaatcccaattatatgccaataaatacccaaaagtatatttctaaaattttgtttttgaaattcctaatttgattctaatatgtagatagatttttatcaccaagagatgtcttaaattaagtcccaacaataaaaagtgtacctaccctaactaacagaaaaaacaaatcgctctgcccatcccctcgtcacgtgcccacgtccaatcctcttgtcacgtgttgccctctccttttatatatggaaattgggagcgagagtatctcctgacatgtggagaggacagagaaggaaaaatagattccaatttttgaatacataccaagagaactgtaggagtaagttttcacaaaagaaaacccaactcactcggggacattgttgatcatgctctaagtgtgttcacgggtagattcacttgaaccactacctaaaagtctcaacttacagcaccaattgtttcccagactgcaacaaaacaaagcaaaaataaagtctttgtgggacggagggagtagtatatagagacaacacgtatatataagcttgtaggtttttttttttgcgccatgtagatacttgttgagtgtagaggccacgttttaattaatccattataaaaaatttataacctttgtaatttgaaagtatgatcgtaactatgtaagtaagtactctaaaagtggatcctgtaaaaaaattacgatttactggtgcatcggtatcaggatacattagtttcactcggtaaatagtatcactttcattctgttagttatggatttccctagagatcattgtattgtgtctaactctaaaacttcttatattctgggacaaagggagtactatcatggtatttatgtctgcatgtacttaattaatttctacccctatatagatcacaaacttagtgtcccttgactttaagaaattaataagttgtgggccccacgactagcggactcatgtatgttagggagtccctttgcaacaatttggctattctagtccatttccactctcaagtaagggtgcaactagtgggtcaactcacgattcacaaaccccacctataggccaacaaacataaaaaaaatctatctctaaaattttgtttttgaaattcctaatttgattttaatatgtagatagatttttacatccaacggatatcttaagttaagttccaataataaaatgtggacccgcatctaactaaccgaaaaacaaatcgctccgcccatccccttcccatgcactatcctcttcccgcgtatctagatatgcattcaaaaataatggattccaatctttgaatgcatatctagagattgggagcgagagcatctcctgacgtgtcgagaggagaaagaaggaaaaatggattccaatttttgatgtatatctagagatctgtaggagtaatttttcataaaagaaactctaattttaaaattgggtttcacttagggatattgttgatcatgctctaagtgggttcacgggtggactcacttaaccactacctgagagagtctcaacttacagcgccaactgtttcccagcctgcaacaaaacaaagcgaaaaacaaaaccatttcaaaatactaatgtacggccatttataaagcatgatatcagatgctccaattactcacaagtaaacaagtctcttgcagagttgcagtactactctgctgatgcaggccgggtcaccggcactacatattctggatggatgcctgaaacagtaggaccggcagcggcgacctcgctgacaagatcatcagcttcaaataactcaaaaggagtttttgtacaatagctaactctgccattagattctggccaaatgaactccatgacaagaagagccattgacattgctcatacccagaagaggtcacactgctgttgcaatataattcagtatagtattacatgacgttgacgacacactgcctgcttagatacgtagtatatatacatacatgcagataagcattggattggattgattgcctcctgtgctacacttgcttgtctaatttattaatccgatgcttacatgttcatgtctcaatcagacttgttcctttttcctgctgcaccaaaaggaattattgatattattatcatcaacctgggtgttagcttccgtacgtcgtctaaattgtaagggattgtcaagtcagattagaagcatcgtctgtaagagagattgttagtttgtaattgattgcacgagccatcggattacctgcatgacagtgacaatggagatgacttgactacttgtgcgtgtgatggccgtatccggtctctagaacggcacacatccatttttccatagcaactcaagaactgcagcttggtggatgaaagattgatcttgacctgcatccaccttcccttatctctgactgatactcccaacacttgtgcggatcatgacagcctgcatgagacacaacggcacagctgatgggtatgcaggtaggaacaggcaacctggttcatccaaggtttatgaaagaaaatgcaaatggcactatggcagtcaaacaatcttttattttgaaaatgaggttggtactgtacaatttcttgcaaaccgaaatgtagggtctgaagttgaggagcatcattacctgtagctagcctgtcgattctgcacggatttggtgttctagagaatggcgcggacctgaaataaaaaaagccagcatagaaaacgacatgccaatctgtgttcaaggattcaaacctgatttgagaaaattctgaagctctccaaatttgacatagcaatcagttgtaggataggttccaacacctctgaaagttctttgctaacctgcagccactagaattttcaatgcatcagttcacgtagttggacaatacaatttgaaaacatgacatgtttggcaccttgctggctgttactccacaactcagcaacaaactgacagatgcgatctagattctagaagactgagaaaagcaatacgaattagatgcagctcagagaggagggaaagaaatgtaagtgtgaaactaatttggaatcggaaagcagagctctctgtcaatcatgtgcccgcagcaaacattaactcaagcttctaaggaaagaagtccactctaacaatttaaaaaagaaatgatgcactccaaaaggttctctaggttcattccagttcaagaaacctgttaccgctacaaaatcaggtttggcatgaacttccagaaatccaaaccaagggccatgacttagggtgtgttctttagtcaaggtttccaactttacctccatcattttccacgcaaacggtgcattttttgccaaaaaaataattctatagtaaagttactttaaaaaatcatattaatccatttttaagttcttttaagctaacacttaactaatcatgtgctaatctgctgctccatttccgtgtgtggatgattagctcccaacctacactaaacacagccttagagaaacataaacagatgtagtgaattagtatggagctgtacaacaattacaaattgcaacagataaaaaatgttaaaaggggcctcaagcccaactcacctagccgaaaatacagtagtatattcctcaataaaaagcagagataaatccaggaagtactaacacatatgactcactgtcaagcaagctgtaagttttggccaaaaagggaagagttacaacctagtgtaaaaaaaaggaaggataataagttacaaacttccattacaatacattgtctatgcaatccacatcagctgaacaagcaatcaaatgacagatgatgtactgaattaggtctgaccaactaaaacaattgccatctcttcactttcactcgaatagtttgctgatctatgcagattatacgtagctaaatgagaagtggggacagttaacaataatatgctcagcagcagttgagcgaaacataaactagcctatctcaagcatcatacacaatatagtcaaacacaactaaacatgtttgtgcaaaagaaaatacatctcaccaaaagatatcagcaataatacaagcaaagttactctttcagaaattttattagctgtatgaaggtcagaattgttacataacgttatcaactgaatcctctctgctccccgtactcccttttacatttacagcttcagtatatcctatactccattttttctgtacacaacaatagatgaaaatcttacagccataaacatcataactgatcaacagaagcaggctcaggccgggtcatgagccatgcgccgttcaacaaatgcaagcacaatgctatgcagattgcagcgataaccatggacctttcgctcatgtgcctcaaggcacacaatccagccccaatcgcggcatcacccccagccctcgcgccttcatgaagtctccacatcacaaagtcgagaaacgatcgcactgcctcaaatgttgccctcccagtcaaatccagcacgagcctccggttgctcggcaccgcaagcacggtcgacaccgtctccacccatccttccccatccccaccattgccactaccactaccactaccattgttactaccattttgattggaattggcattggggttagggttagatagtacactatgggatgtttttaccagtgtctccatggaggcattgcagagtgcgacgagaagctgctgtagcctggcgccataggaggggttcgtggcggcggcgaagagctggtcgtaggtgttgatgtggatggtcttgtctatgaacacccccacggcggtggccgtgaagacctcgacccagctgcggatcgctctccggcaactcccggtggtgaccacatcgacccagctcggcgacgacgagcccgacgaaggatcggacggggcggagtagtaggcgagcacgagctggctcccgaagctgccggcgacggccgacgcgaggcgctcgccggaaggggataggatcctgtcgagcaggcggtccgagaaggccgcctcgtcaccggaggaggaggcggcggcggcggtggcgtaaccgcggatcacgccggtggtgagggccccggagagcgcggaggcggaggcggaggcctcgggagaggaagcgagcttggagagctgcctgaccgtgggggggatggagtcggagtcggagcggaggaaggcggcgaggtcggaggccacgtcggcgacggcgtcggcgagggacgcgagggcggaggcgacgcgggcgatgcggcggcgccgcgcggcgacggccgggtggtggtataccaggtaggcccccgcggaggcgcctgcccacgcgagccagcggcggcggcggcgggagaaggcgagaaggcggtccatggcgcggcggcggcggcggccggagttgggtttcggatggggaactctgctcaagggctccatgagtacgtggcgtgtggtgatgggtagctcgcattttcttttttttcttttttattttttagagggatagtagactcgcaaattggatcgtggaaaataaatttggatccaatttggcccaatacaaacttctattattccatttaggcccatcttggtgggcccattcgagtttttaaagtctagaacgaaatttgcaaagtggttaggccgaattttgaccgcacacggggatttcgtacctaatttggcccgtgacagtttagagtagtgacagatgagaagtgtatctaatccaattcggcccgtccatttttggattcttaataagagtatttgtaatttttaatagtactcattccaaaataaataaataaatagtactattctgtatgcaatttttgtcaagcactgtataggagtatgagatggcaagagatcgggttaaacacatcatgcactaagatgtacacgtggacgcaggggattggtttggtgaacgcatcaacagagatggataatgcaagtgggttctgtgggtggatggcagctgcagctagtaaagtctccgtcactatctgctttgtcaacttaatctcttcttcttttgtgcatggaacaacgcgtggattcattcagtatactggttcgtacactgaagtttgtagtatattttttgcagtattcaacggaagatacacatcatcatcatccatgcgagagattttcttattcttctttttttccgagatatgtatgtgccaaaagtcaaaaacagtttcgagttgttctgttgtttccgatggatttttgttgtttcctcgattagctagtttagccggtgcgcagcaatccacttctgaatctgacagacatgttcgtggtttctgaatgagaatgaaaaaaaaaaagaaacataatgctttatgcttaatgttgaagggtctgacataacataagcctgcaattttctcctctccgtaactccgttactgcaggcaggttcaaaccctctagatggagtagtaatttgtgtgcgaaaatgcagtagaaatgacggtaattagtgcacgattagtcaatcgaatcagcagtattaacggcaggcgatcgatcgccatgtccgaggtgagcggcagcgacgacgaagggcttgttttggagtcccgagccggccgcccggcggcagcgtaggcagatggtcggccggcagagtcaaaacaaaagatctcgccaacaggaaggttaaactttggaatttatctatcactcgtaaacctcgaaaacacaatgcctctgaataagcgagcgaaattagacagccagtcaggcaggtccagattccagcaacgccgcatttacacgggaccagcaatttgagctctttgttttatcgtctctgacagcgtcttccaaaccaagaaaaaaatgcatgttaaggtcaggtcaggccaggagagatgagcagtttatcattttgcatcagactcaacagctcaccagttatcaacatccacaataacgctactagtagtggagttacctgctaagtgtccatcagaaccagatagctactaagagtcctgctccctcaattctaaaaatataagagacaactaccattgatccaaagataaagaaataattattatcatcttattgttataagtataaaacctgtttaaattgtagccaaaataaaccttaccaaatttttgcaataccaaaattttagtaagataccaaaattttggcaggatttcttatgtatttagcaaatttagtaacaactaaacgtagacatttttttataactttaccaagaaaatggtatggttgaaaatgacatcaacgtaaaccgaaccataatgtatggatccaataaaatttagatttaaagataaatgataaaaataataatttagtgaagataagatgctagttaattgattatacgcatacatgtttttattgtagttatgccttatatattttgggatggagggtgtctgttcaggttaagattgaacccacttagagcaggtacaatagcaggctataagccagctgcaaacatattttaaggagataaataaagagagagaagagcagcgggctacagatttgtagccagctgtagcacggactccaagacgcagtgtgtgcatgacaggtgggaccaggtattaatagtgtagtatataactattgtatggatgagctattagattggctatagatgaattggagttagtagttggctatactattatacttactcctactataagcttatgtgaaagagagatgtaacaaaaagttaaggggtgttggctctcatgcaagagctagcttaacacaagctccaagacaaatacaattaatgtataagtgagagatagagagaggagaagaaaattgtagccaaccttataactaatttattatatgtgttggctttaagattaattaatagtaagaagtgagtcctattattatccctgctctcagtgactgacaggcagctcaaccacatcgattcgccacgcagcaacaccacttgcaccaccgcccctcgtctcagctcatctcctcgtcaaacttcgctttccccaaagtcttcctcttccctcctctctctctctctcccccatctccatgccgccataagtatcagcagcatcgcacccggaatcggaatccccaaacccaaccccatcaccccccaacaacaagagatcatcgaagccccaacaagtcgcatgacatccatggcgacgccgccgcccaagaccctcctcctgctcgtcctcgcgctatccgtcatcctcgtctcggccaccgcgttccaccaccaccaccaccacgacggaggagccgaagctggaggaggaggaggagggggaggcgggttcttcgaggtgccgtggttcggcccgccggggggaggcgggtggggggcgtggggagccggctacggcggcgccggaggacacgagatggcgcggccgtcgacggtgtgcatggagaagggcgcctgctacaagaagcggctcacctgcccggaaaagtgcttcaagtccttcagcttcaaggacaagcacggcggcggcggcggcggcggcggcgggtgcagcttcgattgcaacaagtgcgaggccacctgctaattaatcaaaccgaatgatccatggatggcgaagaatcgatggccctctctactgaaactgatggatgtgtatggtatggggtgttgaattaatcgtcagttattagagttttgttaattagctacttactgaatggaatggaatgtaatgaaatatattttggtgagctgcgagagtctgtaagtattcaggtgtgtgtgtggtgttcttgatgataatgatgaataaaacgagaggaattcatcgattctttgaccgtatgaatttgatttgagctgagctgagcagcaatagtagtagcgaactttaacgatcagcacttcgtctcttcttcttgtccttcacatcgtccgtagaattgtcaagcagtccatagtgaaggaattttttttcctacttattactggtacaggattaaattgttttccaacaaaaataaatcttccaatccaaagagcctcttaatcaaaatctacgagaaggttgatgctgagccgactgatacattagttcggtttgccggactgattacaggcggagatgatttcgacgtagaactaccagctgctctcgttgatttccctatcaaaaatgaaaccagctagtttttctttttttaaaaaaacacgcttcaagaagtttcatttcgttgcagagtcaaatcaacaacaacaatgagaagaagaaaatgcatgaattccgtcaccaagttaaagttggagctgatgtgaacagaatgaaaatgtgtagtcaaagatggatagttgagctgggccaacagcccatccatagcctaggccagcccatcacttgctctggattttggtacgtttgccttccgtgggcttctcatgtggatagatgggtcatgggcgcggccgcgcgggctgggctaatggatttggagttggttcacttttcaattgggccaggccctccaggaaaatttgctggattactttcaactgggcagccctattagtagttgggccgccttcccccatttgtcatgctcattatctcatcaagaaatggttgggtttatgtctttcatgacgagattagtcatggatatttttctcttctctcaatacagcttgtttggttcacagaggtgagagagtgcatttcattagttcagagtacatactgtcctgttcttttctgattaagatccagattttatctcggtcttaattagtacacttttcaaactactaacaatagattttttacgaaaactttatatatagaagttgctttaaaatatcaaatatatctatttatcaagtttttaataattgaatttaattaatcatgcgctaatgattttcccgttttacgtacgtcaacttaatctttgtaataaaagattcagtattttgtgcagtgtgttcgttctactagcatcttcatggaaggagggggaaaaaggaacaccttccatctacacacacacacacacacacacacacacacacacacacacacacacacacacacacacacatatatatatatatatatatatatatatatatatatatatatatatatatcccaattgtcgtctgtcctgttctgaatatttttcttgttattatcttggtcgtatgctggaaaacatgctgttttatcgcacgttgatcccatgggatgccggcatcatatgatcacacgacttttcacctttcctcgacctcctgaagcctccaaaccaaagaacaaattacgacaaaccaggcaaaaaaaaaaaaaaaccacacaccaaactatctcaactctgaaagtctgaacttctgaagtccaaaaccgaaagtctgactgataacacgcacgaattaatgattccgagaagaaagaaagactcttactaatccaatgggggatagatggcgatgctaactaaaaatacgccaaaatttcttccctctaccgacggctcgtgtctgacttgctgaccggtgaaaattcggcgtaaaaatcctaaaccttttgcccatctcgcgtatgttgaaagcatctgtttttctatattttaatcttaatctaatcagttgccgtcacttgtcagtcatcaggatcgcgtgttctgactatccatttggggatttcttttttcttcccaattttgtttgtctcctctgtccacgaatataaaactatttttcaaaacagtgataagttaaatatttttaaatttaatcgttaatataaaagtcataaatactaacgatgtaaaaatgatattatgtagatttatccttaaaaaaaaaccatcataatatacaactctaatacgttttagaggtattattggtcaaggtagcacattggatatcgcattgatatctaaaatgcttataattatgtaagaagatggtagatgtatatttaatgaaaagtcatcttcctccttggtccaaaatagtatctccatcccaaaatatatgatgccgtggatttatcgtataacgtttaactatttattttattattaaaataatatataaaaattatttattttattgtgacatgttttatcactgaagaaactataaattaacttataattttatatatttatattaatttttaaaataagacaaatgatcaaacattatgaaaaaagttaatggtgtcatgcatttcgaaatgaagataatacttgtgaagtttcaagcagccactgattggtacctacatattctcaattttgttaaagtttaatcagcttatcagcatgggcaattaccaacgtgacagattaccaaaaactatactaggaccaatgaccattgaagtaaatcaacgcgtgcttttgttcgaagacttttctgtagatgcacgtggatttgcatgggagatatatgttgctgctgttgttttctgatcagaatttcagaaccgtatgtcctaaaaaaattcagaacccgtattgtggcctggatgggccaggagatgaggagatgatggagatatctcatgttccaacgaccatagaacagaacgatgatactctctccgttttaaaatatttaacacctttgactttttagcacatatttgactattcgtcttattaaaaaaattcatgaaatatgtaaaacttatctgcacgtgaaagtatatttaacaatgaatcaaatgatatgaaaagaataaataattacttaattttttaaataaaacgaatggtaaaaacgtactaaaaagtcaacggtgtcaaacattttgaaacggagggagtattatacataactgtttcatgctgctactgctgttgttatctataactcatcgctgaattaattgtcatggatggttccatgatgtaagtgggcaagtccacgaacccacctataatataaataaacagtaacctgtctagttatctactaatttactctatcccaaaatataagagattttgaagggatgtgacacattctattaacacgaatgtcacattctttaaaatctcttatattacagaacaaatagagtatattataagtggattcgtgaacctgcctgcttgcacctggttcacagccccatccttttatccattgctggttataagccatgaatccatgatgcatattagttcttaacaacttaaaatccaatcaaaatccaaggatgaaaagtaaagtaaaagaacaataaaatgatctttaaaattatgatttaaaatttaattctaattgcggtagatataaacaggagagcaacgatggagtcgttccaatctgatagtgtttgcataaaggaagagagataaacgtcaggaaatttaattaagagcgattagtcgtcattgccactcatgattatataattaagaacggtttgagcgtgtgatcactaaaagagagccagccaggccatacatacgtcaagcatttttgcttggacaagtcaataatacctaattattttaaccaagaaaagctgataacaatatcatactccatatttcatctatttggtactgggaccgagtgatacgtggtagcagtagcacacactaatttagtaatttttagtatgatcggaaacgtcactctgtttctcctacgcaattaggtatatttaacccaaagatttagctctctctctctctctctctctctctatatatatatatatatatatatatatatatatatatatatatatatatatatatctaagcttatcgatctattgattgcgtgctcatctatattagccctatacacgaatgaatgagaagttgagaacagcgcaaaaaaaaaaaacatccaccttattagtcaatagctaaatttatgatacttataacacattggaggaaaacattgttagttgccaccgacgaattaaagtcgaattccacaaacatgatcttaaccaacaaatcaaatttcttccataatgatggtagtatgattatgtcaaacatgatctcaactgacaaatcaattttcttcccaaatgatagtagtacttatcaccatttcagttagttaattaacagttattagtcaactgatggtgccatgtcatacggtgagttctcatttcccccgtggtgattagtgattagattgaacggatttctcccctatttgctcggagttacggtgatgatccgaatgtattggagccatgcatgccgtggcctttgatgcatgtagatccagctatatacggataagattttaaaaaaaacccaatgcatttttccttttaccattcatttcggcgaaccattgttctgtcgatccatcggtatcctggtcaattggcaagttgacgaaatgccccatgagcttaatttgctggttggtttatcagatacatccaaattcaaatgtaaaacttaaatttattttgagttggttttgagatttttttcattgtaatttatttttagcactggtttttaaatcactaagaaaacaacccattttgatgaattcgtttattttgtcccacaaaactaatagcactatccactttgaacaaacaagatttatttaattatgaccattcgctaatccggccaagacctttctctcttctctccctctataaaaagcctcttcctcatttcctcttccatttcttctcctacttgttggcttctatctcctgttaattaatttctcaagattagtagtaaaagggtagggtattagtggcgtgattaatttggcgggagcagcgatgagaagtggcgggagcggcggcggcggcggcggcaagctggtgagctggctatggcgggcgccgcgccgggcgctgtgccgcgcgcgggacttctacgtgcggagcatcaccggctgcgccggccacctcccgccggacgccgccttcggctacggctacccgacgttcgccgccccgacgacgccgaccatgtcgaggaacagcagcttcgcctcctcccgctactccgccggcggcggcggcgacgacgacatgcgcgagctcgtccgcgccgcgtcgcagaggctggcggcggagcgcgccgccgcggccgcggagccggcgaccgtgccgcggagccagagcgtggccatggcgaggatcgacgaggaccggccgtgcgagttcgccggagttgggctggtgttcccccggagccagagctgcgccgtgggcgccggccgcgtcggtgggcggagggggagggtagctgccgtggcatgaaccaccgccgccgatcgccgccggcgattcttgcgtgcggtgaggcgtagaacgaaagcgaaggacacgaacacacgacgtgttcttgttcaaatttcgatgttttctttttcttctgctccaaaatttgcagctgcgatctgtaattcttgttgtttgccactattgatcttcatttttttatattgttcttgttcatctgtaaacatcccattaagaagaacagaattaaattactcgtttggttggcttggtcgaccgaggtaaaaaactgagaggatttttaaggtgattttcaccctaggcgagatggattcaaagatatatcagatatctttgaatttcgggtgaattttcaagctagggagatagattcgaagatatctgcatcagaaatcttgaggtagatttcgtcggcagcccatgcgatcctatccttgtgtcgattggtgttgaataattcatctggagtagtatgcggagtcaaatcccgttttaaccagtcaacggtacaccaaccattcggaaaccgaaatggtgaaagctctgtcactattttgttctctattatccaatgcaggattatctttaattttttgtttgagatgtaacggttgcttgaaggaacgtatcaaaacaaagggcctcatcggttgccctatagtttataagccaaagccaaaatttaaattttaaaacttgattttgaatttgattttaatgttttttcaacatagtttttttcaactttggcttttcaatcactaagaacatacatacaaaagttttactcacatatcattttttaatcgctaataagccgttatggcttataataagatgcgggcaaccgatggggaccaaaggattggaatatctaagaaaatttcttatacacgccttatagagcattttgagattatcaaattcctatggattaatttcttaattcttatgccccaaatgacacttctccttttgtctctctacttcctctctcgtatccaccaaattcctgtgcatttttatatctccatgagatttggtagcgcgtgacattgtaacacgcgtgtttttgtaatttagagtatgaccaacaacttacttattctattctatatcctcagatttaaatcgcatccaacagaatcttccaataatccaggttcccaactccgggtattgcgagatgaaggaggagttggccacgcggtgcgcgcatagggatcagggtattgcgagatgaaggagaagctggccacgcggtgcgcgcataaggagcagcagaaaaaactaattttctctgttggtagttaaagggagggaggggttactgattagttttctcacttcctatattcattttagaagcttaaaaaaacatagctttgggatttgattattgtcaatctcttggtgatgctcttagaatattgcgttccaaaggagtactagattttctttaaaaggaatcacatagaacacaccacctatatatacctagccctaccatatttttaaactaagtaaaagtcactaagtttcaatttttcaaaattttcttcgaacttaaccataaacatcaaacttctacaccacaactattcttactgttgggcttggcccagccgcgccgaacactgtcgcaaaaccacgaagctgaagcctagttgggccggaaaggaatatccaagaagtgttggtccgaaacgtggcagcaagaaacattttggcccatttgagagcccacaagctatccggcccatcttctataagaacgaaacgatgataccatcgtgtcagtctcgactcgtcggctcgcctcctcccttcgccgtcgccgatctctctctccgcctcgcctcctccgccgcgcgccgcccgtacgacggcgccgccgcctccatggcgcagtaccacctcagcgcgcagctacgcggccacgaggatgacgtaagcgtcccctcctccctccctcccgcacctctcggcgtcgcttctcgcctcgtctccgctttgcttctcccgcaagtctgcgcgattccgccgtcgttccccgatccgagcgctcgccggtggggggctcgggtccgctcgcggacgccgcgggctgcggtatcgatctgctatagtagggcgatggcgcgttttgttgcggggacggcggtgctgcttgcggctccgaattgggggtagctcgacctagcttggttgcgctcgctgttctagctctcgcgctctcctcctgtttgttcggtgccttacttgggttcgtagatttcaaacgctcgtgcattgctagtttagtttagttcggtcggcaagcttgcttagtgtcagagccaactgctgttttgattgctagttcggtcggcaagttctacccaatctatcgcatgtgaattcactgtgttactgtggattttgggggtttagtggagggttatcgtggatgtcctcgccagtgattattgtactttgggtaattagtagattggtgaactcgtgagtgatcagttgcttggtctcaaatttgatgtgattctcttcatttcgtatcacagtagaacttcctgttccctgctccacccgatctcagtaattcagtcccatccagaatgttccttgtcaatttgacaacattttcgtcctttttttttcattacaaagcatgttttgttatgcatgtctgtgcctgtagaatgcgtatcttatatgacatgagctaattgcagcttttctttgtgcgatcctcaggtttttcaatttcagcgcaatatagttcaattatgcttattgtgcccttccacattaacaacacattcttctaattttacatttgcaagcacacttgtttcatggtctgcttattgcgatttactcctcaacaggttcgtggcatttgtatctgtggggatgctgggattgcaacatcctcaagagaccggacagtgagattctggacacagcacccagaaaagaagcatgaatacgttctctcgaagactcttgttggacattccagttttgtgggaccattggcttggatccctccttcagaccgctttcctgaaggaggacttgtttctggtggaatggatactcttgttttgctctgggatttgcataaaggagaggttgttgagactatgaagggtcacacttcacaagttactggacttgctgtagacaacaatggcgacatcatctcttcatccatggattggtaggttttctctgagaaatcaatataattctatgctgctttcttatatggcttggttctgtttctgcttgctaattactatcctatgctaatttcattaaaaaaatgtatgttgtcaatggcataatgtaacatgctatgataatttgtatagctttggcaccttcttatttatggatcactcattttctttcattttgtgccaattcatgtttctacttctgtttccttttcctttgaggctctgttgcaaatgttactactaataatttgtgtcaaaagctgcctctaagtatttggtattttaggcacacgcatctgctatttactctttcttaaattgtttgttctaatgacaggatggcctaatactaataaacaattaagggtccttattagagtggtttattgttgtcctatctgatatatgtattgccaattgtccatacagcactgtaagacggtggagaaatggcagtgtagtagaggtttgggaagctcacaaggttgccgtgcaaactgttctgatgctgccatctggagaactatttactggtagagcatctgttatgccttcacatttatttcgtttttacttggtacttgtttattttctgtatttgtgcactggcaccttgttcataactgatccaatgtgattggtttgagcttcctatcaaacttttggaatctgatggtttactggaaatatcccgaaagcaatggttcatctggaattgttttggctttttgaaagtacttataatagtaattcttattggatgtactaagtagctatgtgtctagcaaccgctaccttagaggcgaaggaaaatgggtttactagtataggtaaacgtctcaatttccacaatacagtgcagggggtacaaaatgcatactgaacctcaatttattatagtgtttcctgggacttgttctgaacaaatgtgaccaaaaattcgtcaaatgatctattgatgcttttcctccttcatacaggctcaagtgattccacaattaagttttggaaaggaaggacatgtctacatacattcacaggacatgcaggttatttgcctgttcctaatgcataatactctgtttattgtttatactttcttggacattgacacaaatgtatatgtgtgcaagggtgcttctactgtaatagtgtggttcaccagatagctgagagttgtcaattttactctggtcaatttttttttctcactttagaattgattctggttgcactggagcaaaatgttatgcatttgttttatgcaaagagaaaaatatcatttatgaattgattgtcagtgcccttctcaatatataagcataagtttgtttttgtgttttgttgctagctcacccatgtttatttgacctcattttgtgtaacattgttacggcagatactgttcgatgtttagcacaaatgccagggctcgggatcctctctgcctcacatgatgggtgagtaaccagcttcacttacaaatagagagataaaaactgtcggtttgtctcgaactagaaaagcagcacatttacattattgtttgatcattgttattgctgttgcttcttctaaggcctacttctcatgcaggggccctttggtttactaaaaaaatttagccaccccttaatccttttttttaaaattttatcacacacatgtgcatcactgtattttatcacgcacgctcgcaaatgatattttgtttggtcacagcactattaaggtgtgggcattaactggccagcccctgttggagatgattggacacacttctcttgtgtattctgtggacgcacattcatctggggtaattgttagtggcagtgaagatcgatctgccaagatatggaaaggtgatttgttctgcgttcttcttagactgagttcatgttaaaattcagtagtattttttcattggattgattatacttgcatagtcaactcatgagtcctaccatgaacatttgttccaaacaatttctgaactgatttttccattgtgaagtgcaatccgttttacaaactcctttgtctaaagaaatgtaactttgtagttaaaatcattatgtaagattcagcttcctctgctccagatctgatcttaactagttttgtatatgacaccttggtatggtagttggtagtacatgtttgtattcacatttcttgcttttgtaacaaaggaaacgatctttgaggtgaaacccagtgaagtgtatgttttgctaagcagggatcatgcatgctttttcaaaaaaaagggtgttttgtatggttgttataagtatgtagcagaatgcacattaagcacctcatgtacttgatcaaatgactttgctagttgtataatgcagatgggatctgtgttcaaagcattgaacacccaggttgcatatggggtgctaaattcttggaaaacggagatattgtaactgcatgctctgatggaatcgtgaggatatggacaactgacaataataggttttgcagtgatgaggagcttgcagcttttacagatcttatttctcagtacatacttagtaggttggttcgctttgcttcttgaattattctatttatgttctatgcgaagtattgacatcttctcaacgtgcccccccctcttttgggtatcaacgtgacctaattgtaaccttatcggtatgcataaaggatgcataaagtagtctatttacagtttagacatgattcttttaatctttttatttgaataatagaacctgatgtttattcatgcaatatcaagttttaatttgaccgatagtttttgtgccttttattttgcttgtatagaaagactgtcggtggattgaagttgtcggatctaccaggaattgaggcactgcaagttccaggtcacatacctcatttcttatcaatttttttagattattgttgatattcctacgttgcttaaatatacatagaaaattcttaagctgtttgccttttttttttaaaaaaaataaatcaaaacagcatgctactagagttaagaagcataagaattagacttgatctctaaatgaagttttgtacttgaaagtactttgtgggtttatgctaaattagacttttggaaatgtctagagtattttgataaaatattgcagttgtgaaactcaattgtctaccgattctttagtaactttgtgatgttcaagttgaaggaatgaaaagttcatctttctttatctttgcataatagtatcatcatttttgaacttgtttgcttgtaagcaggaaactctgatggtcagacactgattgttagagaaggggacaatggtgttgcttattcttggaattcaaaagagctaaaatgggacaaagtaagcacttttgtgcttttagtatctccattgtgtcccccctaagttgccattccttcacatgagataatatgaatgttgaaggtgtcttttcattatttgctgtttgatattgataaatatatttaacttaaatgcaacctatgcaatttgacatacctatgaggtattagcattatagggagcttaacacatttactgcgtaacaggtgtcataaatgatgctctctgtttatatttttccatgcccatgcttgacctgcactttgttttgattttatatgtgattttaccttgttattaaaaaatcatgctagattggtgaagtagtggatggacctggggatgctgcagctgcaccaggccagtttcatgatggtgttcgttatgattttggtaagttgccttctgttggatatatttttgtgctaacctcatcatttacttatgttcatctgaaatccatgcagtttttaatgttgacattggagatggagagcctatgcgaaagctaccctataatcgatcaggtatgcctcttttttttaatgcttttgtctgctactggttctagagtaacccaattagtattataattcatatgcttactttacaaaagagagttttaccatttaagtgtccactcaatgcaaggtcctttgcttgcatgtgcatttacctttagagactctcttg

SEQ ID NO: 73250 - DNA, 942 bp, Oryza sativa
gctgttgacatttgagttgtttatggttcagctaatgcatatgtacctgggcaatcagcgtcttcaactggtatgtgtccactgatatgaaaatagagatctaactgatctattttattacttttgttgtattcagtgataatggctttgctccctttccccactctcctttttttgcttcttcacaagtcctaacataatgttcaaacttgttttcagttagtgctcctaaaccaactttcaagcacataccaaaggtaatactcacctttgtcattgttgattgtggatttactgttattgttaataacttaatgtagtgactgaacagttaacatacatatgaattagcaccctgtaccaagatcttgtaacttgttattttgtaagcacatgggctcgtacacatctgatatatctattatttgtgttaaattggttggtgcttagtgccttagtggaattagctgctactatcattttgtgttgcaacctgtaacctgttgcaattttactcaaaatttgcttatgctttgcagaatggaatgctgacatttgagacggctcagtttgagggaattcttaagaaactctctgaattcaatgcaacactttcatctaatttggtaatttcaaaaatcatttgttggtgaatttgtttcttctgataatttagtattttctcccagaacctgggaagtttagcttggtttataccatcctgtcatcctgtgtactattttgaagtttagaactatgttggtgttttaatgctttagttcgtaggcaatgagttttaagcattgatacagaccattcccaccgtttgagtctcttttttttttctagctgtgtacctagcctgtttggagtgcaggaatgtcctcaattcttgcagggacagaaattttcctatgaaactcctttatttcaacttagtgc

SEQ ID NO: 73251 - DNA, 6620 bp, Oryza sativa
tgggatttaaaccctaacagttataatcataataaacattttttatggtccttgagaaaagtacctagatatatactaaaattttacatacctcgaggtaccaagttttatgctataacatgtggtacattctaataccttctcaagaatgataaaattactttaatcataaacatacaataattaatgtgactttgcaataaccataccaaatgtgctatacctatataggtgcacagttactaaaatgttttagcacacgattaagttaattaaccacagcacgttaactgttaagcatatttgatcttaaagttggcgatgcaaaagcaaacaaaaaaaatatctggtagattttccggtgatcgatctttgtaattaagtacgtgaaatgtatttgcatacgtacaatgcttggtcataatcaatttcagcatatatttgtgcatccattatatattatatatattaagaatatataacggcgatatatatatgactcgtgcattcggtgttatgtttcggccggaccattaattttatgtgttcccgggccttcatccgttaactgtcaatcggtgcataataactattaatctcactcgatcgcaccaaaaaaaacatcatgcttgcaggagcgcatcacataatttctgccaagctgtatatatttgcctccaagatatatgaatggaaaattcatgaagatatgcatggggcactatatatgcatgccagcagctatatatgggttatggctagggtaaacggtatatataaaaatacagcatagacgacaattattattgacgaaacaaattaaaatcttttttttcaaaagaccacataaggaagcaaataaatcatgcacacatatatataagatggtgaaacgatcacgatcaatacagcaaggacgccatgcttagtgacgacgtctgtctgattaattagatttctctgagagaattaaggaggagaagaaattaaaagatcgtaattaaccagctgatactgatcaatcgatctcgatcgtatacatgcacacagctagcagccactgcacacaggtgagaagaaaatccccaaacctcgatatgtatcgcgattgtaagtaggttagcagcatatatagctagtagttattcctcttgctcccagctgctgacctgtactgatcgtcgccacccttgagcatctcttgcagcacttggtcgtctaggcactccagctcgatcacctgccgctgctgatgctgtcgggacgaggacgacgagcctgatccccgcacgtagttgcgcgcctcagcagggaagttgaggacggcgaggtggccgcgcatggcgtaggcggcgcggtcgtaagcccgcgcagcctcctcggcggtgtcgaaggttcccagccagacgcggacgctctgcctgctggagtcacggatctccgccgcgaacttgccagaaggccggcgacgcacgccacggtacttggtcgtctcgccgccgccgttgccctgatcgtcccatccgcccccgccgtcgccgtccatgatatcgatcgatcgattgcgaccactgaccggccgcggacggacaataatcaaattaactagctactactgttacggatcggaccggggatgcaggggtgtgctaataatattgtaagtatatatatctaatgatagctagctactgatctattccatggatcgatcattcagctcagctagctagctatgcatggagtatatatatatatatgtctctgaatataatgcttaaccgatcgatcgattacgctatatatatatagctatctagctgcagctgcgacggcgctggaaatggctaggggcctggacttgtatttaagagcagcttccgagcttaagccctaagggagctcaagataatggagatgcaatttgtgatcgcgttattgaaagcagagaggaagatgccgattctctcgcgctcaagtgatcacatagattgtggaagatgggccccggtcgctcctctgcatccatcccttgttgctctctgcctgtaattagctaactaaaaaaaacatatatatagtaatgttactaaataacatatataataataaagcaggtctcgtggtttcagagagcttgatcgaatgcatatctataatccctccgtttcgaaatatttaacacagttcaaatttttagtacatgtttgatcgttcgtcctattcaaaaacttttatgaaatatgtaaaattatatgtatacatataaatatatttaacaatgaatcaaatgataggaaaagaattaataattatttaatttttttaataagacgaatgatcaaacatatttaaaaaagtcaatgacatcaaatatttagagagtatatattacgtgttcgggatgatcgatccggtcatgcatcagtacgcctaatttatgtaggtcgagtcattctttaattaatttcaggtgactatctaaaaccatatagatatatagctaaaccagccgaccgtacctcacgcgttctacttgcgttgagttcaatgacagttgcctaacttcagctattaacttttgcatatcattgggcattgaaactactcagtattgtttttatttgtaggctataccgctaccttgttttctctttgaattgtcatcaccgtgtttgtatagttggagaatcctttttgattcttgtatggacggatgcaaactaaattaagctcaactagatgatgatgagggatggaatcataccttgatgaattgcagccttgtatatagttaggcctcgtgcctcaattgactggctaaatataatttgtcgcatcgctaactttattaagcaatgactcctcttgtcacaattagcaattgttttaggttagtgggattgcacgtatagtatatacaagtacataactcacacatgcatgtagtcctagtactgttctataagaacaaaagagatggtttgaatgaattgcgcaccttaattttttttatttgggattatattcttgtttggactttgaaacgaatagggacgtattggcctcgatttccctaggaccggtcggcgacacgcatgtgcatgcacgctgtttaaattcatgtttgatcgatccttcgaaaaggaataatattggaatgtctttgctggaattaactaaaatttagttagatgagcccagctgcccagtttctttattgcttctgctatttaattatacaagatgtaattatatactagtagtagataatgcaaggatgtttttggtttgaggaatctaatacgattacacttgctggccaacaaacataaagggtaaatccttaaatccacaaatcccttatatgtatatatatgtattcaatataacatgcatgatgttagtggcacaaggatgacatagaaagcatcgtacgtcgtacgaaattttgcgctgcaaacagagtgagtagttgcaatataatgcagtgctgtatagcgaagcctgcgcactagctagccagttttgaaattgatgaaagtataataatttcttttgttggttaaaagaaaagtttgaaaacgttcgagtttccaagtaaacagttttttttactagtaatgagaagtcgttgtatagtgaagagaaaagaaggtgaggaaatagcaaagttaagggacggtgtgtaatgcttaatgggctagcttgtcggccccatgtatgatgattggatacaatctggcagtatgcatgtttatgggccgatccaactgatacgtgcataggataggagtaggactggcattgcaaaacagcagatgccatgacatgcataaatactactccctccatcccgaaatataaaggattttatgtggaggatgtgacacatccagtgcatactactactacttggcaattggcatgtacgcatatgtgtatgtgaatatatagggagaaaatggcagaggcattgacatgtgcaaatggaggaggtaggtttttaagctagggaggattggatggggatgggaatgggaatggaatgaagttgacttgagagtcaaaaaggagagatgaggaaggagggcccagctggggaagggaataaatccatccatccatccatccatttgctgcctttgattttagtttaggcggccgtcgaaggcgacccgctaggtccctgttccgacttgcgagctgcgaccatatgcatccgcgtactgtatactccttccgtctcaaaataaatacagttttgtactattcatgttcaacgtttgaccgttcgttttatttgaaaaatttttatgattagtatttttattgttattagaagataaaacgtaaatagtattttatgtgtgactaaatattttcaaatttttcataatttttttaaataagacggacggtcaaacgttcacggctgcacttattttgggtgggacatgaggtagtacttggcgttgaccagcgcgtggacttgtaatatggacggacgcggacgtgctctctcatctcctagctactgtactagcactagaaaagaaaagaaagaagaaagcagcagcaggaggagagatggacttgctcactcggcacgtgaagtactccctccagcaactagtaagaagaaaggcaggctgcaggcgtggacgctgactgtcggtcttcccttgtgaattgtgatccaatattgccaaattaataatatcccttcatagatttctctctgaccccgcgaaacagcatcagcatgcattgcaattcaactcgcatattagtagtaagaagagctactcctactcagtggtgtggcgatgggttcagctctttcgggcagcggcagcgggagcttgttggtcctctccgtctccgtcgtcggcatccttttcacctccatcctcctccttgcctactacctcttcctcgcctgctcatggcgccgccgttcccaccaaactgcacgacccacgccgcctcttccttctttcttcttagccgccgatcaaccccgccgcggcctcggcctggaggaggcggccatccgccgcataccaacgctccgctaccagcagcagcagcagcacaacaagcagcagcagtgcggcgtgtgcctgggcgagttccacgagggggagaggctcaggcggctgcccccctgcctccactccttccacatcgactgcatcgacgcctggctcgccaccgccctcacctgccgtctctgcagggcccatgttaccgtcgacaccaaccacattgctgctgctaccaccagcacgcggcacgacgacgaccagttgctctccggcgtgcaccagccgatgaggaggtcgttctccctcgactcctgccacctctacctcgccatcattttgcacccgcaccaactctcggactccgacacccgcagccgcagccgcagggaaccaaagcccgccgtcttagagtcagagaggcctagtaggacgctgcgcagatccttcttttccttcagccacactaccacctccccagtcccaactccaatcctccctatctgattctcaacactaatctacttgtacaatcccatattatatttattaactcatccatatcattggtatttttcccatcacatcctcgtgtctctatgctctcttttttttcagactgtacaacactgccggttactgtaatttcttaatagacatagtaagtggaatcatccccctttaatacttttttcgtttcgtttatgcaatgtgcatcagccatgtagcaggcgtctgaaaataatgactaaaggtaatcctgccaattttaaaaataaagaatgcttcatgcaccatcatctccaacacataatcagatgggtccggcttgccaaatgagacatccatcattacttccttgcgtgatgcctccaacggtatttaacaagaacaacacatgacggttcaaccagattttcattttttattattatctgatgatttgacaccaaccaagtatttcatgttttctatgtattactttattcatattgcctactaatcattatatcgaattcatccattttatgtggcctttttatgttacctacaggaataagtttagggtttgtttaattggtgaaataaaaatctttggatgtcacatcggacgtttgaccggatgtcgaaaggggttttcggacacgaatgaaaaaactaatttcataactcgcctggaaaccgcgagacgaatcttttgagcctaattaagccatcattagcgcatgtgggttattgtagcacttatggctaatcatggactaattaggctcaaaagatttgtctcgcgacttacatgcaaactgtgcaattagtttttctttttatctatatttaatgttccatacatatgtccaaagattcgatgtgatgtttttgcgaaaagtttttagggaactaaatagggccttactttacgtctcattttcctttaaggctgagtttcaaacgtatccttcagccataaaaccgaatacaacgtattcctcatattgcaatactagtctaaacaaggtcctaactctcaaggtacttcatccgttttatattataagactttctagcattgcc

SEQ ID NO: 73252 - DNA, 13265 bp, Oryza sativa
tttaggtggagctgaaattgtttggttgagctccaattccaggagatgtggaggtggtgttgtgccaaaatactccccccgtcccacaaagactttatttttgggtttctgtatccaacgtttgaccgtatgtcttattaaaaaaatttatgaaaagaatttaaaattagtcacttataaagtattattcatgttttattactaaataataataataataatcattgaaaatttttaaataagacgaaaaatcaaactttatataaaagttgaaaaatggagtctttgtgggacatagagaatagtagataagctataaggttatatatgttttccttcttctttctatctctcacatatgcatttaatgtatttagcttgaagcatgtgaacagataaattttgcatgagagttaaccctttttatttttcaaattctctcactacttatcctactattaaacttaaactggctcttaaaatgaacaacttctggacgtatctcggcaaaaaatttatccatagaagttaatttcttttgggacggagggtacagtgctaaaaatttttaattaggatgtgcaatgtaatactcttttcatgttcgtaatacttatcgatcgttttgaacaagtctaatgtgaaattttaaaatctttaattataaattatttctaaaatatccatatgtatagtttaatttttaaaattactctaataaaatagtatatttattaatatttttatatgtattataatagaaaatagtggtcaaacattactttttattatgttcttgttaaaacgacaagtaccatcaaaatgaagacacaactatcctggaaaaatcacggtggaccatacaaataggtttaggtcgttgcaattgcaggggcatcacactccaaattcctcaagtcgaacctctgaagtgatgacagtataatcgatagtagcttggatttttcctaaagcagctattggcacgttctaattaaggaagggagttgggaaccggcggaactcctcacgatacattgggcagtggaaaaaataaaaaatagtttaggggtaaaacttttatatttatgtttattagaggtttataaaacaatgctgaaaaatgaagtatgataaaagaaactcaatcaacttaaaaattaagttttaaaatctaatttataattatggaagctaaacgatgagaagataagaaaaggatcatgtttaaatactaaatggcaagagctgattaactatatactagtatagactatgtgtttctgatgttacaaacagttttcttttagggggtgggaggggggggggatgttacctcaaattctgtgtcacaactcacaaggttgcaagagtgcacgaccaaatgtcactgcattcatcagcgaaaaacctctctcgcaagttgtactatcaactagtactatcaagtggatgacaggaatggacaaattaaatttgctgagctgagaattttttcagttttacgttatagtagttgcataaacactaataaataaatacacaacgaggatatggatgatatattactgttaaacgcatgttaaacgtacaccttaaaatgtatgtgctcgttggtatgtaaatataaggtaatgttcgtttctacttaagataaaaataaagaagttagaacaccaaaaataagaaaaccattaacgtataattagttgagttttaattgttataaacttaacgaatagttttattcaatattttacagtaacttctacatatataaaaaaattttccgcgaaatatattatttagctgtttaaaaagcgtgagttgatcaaaccgaggtagcatgaagaagatgcctatatggtcgcaggttttcgtgtatgtctttcgtgatcgataaaaaaaggcgagattttaacgctacaacaaattatctggcggtatcttctcttcctgccagccgtgcgcttccctacgtaactcgcttgtcctgtgactcctgtccgatcgtccgtatggcatctcgaactgatcctccgttcccttcaagcaactgctacatgccgctttcctgcagcgctcactcgcgtccgtggcgcggaaaaaaacggcttcctgtgcgtgcgctcccgcgccgtgtcagcttccagctgcctctgttctctccgtgacgccgatggcgagagctatagcgcaggagaatttatggcgctcacgccgtgtcagctagagctcgaaccctcgaacgctcgagcggaaaaaaaacgcttgggcgagcctcgcgccacggcatccgggggtcgacggcgatggatctccgatagcgacccgagccgagccgcgcctctcgatcgcgatcttgggtgagtaaagcacggaagcttcgcgcttaattgggagaccgcgaatctgatgtaagcgctgcagtaagactgggatgggacaggttaattcgatccgcggcaactatcaccggtttcttgtttccatgcatggctgcatcaagtaagtttatgcagttgtaaaaacggatttgaacattgatgttatatatgtaaaacagttctgtcaagttgggcatttgtcaatgtcaaaggacctttcggtattagtaccgcaagttacttacaccaatcaattcaccgatgagaagcttaaatttgctatacaattggaattacctgtggctgtagtccgtcaaaacacacaggtgcgtaatacactcaaccggcttcttgtcgtttggacgttcatgtcagatatgtaactagccccaactgagctaaactaaactcgacaagtccatcttgtgttgcactaactagcaagttgcctagttggcagctaaatcaatgcatgtaaacctatcctacaataggaaaagagagcagattccctttacagagctagaaaactcttgagtcagtataacctctctgtctctgtgcattgtatttgtagtctgctcaaaatgaggtgtttgagtgctacatctcagtcgaggcaggggcatccaaagtttcacacataaaaacatgtgacaccataaagctcatccatatgacctctcgatagaaaggaaaagcatcatcctgatttggtggtgtcggtgttaacttatggcgaaatcacatattaattcgatccggtgcgcaccgagccacgtacaactgcactaagtaaagggggacacaacatggccaatcagcaaaggttcttctctgatggttaggttacaccggtgtagcaacctcctctttatctaatggcagattgtttgttttccctgttaagagtaagagagctcttgaattcaaagaaagtagccttaagtggagatgaagtcactagccaattaacaaagccatgcatatggcattggtagaatggttcacttgacagcttcagaatatgtatacaattgagctggctagtatgccattggttttcagttggaacctctcctgtagactgtagtttaattacatctatcctctgctgctctatttgcacctgcatatatacttgcataatacttggtggtcaacgcacgtaaaagaagatgccaaatgaaaaatgcccttctgatttgtacctgaaaacgaacgctggccatacgtatactacttgaaagcgagagcgccgctgcatccactgacgactgaaacataccattcagctttcagccggatgccccgggttgcactttgcaagaacagtttcggcaaggatcgcggtttctttctggaagagtgggtaaaaaatttcagacagaacgatacgacggttgtatcttctgttgttccctctgctacccttctctctgcaagcatgcctagttgatgtaactgatcttttgtcgtcgaccttttttatccctttttatcctcacccgttttaaaaaaaaatgttgcaaagtcaaaaggaggccacatgagcagcagagcaggtccatttactggcaaaaagcgtgagcacgcatacagttcagttctaatctaggaggatcagtcccaatttggatagtgacacctcccaacatgttctagaaaacagggtaaccgtcaacacaggtcacttatttaaaatcacataaagtattacctggtattataaaacgcacatgaaaaaaaaaaaaagggagcagtcctgtaatggataattatataggtataacttgcaggagtcgggacttagagggtgtttgggacttatgtttctgagagcctctctctctctcccaaacacccccttagtcataagtaagatccccgcataaacataaagaacttaccaccataattattgtccgatcatttctcgagatttggtgagatcatgattggccatgtatgggacagtccctcccattcccatcttaccatatatgtacatgatctacgagtatatgtgagaggacacatttgccatcgctttgcttgcctgctcgatatggaatgtcagcacgaacagggcactgcacatagcaagccagtgcactgcaacgacaaggttacgtgcagtgaatggctatacaagttgctgcctatcctgagagccggggaccaacgggccgcgcggcactttcgcggcttttggttgatgtgcgtgacgataattggctagtgcgccgggcagcctcgtcgcagtatgcgtgttgtatcacagtatcagccatgggtatgtggaggatttgcatgatatagaacggtagtgagctagctgcgagatcttggtgaggtgacagctgcatgcgggagctagtggcacaccgttggggtcgggtccgtactatgatgtagccttatctcgtagtgcaatggcgcagggcacatccttttcgggttcagcgatgtccacgggcaacctgtcgttagagagatcatgtactggcactatggcgttattgcctagccggtccctcaccgcggaatggtgtactaagctctgatggtgagtattagagttctagcatgggcctggaatcggcagaaagagggatattacgtcccctgtgtaggagggggcttcaagtgctgctagctagtcgagctttagagacctgattttatggtaacgaccacattaagcaatctaacttccatagcctttggctatttcactatttggccataatcctagaaacgttaacaccttgatgaggatgtgtcgtcagtacgaatatcctctttctgtagccggccggaaaccctttctcttgtaccagatcttaaagcagatcacatcagacagtcctgtcccgggggtagatggcgcgttacgggtttaccggttcaacgtgtggctacgtgacgaagaaatactcctataaaacaaaacaaaaaagacgttactaagcgaaaggcccaaacgatctgccgcgccgcgccgccaacgatcccgacgtaacagagctagctactagctagatagtttggtccagccgtttcaccggtggggtgtgcgaaaactgtacacggttacgacggtatacctaaccatacacctcgcgcagccgcgcgtgctgcacccgtcggtccacgcccccccccccccccccgcgcgcgcgtggtagcttggcttgggcgcgcccactcgatcgaacgccgccaaacgtgacggcgacgccggtgcgctcgcgctcgcgcggcgttgggatattctttcgccgggacggcgagaccgcgagatcccccccaccccacccatactactccccaccgcgcggggttcggccgcctcaacgagcggtgatttggctcgcggggtcggtggtttgctcggcgtcggggtcgggctgtctcttggtcggtcgcgcggacgccgagagcgcacggcacggtggcgtcgaagggggcgcattacggcgtagcctcatttgccgaggcaacgcgcgcgagatcgatagattgggctaggggcattatcattggtcagataacggaaccgggggcactactgtcccctgtggaatcgaacgggcatgtcatggctgtcagtgcggataataactaatcaaatccgtaaatgggctcctgcgtgtttgatccggtagcagagtagtagtcccgttcagtcgccagacgtgctgatcgagccaatattgcaagcccctacataactttatgctgcggacgccaacataatccgaccgctacgttccgcagtgaacagtagtcatgggaggaaaaacccaaggcagaaaaacactggacgacccaatgtccggtggtacctaacgaatcaatccacatttcatcgagacaacatgagtcccaaacctacccgattgtttggcttccgtattaatgctgccatcatgtgacatggatgccacataaaaacccgtacgatcatgccgattcagatatgtttccccgctcgagaggccacgcttgctcccctggtcaccggcccctggtctgggtcccaattaacctcagatcattgatcgaattcccccaatacaaatccttcagccacaatctcatatatgctccgaccgtgacgtgctcctatacgcaatcacacaaattcattcatttaatttattcctctcccatgcaatcagtcaactggatggcctaacgactaacgtcagtataccactgtaatttcattaggggaaattaaacatccatatatatgatctgaaaagtgaaaaccgaggcggaatggatcgcagctggtagctagcatggtagtctggtattacggtatagtggtacaagagacgaaagcaaagacgaacacgtacgtaggcgcaccgcacggcggtgtgaacgcggcgcctccatccgcatctacctcggaatcttcgtccgggggcgctcgtccgctacctgagctttgatgccgatacggcgatatgatgcctctcccgtgctgccactagctctctctctctccctctcccgcctatcagcaaccgctccgagcagaaacacacgctacgcttcactgaaatctcttcgctcgcggctagtgtcgcgcgcgtgcatgtcgtcacgttcgtgcgttgggcaccggggcgccgcgcggcgcgcggccgagaccaagcgtagcgtgtgtttctgctcggatcgacaaggacggcgagctaaccggtgtcggtattagcgactcccgagtcatcgatcgccgtctcaggtgcgtgcagtgctagctcgtgtcgcgcgaccgtgcagaggctccgtggcgggcgctggaattctggggcccgtacagccgtttgtacgaacggggaggggtgtctcttcacaggataggatatgtggctacagaagctcgtggctaatgtggtggtattaaaaaaaaacaacggtagagtactggctggaggtgtaggcgcacccgtgtctggcgtccaaagtgagtattttactcgcacgttaggtggaaggctgatactttacatacatttgttgagatgggacaaggtgtggtactcgaggactacggcttttgtggtttcgttagctccaaagatcttcggggaaaatataaaagaattcaagagtacactaggggttattcttttttatttttttatagggagaagccataaaatttaattgataagcatcctaataccaaaaatgctatcgacaagagcaactttccaaaaataccattgcacaaatctctttctctcaaaaataccatcatagtcaaactgttgttaacaactctccgttaaattgtatgaaaagaaattttacccctagacaaccatttgctcacccacatcatcattttgcaatgtttgctcaccggcgcctgcgggccactcctctacgccgtcgtgttgccgcctgttgcggccgacgcaccgccgcctgtggcctcctcgccgcgccccgcgccacgctgctgtggaccgtgacgccgccgccgtggaccgcggcctcgccgccgccaccaccgaccaggagagctgtgccgcagtcgggagagccgtctggatcgggattgaggggtatagggtaaaaaatttcaccatttcatctcttttttcttttaccataaaaactgggtatattttggcccgagggcaatttggtcattataaaaaaatggttgttgcagtgcggaattgatggttatgttgggagaaagaagcttgtgcaatggtatttttgggatgttgctcttgtcgatggcatttctaggattagggtgcttattgatggcatttcatggattttctcttttttatattgagatgcccaaccaagtaattttacaaggattttattttcttgaatgtacattaaacgtgccaaaaagaaaaaaaaacttcatgtcataaaacgtcgtaggagatacgagcagacaagcacaatcataacattaaccaacttcaactcgcgtagaagtatatgagtagacattgaccactatcttcaatcctttaacaattttgcaagctggcatcaccgagcaagttggtgaatcgcaccccaaaggcactcccgttgattggatccttgtcaacgcgacatataagtctttctaaatcttcattgaaaattccacggatatagtagttgtcacataggtagaatagcaaataattctatgacatttctaacttcatagacatcactatagtgataagagacatgtttccttcccttttgccatcagcgaggatgccgaatcaaaggaggggcaccgagaggaaggcttggaccgcgtaggccctatcgtgatttgccacctgagacgaagtccgagagccctatcaacctaggcttgtcaatattttagaaggattttcattgtttaatatgtactactagaagggttttccatcatctaaataatattaatattgaaagctttaatgtacttatcttgaaaatgtgctacatacctagagagaaaataattaagcttgaacgtgaggagagagagaaaaggcatggactagctagctgattgcatgacaaacattcttaggtgcttgcaacgatgacaatgtagcggtgaccaaaatgaccatacgattgacaaacaaagcggggaagataataacaaccattggcgtctaaaatctggtgacttagacatggaaaattgcaggtatgcatctattcaagcttgatggttgtcggtacatagtgctgtagtgttataatgacatctaatacttgtatgtaagggagaatatatatgactagggcgggttggatgcttgtgcaaggtggtgcgtggcgacgtggtatgttggggagtggtatctggtaagcttgaattgttcattgatgctggatgctctacctccttagtccttccaaaggtttcattgggttttacttttttttaatcaattgtcaactttcaggccaaaggattctaaatatcgaactaaaagtcatgcttttatgccccatttgaaacagagaaattttgtagattcaaatcctataggatattttcttcctatttgaccctttgaaacagaggattaaagctttcaaaatcatatgaaattcctaataatggctcaatgcgtatattttaaagaaaagttatcaagagttccaaccttttaattttttcttctttgatcatatctctcatctgattcatatattttctcggtgatctattcaaaagatcatttatgtggcttttctgtattttataataatttgttttacacttttattcttttgaaaatcttatgtttttttattactctgttttcacgatcatgagattcgaaggaacccttaatatgaaatttgaagttctcacatacaaattaaattcactctcgtggctagcaaaacgcgtcaagtggcatggattcattgattggtttttgtgttcgggcacattgaagtctcttttgaaatggagggattttagtggaatttcagaagaattaaattatttctgtaaaatttatataaaatttcgaatgtttcagaatttgaaagaagtgtgaagaggatgaacagaaattgaccctcgatgcttgcgtctagtgtgtgtgccctagaagtcatggctcggaagttaaaaatagaaatagtttgaggtcattgcttaggggaagttacaatatcatcaaaatataatttacaatagcaatatgttaattttaaagtttaagtgaagatatgaaatacaaactcgaaattcagctgccatagttggccctacggcttataagccactcttaaaatttaacagttcaatatttttttcatcgaagtttattttccattgttagcttttataaaagttttgctttcaaatataatttctgtggctgtaaggtcgtccagtttataattagaggtgaaagtttcaagcctttgtaccgaatttaatttgttcgttatatttctcatttgggttgtacttaagaaataatatttggtattttttttctattgtataaagataagcatatgcgtgcggggcaccacatgtacattcatgaccttttgtattagatttttctcgttattcgcgtgcacgctttctaaactattaaatgttgtgtttttttaaaaaaatctataagaaaattgcttttaaaaataaaattaatctatttttaaaatttaaaataattaatagtcaattaatcatacactaatagctcatttcgttttgtatatcttcccaatcttttctttccccttctcctcaaacagttaaactcagttttgacacaaacacacataactgcatatagcttagctcaaatcagagatctaattttcgcgaccgcataaaaagatttcacgtcaatatattagaagaaagagttttacttacacaacgcaatcagccagaccggcttatgctaggaaaagagagaaaaaacaaaataaaaaagttgaagctcagatatctaatgaaggcagcgtatgaaatttccatgattcagcactatcaataaactctttcccttttttgtcataaaaaatagctgaaacctgcataatttcatttccactccattgattcgttccaccgttgagtgtgcccgaaaaatttcttagttccataggacgtgcaggtgcattctgcaggatcaggcagcaaatattattggcgtgagccggtttagcctttcgaggccgggaaagataggccgtgatgagatccttgcctacggccaattctgacctctataactgtagctggcgatagtatcttcctcctgcttctccaaaggtcaactgctactagaggaatcagtctctccttaaaatatctaaaagtgctctcaaaatatgcaacagtcaccttagtaatattacgaagaaagatactactttaggaacatgtacagtacaaaacacatccacatacacactgcctttgtgagtacaaccgaatgactggaccagcatatcttgagatcgatgacgccatcatggataactcgttgtcgaggtacgtcgtctacttttgaaaaaacaaatatcatgagattgacgaagtcacaacggatgcctcattgtcaacgagtactaacccctataaacacacacatcctatctctgtgagcacctacgaagtactgggttaacatatcttgagattgatgaagtcatcatggatgcctcactatagacattcgtcacctaccactgaaaaaataaatatcttaagattgacaaagtcatcacaggcgtctcgttgttgacgagtacgtcgcctaccactgaaagaataattacacctctgaagtactaggtcagcatatcttgagattgatgaagtcatcatggatgcctcactatcgacgtacgtcacctaccactgataaaataaatatcttgagattaaagaagtcatcacgggtgtctcgttgtcgacgagtgcgttgcctaccactgaaagaataattagccgtaaatgcgagcgcctgtgtcgaatttaggatttgaacccatgttaattagccgtaaatacgagaacatgtgttaaatctagaatttgaacccgggtggattggttccatcacaagtaacctaacaaattgagttacgctcacttcaaccacacaaattaagaaaataggttaaattaaatgggaaatattgtgattgattaaaaaaagaaataaggtggaaaaattaaaaaaaatggttataattggttgagatataaaagtatatagagaagttgttatactataaaataaattttaaattgtagaagttgatatacgtggggatggaggaaacaatacctatattgtcttttacaacttaaataattttagaatactaaagttcaattatgagtgtgaatgaatttacatccgcatctcacattctgcggcgaaaggtgccccctgacgacatttttgccacgtaggacccgcatgtcaaccgtaaatgctaaatatcgttctcggtttagtttacatcatctatgcatattatataaaagaatctaaaagtataaaatttgtcaaagggggacagagagagatgggagaaggtatcagctcaacacgtggaccatttaaaagctccttataatatcaccaaacagtgtttgataactagcattatgggttcatcaggacgctaaagtaagatatctcacacctcctgtcattgagttgagtttcgaatgagaagacaaacttgtgcatttagatcgactataatatagccaattatgctcgagttcagattaaataaattatagccaattatgtagcccccggcccggtcactagacgaaggctttgaataatgcaatttggacagtgtcacacagagaggatcgctgacaacatcacgtcatggaagttgctcttgttgagttgttgtcacggccaacaaaacagtaacattaaacacagcacatacgtcaacagttcagtggtctttgcgccttacgttgcccttctgcatcgtgacagttgatttgttttttctagtattactgtcccgttcaagcaaaaatcaaagcagacaaaattctgtggttcttgtttgatattttcccctctgtgattagtgaatgtacggaaatttgcaatagtaaaatcaacaagaggtcttttaagttctcctgccgaaagtctagatctcaaagcttgtcaagttgcacatggcattttcatactgattctgtaacagttaaaccgttctatttggggagggtcataccatatacggtcaactcgtccggcacaggggaaagaaaaatgtgcgcccgtgcctgatgacctattgatgtcgcaagctaagcaggcttcttgattacttccg

SEQ ID NO: 73253 - DNA, 3000 bp, Oryza sativa
tgatgggatcatagcaatgcttgatgaaacaaaaatactgaacactgctgataatttctctgtgctagatttgtaacagcatggtacgtacgactacattttacaaaacactacaattgttaaggcactgccaggaacttaggaaaatctcccagtaagcaaattccgtagaaatatttcatagcacaataaccatgtgacagaagaaggtaggactctgggtacaagactataaataccaaaaaaaaaactaactttaagcaggccaaacaaaataaggtttcccttatggaccctgtaggccaatcctgaaacaataggtaccagatcaactatgaaagaaggataagtaattatgagctgtacacaagctgtcaatttgtggctgagaacatttaactcattcaggtgattattgacccaaaaatctatctattaattccctctgggggaacaagaaacttttttaaagcaagttattgtgaatatattggtgattggaataactaatggttttacataataatagaagccagctttcctgccaaaagaaaagaaataagaaccagctaagaaaacattggcacaagtaggagtatggaaccattaattgtgttttgttgggtatacagcaaaatttggttgggaagaaaagaaagctaattaaagctaaatacacgtcattggtgtggcaggtaatgactacactccttttcatttgtatattgttatgacttacgagtatctgtaaagtagccacttgatgtaagcattttacttgattatcttaattctgtttcatgacttgaccagcttaaccataaggtagtaatctgccgatattttagaattatatatgtgctccgatggaggaaacactccagtttttaaaataatgaaaaacagagtcacctaaatttacaaaagtaatgttgggatccatgagagaaacactcaaaaaagtaaccaatgttactactatgatacagtttcaagaaaaataggaaaggaaaatggacatatttagatgtctgctcaggtaggatgcacataaggtttataggaagcaattttataacctaaccacatgttccatatctcataaacattaagcacaaagtacccatcctgcattttggtatgggtacaggcatgcaacaagtagttctgtttggcccaatatgtgctgtttaattactgaacttgtaaacattgaacagcatttgcattcatattaaataatacttcctccgtttcatattataaaactttctagcattgcccacattcatatatatgttaatgaatctagacatatatgtgtgcctagattcattaacatctatatgaatgtaggcaatgctagaaagtcttataacctgaaacggaggtagtataaaagtttaactattacatatgtgttcaaccatcaatgatatatgttccactcaggagttggaaatgagcatgaaaggggtagaacaactgggcttaaaataatgaaacttgtagtccactagggagaccaagatgaattaattatttgacaggctttggcaatcacagtactggggttatctttataaatagcagagaatgatgaactgaagatccatatcataaccagcaaggagcaagaataagaccaacaacagcatcaagaacaaggatgacaggacttggctcaccatgtggcgcgtgcaagttcctacgcaggaagtgtgtgaaggggtgtgtcttcgccccatacttctgccatgagcaaggtgctgcacactttgccgctatccataaggtatttggggcaagtaatgcctcaaagatccttatgcatctccctgttagtgaccgctgcgaggctgcagtgaccatgtcatatgaggcgcaggctaggctacgcgatccaatatatggttgtgtcgcgcacatcttctctctgcaacagcaggtgagcaagttcttcattagtattcagtacattacaatgagggttttggttcagaattatttttttttattaaaagaagtggttttattcttcatggagtgggaaaaactcacctggtgagtgttgagaactcaaggctcacgggctatcctaactaatctgtatgatcataaaagggttttgaagtatcacaagaaaaaacagttaagaagtatcccctctttctttgttgaaaatgtgtagacttctaggttccttggatggttctttgtatcaaagtgtaattttttttccaggaaaggaggttctttgcatgaaaatattgtcttaccatatactgcaaggaaataggtgacactgacagtggtgttccttgttaaaaattttcacaggtagtcagtctgcaagcacaactagaatctctcaaagctcaggcaacacaagggtatggagatggttgttcgatctcaagccctcaaaacgatagctgtggaaatatgttaacgtctattgtgcaagatgagcaacagtttgttggcccaacaatggcaagtaactcttcagtaaagaatgagaatcattcatacattgcaaatggccacttggcccctatgtcagctcaatcttcacaaggctttgaagcagagttgtgcatggctgagtacagcaacaccaacccttgttgcagtgtgcaagggaattggtatcatgacatggaggaccttcagtcagtagcctttgcctatctgaatcaggcatgagttgatgatacatatgtggtagactgctagatactgtacgagttggaacggttttggtaacaataacttacattcttataggatgaacattcaattgctaaaataaagcagcagagttgtgatgtagctgttcaaatattgcgaacacataaatttattttgtgtcgatatgtagttccatagttagtgaaagtaagttgtctggtttctgcaatactaaaatcgatctgtcctgaaaaaagcatgagttggaggttaagaggaaaaatatgattatggcatgaacattcg

SEQ ID NO: 73254 - DNA, 14791 bp, Oryza sativa
  unsure (1)..(14791): unsure at all n locations
gggaactaaactggcccttagtgtataaaagttgtactaatagacttatgttttaaagtggaatcatagtagtagttcgttttaagagcaggctataaacatatttttgaagagataaaggaagagagggaagagcagcaggctacagatttgtaggccagctacagcacggacttcaagacgtaatgtgtgtatgacaggtatgaccaggtattaattgtatagtaagcaactattgtatgaattgggtattagattggctatagatgatttggagctagtagttgactatactattaaacttgctttaatagcatctgggataccatcgatgagaatattttttttttgaaaggatggtaaaagctttgcctggtatatatttatagagaaatagatcgatgagaaattcatgaagaaactttaatgttgaagacttctccaattggaagtatgtccgatatatagaaatcaacacgtacaagtacatggtatattagatatcttaaaggtgctagttaactctaaacacggtgtgcatcaagtagcagcgatgacaggcggagcaagaggctcaaccgcattgcgtctccatgctggtgatgcacagttcctatgaaattaatgttggagctggtaccatgttgtctcttctcaacgaatgatattaattgtattctcttcttcagaatttcctatgtaatttaatatgaatctagattttgaaaataaaattatatctaatactcttgcttaaattttataatcaactacattacatatacaaccatatcgatcaatatacagaccatcgatatcgtatagtgtcaacccatcgtgacaaaatagtgcatattttttggaattaacgtgataatttctacacctctcatcaaatgttgtgttttcttaattttcctcccttgtcatatttttcgcgaacgctcccttgtcatatttggttttaaaagaaacaactttcaaactgtgctgtgataattaagttatgatcaatcgactctcaaatgcgtgccatttcaataacattaatgacgcaaccagctggggtttcgatgaaaatcgttgatcacatgccatataattgagttggtgtgtgtttccccgcagcaaaagcttcctaaaaaggaactccagaacagactcagcgcatgcaccaaccacccagatgtacaagcccttatttaaaccgaaccaaatcagtgccaaattaaaaagtgccattaaactaatggagtagacacagcttgattgtgataaataattgcctcgggttaaaataggtcatggtctctcactctctctgcagaaccaaaaaggatcttaagaaccgtttcacaatcttacaatgtccttcatgttcaaggtccaaatcccaagacgtgtcaattaagaaatcaggaatgaacatggagatcaaacaagatgcatatgtttgaaacttttgattcgggtcatatgtaccagcagattagacttaattgggatccccatgctctagatgaaaaagatttgaatttaatggcactaccaagactaggaggagaaaacttaccaacctagaaagtacattaagacaaagtaagggacagggttgtcatgatgttgaaataatccagcaagttcatcatatcagatggaacatctatccaaggactagtagtgactgtgcacttccatgtaggcaaggtaacttgttgagcatgggatttttcactatcaattcttaattactcaaactttatgtaattgtaattaatctatagaagaaactgaggtactgatgtcacatcaagctaaaaagtcataaaacatacacagaaataaactttcatagattaaaataacacgataaatcggagaaaaaaaacatttactctatatagtcaaatcttcgtgagtataaattatatcgacaatgattgatcgatatgtttgtacaggtttggcaacgcttttcaactatagttgtatttatggaaacgtaaataacaattgtatatccaattcaattcgatccgtgagttaaggtgtactttgtatgtagacataggggtgagtatgtgctatttatattattgccggtacgtgtgtatgtgtttcaaaaataaattacgcgcgaaaattcaccaaattctcatttctttttcttataatggaataaaacattccagcctttactcatcagagctacagccaattcttacaaaagtaacacccaaacactgagtgtagttcaaatgaattaaacacacccaacaaaataaaagatcaaactaagataaggagagcacatttattcaagtctatttgtgaatctgcatcatagtttgcaaggagttgcatgaccgttgtctcaagccaacgacctgcaaccttcataagctctcgatcatcttcacacatttgcagctgtgctctaaatcggagccaatatgttgcactgaaaattacctgcatatatgagatagatggtgatttgtcaaaacgatatcatttctagtcaaccacagagcccaacatatggcagaagctcctacaagtatgagtttactcttcttcttgtctacccccaagagctaaccatcaaacataaaacatattagatacggtagtaggaaggcataaaccaagagagaactgtactgctctctaaacaaattttgcataatggcactctataaaaagatgttgaatagtttcatttttcataaaaaaacaacatcttaaactgccattccaatttcgtcttgccaaattatccttggttaacacaacccctttaagcaagtaccacataaaaatcttaatcttaagtggcatcttaagcttccaaataatcttgtttatctcaatataaccattattaattaaagctagatacatcgacctaacagaaaatattccattctgatgataattccatctaaagctatcagaggattgattcaattgaatatgtccaatagaagcacacaattcataccaatatgcaagattctgaccaactaatgatctcctaaaggaaacattgagtggaacagatctcataacattagtaatagtagaacttttccttcggacaatagagtataaagatggatatttgtctttaaagccaggtttcctagccatttatcttcccagaaccttatttgtttcctattatttacaatccaagaactcatatctaagaaggtatctttgatcttcatgagacctgaccaaaaatgagaatcatcccgttttttattaacttgggttatattatagactgattgtagagatactttcataaaaccggttcaccgagctgatcctatgtttccctatggtggctcacacgaacgagacctaaaaatgccaagaatctgacactgaaacggacggccgagatgacgcgtggcccgccgaactgggcgtccacgcaaggccatgaccccatagatgacctccccatagaccaggccgcacctccgtgtcgccgtgcatccatcccaaggccacggtgatgacgtgcccgtgcgccgtatcccgcacccgcagcccccgtcctgagccgcgcgcgcgcggtccacacgcgcctcccctcgtaggacgggtcggtcgcagccgccgcccccgccccgcagcgatccgctaagcgaagctgaccggacttcgttaaccgccacctcctccttgtcggatcatcggatcggcgcccgcgcgcccgctaagatgcagccccctcgcgccacgtcacctcccttcccctgggcgccgcgcggtgccggatcaccacagacggatccttcttcctcctgttctttatatgagcgacactaaagaaagcgctacacacacgcgaccccataatctttcctacagatacaccacccacgccagttagaggttagaaacaaggcgtcgaacaccttaacgccattaccgaaaggcttcgagaattcggtggtgggtgtgcgagggagagagagagagggggagagagggtgtgtgcagtgaggaggggccctggcgatcgccggagggatgactacgggcgcggcggcgggggctgctgcggctgcgggggcggcaccggcgtcgccggtggccgccgcggccgcggccgcgcccgaggtggcggcgagggacgccgtgatcgggtggttccgcggcgagttcgcggcggcgaacgcggtgatcgacgcgctgtgcggccacctcgcgcagatcggcggggacgccgagtacgaggccgtgttcgccgcgctccaccgccgccgcatcaactggttccccgtcctccacatgcagaagttctactccgtcgccgacgttgccgccgagctccgccgcgtcgcggacgcccgcgcctccgccgcctactccgaggaggaggcggcgtccacggtgatccacgagcccatggacgagctcgtcgccatggccgccgagccggagccggagcaggagcaggagcccgaccacgaccatgtacctcaggatccggcaccggagccggagcctgacggcgccgtcaacaaccccgtctcccccaccgccgccgaggtgctggaccacgaggcggacggggaagattcctccggagattcgtcggagcgcaaggcaccctccacggaagatgacgccgtcgctgacggacgtaagtacaatcaccccccccccccgctaattaatcctcctacgcgcatattaattacatgtgcctcataggccatagcttttccaaccatcgttgcttcctattttcggcatcggcattttttttcttgctaaatccgtcatcgtttccgttagttcatccgtagaatggatctccagttttggcccgcttcagttggatctggtcgtttgctgtggatttctctgcaagttttgtcctctaatctcctattttttggggttaaaagaaaaaagtgattaatttagactttcaaacgatgcctttctacggtaaataccattgcaaaagctgcatctgcatggttagtactactagacctggcgcgcgggtccatcacgcttggtggttaggagaaaaaatggaggtcgagagggccaaattattcagcgccgcaccaaatgcggagccatgattcttcctgggacggggagatcgtacggcggggcagtgctcctccctgtcaatcgacgccgtccgtgccggcggcggcggcccgtgacctcgctaaaaccctaccgctttattgccttctctcctctccatccacgccgttggattcctcctctcttttcctccgcctccttttgtttggttttctccgtctcgtcgcctccacgcgcgcgcccgcgcctcggccaccccttttggcttggtccccctggaaagtaccaccgctggtacggccgcttctgccagtgcgattagcaaaaacgtgccacgctgtggttgcccttttgacgcctccggcggcctctcgccgtgggtcggcggttggcttcagagcggcggcggcggtggccttgaattgaatggaaaacatcgtgtgcgttggattctagcggctctcatcaacctgggccctgggggagtggggggctccatatggtgtgaggtagccgacgctgattggctcggcgtaaaatattgccgtgcatgcgttttgcatgtgtggacggccggagatcaccagattcgggttgctggttaacccgccgggcaaaaagactgtgtgcctcctcctcacttggaggagatggagatggagatggaggccgtgatgcgtggcagtgtggcatcaactttgaacaggcgtttttctcttcaaagaaataaatgctcttgaaaaaaaactgtcatgaaactgttgacttttttttatttgggagaaatacagagtaagttggtgtgctttaagttttgttttgtgttgttgcatgctagtatttcggttgtgtgtgtagaattgtcatcatcattttgtcctggtttggggggtgtcaaaaacgtaattagggacggtcgttgtcctcttgctcgagtgacctctagtcgtctccttctgccttaggcaagcacaagtgtagtgatcaaacatgagaaatcatacacactcatttaaaagaacaaaacaaaaaataggaaagtgtgaatatgtcatcctcgccttggggctagaagcctagaatgacgaaggatggttttttgccattgttttgcaacaaaagcaaacaaatagaacgtgattctttttgaaagtaaagaaagtggattagtacattaagaatacagagctgatagattagatgaaaataaaaatagtactcctactaagtggcagtatcgagcgtggtacacacgagagggaacttcctcccatcctccgtgctactagtactgcaacgtggatctcatgagatggtgtcaggccatgtcaggtccgcgcggtggagccagccggtgcgccgcgacggcacggcccgtctgatcgcaatcaaacggagccagacgctgggcagagttaaatggacccgcacgagactcgccgggcggcgggtcaccgtggaaaaatcaattcgttcgtgcccaaccctgcacgtgtcgatgaccggctggacccagatcgggttcgagaagccagaattcccggggtccgaagggctggatctggtgccgtgccgatcggatcggtcgggacggagtctgagctgtgttacacgtggttggccgacatccactggctggtggggtccggggccaatcacgcaggtggtagctcgggcccactggcagcgccttctcgagagaactctttgtctccgcatggtggccactggccagtgacaggtctttgtgctctttggctgctctcgtgttaagtctttactctttagccgccttgaggctgcaagcctgctaccatcagcccaagtgtgtgggtaggtgtggcgaccggcgacggcgtacacaacttttgaacttccacatgattagatcaactgtaggtgatttggaattgataattcaggttagggcagcgtagccagtgcgacgctatgtttgtttctgcgttgtatattggtgatgtgatcgtgttccgcgatttggcgacttgctagttgctgctactagtcagccacctttgcaaccagtccggatttcagaagattttctgcaatctcttccaaattgactactgacggactacacacgagtaactctttttttcttctaaaagataggaggaaaaacaatttcttgagtttcttgtgctaaaaggaggaaaaaggttttgctgtgcgtgctgcatagggtggtctgatgcaaatcgtctttatacattgtcttcgcccaattattgaacacgtattggtccctgcttggtgctcgcccccacacttatgccatatgtactaatgaccatctacgcttcactcaacttgcgggaagaatctcccgttgtgctcgctcttctctttattgcgttatcacgaaaggttcctctttttttctcctcatgctgtccatcgaaaatgacatgaaaaggactacagcgtaggagtcctcgacactaggttatttcttcctgggctatgatggaaattttggaagatcaaggggaactacagcgtgtctcaaaatgtgatggcaaaacggtaggtgacaacaattttgtgtgaatgcaattgggcgatagacttggagaccttggtgccgcgtgactgtgcccactaacgaactctcactgaggatctaattatgccaggccagaaaagcgggtagaaagtacattttatattttattttattaggaggtttacgattttattaggttctttagacagcctcaacccataatatctgtcggtgattgtttagtaccctagctagcttagcttggtttctcatttcctgaacaacatgataagagttatcagcttttagatgtgtatcctttgtgcttgcaagctaaaagatgaacagttaaactgaattctcagaatgcactttcttttataaaaataaggcctacggcatgggtgcagttttttttatagcgtcaccagtcatatatactcatatccgtgattggaagttttcatgctttctgctgtttatcataagttgattgctctttgaaatagatgttttccttgaaacatggtaccgcagttaaaagaactttatatctttattgtttgaaaacagagttcaaatctaattgctaagaacatatccactgtttggatgcatctgagatctatattacttagcagatgatcatactgaccaaggatctcaaggggaacacagcctaccagagagttaccctatctgctctgatcacgaggagtgcattgtccgccccgagaggatcaagattcagaaaggttttatggccaaggagtccgtgaaggggcacatggcgagttccttctttacatcactcggcaaactttctgtattgaagaactaggagatgctgtaggacttagcagcacttccattcatctaatacgttcattcttctaattgctgtttttgactggtgtttatgacttctgtatgatcaggttaacgttgtgaaaggcctgaagatttatgaagatgtgttcacaacttcagagctcatgaaggnnnnnnnnnnnnnnnnnnnnnnnnnnnnnttcgtcaggctggcagaaatggagagctttcaggtaagttggtgtttttgttgcttaaaaacatttttgttcgtcaaatgtagttttaaagatccctgatatggagtatgtttgcattattaacgttaggtgctatttattttcatactttttacttttgtccatatctctttggtgctctccaattgattcttctaagataccaaaaatattcttgcgtccatagcatctaaaggtggtcctagttcaggcattgctacctttatctattggtggtgatgattttatttgatattattttgtggtaactgactccgatatctggatatccagttcataacaactgtcgtccatatatttcacataatatcgtgctagaagcaatagaaaatgaagctaagacattgaagtttatacacttcttgcatagatagattttttttagacggaaggccagtggcccggcttttaattgaaagccaaaacggcagagttcagctggggttgccagcgtactgcatagatagatgccacctccagtcatcctaatcaagtaaaagtataatttgcatttgacaagatcacaagatagtcacaaaccttgtgcctacgatacctaatggactcgagcatgtgtatttgctttaacttaatctaactagccatgagttctcaagttatcttaaatgacaatagaagacgttgagcaagagtatagtttaattatgacaacatgttagatcgcttctatcttatcggaatgggttctgcaccacaaaacattgatccaagtaagatctcaactttgtagccttatttggttcttgagtagagaaattttatggtccttgaaaaggtatctcgatgtacctaaattttacactaaaaattttagcatctcgaggaacctagtagcatttccctattggttctgttgattgttcatgtttggctatgttgattgttcctgcctaccttgtaccttgaaatgcgaccctcctattacctttgcctttgctgctatcaattttgtcagtttggagctaactctctagttcaaaatttaggtgaaaccttcatattcttcaacaagcagattaaagggaacaagagggagatcattcagcttggcgtcccactatttcagcccaccacagaggaatctaattgtatgatcgaaaaactagacaactctactgtgatttgttctacttacttacagttgcaagaatattctttgaagtgtggcatatcatatttgcatgaacatgtcttatccacacaacgtaatggcctactgaatggtggtttacaactgttcattccttcctctgcgtacaggtcacatagaagcaatcccccttgtcctccaggctgtcattgatcatcttgttctttggcgtttaataccagaaagcaggaaacctaacagtgtcatcatcaacttcttcgatgaggtaggtactggttcccttataaaatagtatgacagtacactcgacgaacccaaatgccccttttcttctatacttcgttgaaacttgtcgtataatattgaatagaattggaagtatggttagcctagtggtcctagggaaaaaaaggaaatggataaagaatgtgattttaagaaaggaacatcattataatataataaaatcactcttcatgtaaatgccagaacagttgtattgttcacttcttgttctacaagtggaaggctgaagataagtgtaaaaaatatgagaacgaagaaagttcgaaatttctgacatatctacttcttccatatactttgtttatgacttcctaaccattttactcgtttggatacaccccaaacccaacatctgcttgtgtagaactataatccagacccatacctacggatgggcctggatttgttttagactagtgatgggcctggatttatccaatggcaagcgtaggtgatgaaaaatcagttggaatttaggttgaatcttttatgaagatcttgagcttgcttgatttccaatgatctgctttgactacacaaagtcaacttgagtactaggacatcagtaatttccatataggacatgcatgcaccaagaactcaactgcatagaatagacgaacaaatatccttgctcaaaagtcttgtccaggttgtgctctctgacaatctgacgctatggtggatttgtttgacaggatgagcactcgcagccctacttcaagcctcctcacctggacaacccaatctccactctcctgctgtccgagactacgatggcatttggaaggtcacttgtcactgacagcaatggcaactacaagggaccccttacgctctcactgaagcaagggtaaaacatcgaatcgcactgacatcatctgcttgtttttagagctaagctagtatagttgtacatgggctcatggcgtctctgcgtcgaatttgcaggtcactcctggtgatgcgcgggaacagcgcggacatggctcgccacgtcgtgtgcccatcgtccaaccgccgcgtgagcatcacgttcgtgcgcgtgaggccgtcgacgccggtggacctcagcccgctcccgtcgcccaccaaggccatgacgctgtggcaggcgccgccgccgcagcagcagcagacgatcccggcgcccggcatgcagcagaagccgcagcacggcggcgccatcatcggctacggcccggcgccgcaggccgtgctggcgcctgcgtggggcatggccgtgcgcgcggcgcccgtcatgatggtcgccgcgcccgcgccggcgaggccgatggtgatggcccccgccggcggcaacaagcggatgagccgcagcggcaccggcgtcttcctgccgtggacggtcgggcccaagaggtacaacaagcacctcccgccgcgcatccagaagcgccggttctcggcgatgatgtcgccgatcgaggcccagggctgacatcaacaacgtcacctcaccggacctcgccacgcctcgccggcgtcgtcgtggtcaccattaggccgcattttcttcttctttgaggcaaacaaaaaaaaagaaaaggaaaaaaaaagtcgaaaacgcgcgggaagttcagtcttaatcggtgtgtcctccctgtgaattttgtcgtcgaagtggtgactggttgtttttgtttggtctgcctgtaatttagcccgggtgtgagtagcagagatggaagcggtagaatatatgggtaggcatagttgagctcaggatcaatcaggaacagtgttttctttttccctttttggttgcgagaaagaactactggatggatgttcatgtcctgctgagtttgcagtaagctctaaatagtagaggtagatgatgcgtctggtgttgctcactttgtttggtttgtaccagcagatgtacctagttatgcttatgcatcgattttaattgtttgtatataggatttgccagcaccaatcgttgagttattctcctaccagtaaatgtgatgaatggatactccaactgaagagataggagatgaccaagtgaaagttgccattttgtttgagatacatggttgccatttccattgtatagagaatgattatagataattgtaatgccgtttatcctaacatttctccggttggaaaatttgtttacaattgaatttgcagtctcttaaccagttaacttccactgactcggtccaagaaggtttcatcccctcctttttggatttttaaaaataacaatagcttttattcaacttaaccaattacatagcctatagaaaaaccaattacatcgagaagacacatctatatgagaagtgagaacaccctcagcttttacatagcaaggacacatagttacacacacacaccctcaagtttataaaataaaaaatacatgaagttttatggccaatcaacgtctagatggccatccacatcatagggtaataaacaccttgaccactttctctagatgcagacataacgcaatcaccaaatcttgcatactcctaaagtataacctatgggagccaatggattagtgaataataaaacatgaaaagctgaagagataatgtttttctaataaaaataaccatatcattcacgtacaatcaaagcgaccagcaaatgacatccgcctttaacaagacatgaggtttcatattattttggattccccaaagccatctccaaacccgtgagaaacacttcaaggtggagggagatctcacaccacttgaataatagaccaaatcgagtgagcacaattacaatattagaacatgtgtttaacaggaacaatgcttttgactaccttactagttgtggttagttatgttgccttagctccacattgcaataccaaacaaatcttgaccttaagtggcagctttagtttctagagatgtttggtaagtacataagaaggctgctaagcattaaattaatcaagggtcaattccttaagtacccttgaaacttcacgcggtcctttctacgcccacgagatttgcttgatcccttgtatacatcggagtatttttgtccttgacatgcctattctgttagtttactattagtttttttttaaaaaaggaaatgatcttattgtttctttaaaaaaaaagatcttattgacctcggcatattactaaaagttagaaatattctatatagaaattgtttgggctgtgaaaaaatggtaagcagtaaattaccgaatatgtggttttgaatttaacttttttgaaaagacaattcattgaaatttacataacattttgaagctttgcgtcgaatttgaaaattattatttgaatgaatatgcagtttgaaaaatgtggaattttttcataaccgtgtattcacctttcgccagtattgacactatttttatttagttcaaaattttaatatttttgcgagtatgtattcaaccaccgtatattttttataactacaaaatttttattagcgaggacacttaccattttgtaatacacaaaatagggacaatatggtcattttagggaaaacataatggtcaactaatggaaataggcatgtaggagatcaatatagaaactcaagggtatgaaaaggattggttgaatcttaggggtatggaagggattagttagacatttaggggtatacaaagaaattagtgcgacccaacctttcttggatgaaagttttcctttccaactacagagtatgttcttagttttggggtttatgaccttctctctctccatggagatctagctaaccctcacactggatctgccactggggacagcagggaggaggggagtggtaatgtgcatggcctaaggcataggaggattccaccaaggaaccacatagggtttggccaaaggcagaggaaacatgatgcccattgcttcatccttgtctgcctaggtcgccatgatcattctgggagcatatggtataagacgacgtcaggccctatactggcttaatagccagatttaagaccgccaagccatagcaaatgaccctaccattgacgcacattgcactagtctccatggtaacaacccccttccccctcccccacagccctagaaatacattaagccagagttgtggaacgattatctattaatgttcatttccctagggtgtagtgtatgatcaagatttgtagtatgtatgtgcgcagttacatgtgaatataagtcccatcttgtagctcttaaagatatagtgtaatatctgtcaccttaatctccaaatgtaattcgccatcgatatgaattttcatacaagaatttaggatacgtgagttaatatctgtcaccttaatctccaaatgcaattcaccattgatatgaattttcatatagaatttaggatatgtgagtcaaatcgttgttgttggataaagattataggcgatcatgcaaataacaaaccaaatatgcatgacacatgcaactctacatgcaacacgctgttaacgaccaaatttggtaatccaaggatcggatgtgaagaaggaatcgagacggagttcgagatagagatcgtccggaaacagagtgaggatcggctgaagtccgaatcggctgtgactaggatcggcagagttcgagtcgaaca

SEQ ID NO: 73255 - DNA, 987 bp, Oryza sativa
tatagggccaattcgagctcggtaccccatcagaccgacctcaggaggccaatgtccgatgtggtgccgggggctactgtcggagatatgggcccgggagtatgcgaagtgaggggaatctaccttcccatcctgccacgtgtccctacagcctggtcctgtccccgtattccgcgaaccgcaggagcggctggggggtcggagcctcggggtgccacgtcatgcccctcgggcccttgcactactttgccccgaggccctcgcccaaccgccgtttggggggggggagcaagcgaggagggagcccaggctgaacttcctttaatgcgcgcaacgccccaactgccccatgtcgcatttaatgcagtggggcagacgtgcggcgtgctaaactgacgcgcgatggtcaagaatgaccggtctgtgaccggcctgacgccggtcacgtctgactggacggacaaccgtgctcccacgttgcatctgcttccggcagagtggaggtaggtatgacccgtcccatcggggggtcgttcggacggcggccaccacaagtcttcacctattaatgagggaatgacagggttgtcccccgtgtcaggcgagggacggcgctgggccccgctcaaggataagctgtagtttagcttccaggcgaaggcacgggtcgagttccagtcaagatagggtgggtccccacccgaaagaagagtaagtagaggcggtgcatgtggtatccctttgaggtataaaagaaggactttgcccaccgagaggggggacgactctcagaaaacctgagcttgtggaggagggaaataagagtgttctccccaatttaggaaccctttgaactctcagtctaaatcccatacacaggagtagggtattacgcttgatagcggcccgaacctgtataatttggttgtgtgccaactagctaggaaccttggggacaaatacgcgattctagaggcgagctttttt

SEQ ID NO: 73256 - DNA, 1645 bp, Oryza sativa
cccatgcccaggaggaagccgagggcgaaggtggcgaacacggagaggcccacggaggcggcggcgagggggaggtttccgaggtggccgatgaacatggtggtcacggagctgatggcgtagttggtgatggtgccgatggcgatgggggtgccgatggcccacagccgctttgtctcatgccagaacatgcgcgccgccgccccggccgactccacggcggccgcgtcctcctccggcgctggtggtgacacggagcccatggttgattggttggagagcagcagcagcagatctctccctggtctggtcaaatgtgtggcgaaggcgcgtcatttatttggggagttgcgccggtccatttcacaatgaatgcgtatgactttttttctgcttggattttggattttgcttggagtaggtaccagctacccgcacgcacgccgctatcctcctcgtgacacacctccatttcagtttccatgccttccctttattaaattaacggagcacggagtacttatcaatcagagcagatacaatagcagtctataaaccaactataaatatattttaaatagataaaagaagaaagagaaaagcagcggactacagatctgtagctagctgcaatatggactctaaaagtaatgtgtgtatgatagatgagactaggtattaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatagtaaatgaaacaactattttataaatcgactattacgttggctaggtgatttagagctagtagctagttatactattaaacttcctcttagatgcaaccaatgtagtactagagagaattaatacctgtaactgtaacgattaaaaaaagaaagaaattaaaaaaggatcggggcaaaacaaaaccgtcatttctagtatggctgtactaggatcgtcattcgagccattatttttctctctatatttttcgtaatttatgaacaaaaaaataaataaattcgtactccagtccgtgtcagcgagtggtacagctgagtaaagggagtgggtggactgtgcggtgcaaacagctaccacgtcttcacgtattataggctcctactgggctttctttctttctgttgggcttgaatcctccctccaacacgaatcgcaatcgcgcgaggcattgtacatcggaataagtccatttttactcccttaaaattgacccaatcaatcttgacacataaactgttaaatccgg

SEQ ID NO: 73257 - DNA, 22198 bp, Oryza sativa
  unsure (1)..(22198): unsure at all n locations
tcgccacccttttactttcgttttgtttcgacgagttcttgctttcgggttgagctgcatcggtttcgatcttcaacaagaggtaaaacttgttatggggcttgcattctcaggatagtgcttacatctttatgatactctaatctcgtttatgtaattcgtcgagttatcatatatcttatataatctctggcaatatcgctatctgaccttcaatcggctaacttctgttgctagaaggcagccgattaggttaagtaccgatgttgacttagattatataggatatctaccaccctatgaagcattcaacgacttgattgtttagatattgtctttcttttcatacttatagctgcatcagttgagtttgatcttacgaatcgtgattagaatctcaacctctagcctgtctttggttgacgattagggtagtatcggggtttcagccaatcttatctgatttaactacatttatcttatatgctttattgacatgttaaatttgccctttatgttaagatcttattgccttcaaatatattaggatttctgtttagtatattcttcttgctttaatatcttaatatagagtggtatcgaagtattagccgatacatgctagatctatctgatcggctatgctatgaacatatataatcttgttgtcaatatatatttcgatctaagtgatttatactgtctcggcatggtgaccgatctatcccaatcacttgatttaagtatatatcgacataaagattatataccattgatatctacagccgatcgagtagatttagttctttcttatttcttaatgactgccgatcgatgcatatatgacatcggctcaaagataaatgatatgtcatcgccaattagccgatcgggctatcatttatggatttaaccacggtttctttgtctttgtttgtgttgacgaaaaaatcgaacacaccggcctgggagatatgcttagctccagtgcaggtccaaatatgatgagatgcgggcgtgccagtcaatttgatcctgcaactgacaagatatgtaaacagcagataaaacagccgattggctgacaagccgatgtagtgattccagtcgatagcgataatagccaatgccgataccagccgatagcgatagggtttaagcaatcggctatatgtccaatgtagatgatgatataaaggcaatcggctgatgatgatgtaataaaataacaatataatatagtataaaccaatcggcaaataatgatataataaataagcatcgatccgaaggttaaagcacacatcggctggaggtccaatgtcatgaaatccacaagattagattaaacagtgaaacctttgttgtcatcggctaaatccaacttatatgtatatgcaatccttatgggccgatgcaacgtctagataactcatcggctgaaaccccgatgaaacccttattggcaatcaagaagcaggctagagattatggttctaagcacgacttagtagatcaaacttaactgatgcagcactgagtatgaaaagaaacataatatctagacaatcaagccgttgactgagttttcagggtggtagatgtctaagctaatctaatctagcaacgtgatttagccgataccggcagaaaccgtaaaacgagaagtagccgatagagctaaattgatatgctaggactagattaacatagacatatgataaacatgtaggcaaatatatcatccaaaccagagcaatccaagaggtcgaatgtactgatgcagccttgaacgacgccgacgtagacgatacaattgcctggaccggcggaacattggacttaccccttagccggagatcgaacaccgatgcaaccctgcgtcgggtgccaagttccgccggaacgtaaaacaaaagtagaagtaaaaagggtggcgatgcgccgaattgtattgatcgtggagatagattacatagaccccaggtgtacatatttatacccatgggttgatacaagtccttgtcggacaagaaagaaacttttctaaagataaaaggaaaagataaagtccttataggacactaaacacactttcctaaagataaaaggaaactaacaaactattcctaattaatagataacttgccacgccgcattctctttgaacttggtctcttctggataagattcctttagtagatcattttccttaaccgaatatagcaagaatccgacaactgacgacttgacaactctcatcggctaatctcaggacttcgaagccgatgctgactctaagccgatgactactccgggcttaccaaatttcactgttaacagtttcttgttgattgcaggatcaaatcaactggcacgctcacacacccaaaggcatgttttggacctgcactggagttaagcagatctcccaggcctcgtgtttttacatcaacacacgcatataatttttctacatacttcacatccatggggaattgatttcgacttaccattaatgaatttctttgttgctactatgatgaactagaagttagataatcatacacctatggtcaaaaatatttgagatgcataattaactcatgccaagctatggctagaaatttaagatagataagtcagtcgctagtttgggcttgtgctcttgtgagtttggcctggggcgagtcatgtgtgagaaggagctcgggctcccgagaggagaggtaactaatgaacaagcaagaattatataggttcgggctaacacccaactccagttgtgttagtgatatctctcctggttgtgaagcatcttacaagtttatcatagactcaaagtagttcctcttcctttctcctctggattttctaagaatttgataagtatgcagataagtgttctacccactaggtatcgacctcctcccccttgctcctagatctcctttctagttctctagggaagaccacatgaccaaagttcgaggaaggagctaactttacaaggatttggtgtggaatgtcttgtcagcaacttttcttctcacccgatctgtcggcctcaggaaggcccaaataggatccacagggaacaaggtgcggtgaaagctcgtgacgcacccctgcttgatgcacgcaaacatgtgggaataggattcaccacaccctcccggtggtgggacctacgtgacaatgtctggtaaaggatgttaaaaacagtgggcctagtgggaatgcggtggtcaaccgcgccacttggtttcccacatccctatcaaggtaggcaaggggtgaagtgatgggtggtaggtgtggcagttgttgccctatctctcatgcgcctcgccccgaggtaaacatcttgtcaccctcaaatggggagacatcaagggcccaagcagaaatggctcatccatccagcttcaattaggaatgttagctcaggttctgccccgaaggcccttcggtgagctccgtccaagatttaaggagttatcccctagcaaggccgctgtgccccaaggctcggggctcctccttagctccgtggggcttcgcttgccatcctattggagagccacgtgttgacctgagattggtctatgtcttgttcaatggcttaggggtgaggtaacggggcatccaaccggtctgcgccattggttgtaggaaccatgttcccttgtcacaaagagaaagtgtttgtctatgatggtgggggaaacttgagtcgtcccactaaatagtttggctatgattatgttgtctttctttgatgtcccaaggagaatcctggagaagctggattattcctgatattgatttttctggcaaagtgacttactgaatggaatactctatgtagacaaaaaaaaagggtcttggaatcctaaatctggatatccagaataaatgtttgcctggcaagtggttattcaagcttattagtgaagctagcagaacttgcttagaagaaaatacctatcaaaagtaccgttattaaggtgcgaaaacagatgggttattctcatttttggacaatacttgaggttaaaacataggctttttttttcctgtggctcttttaaaattggcacaatggatcccggttaagattggacgactgctgattgggtgatcatccccttaacactttatacccctacgttgtataatctgattagaaacaaaaaattctttcgtgagtgaagtgttctccagggttccacttgatattttttttaaagggctttagtgggtaacaatttgttagcatggcatattttttttaaagattgtggcagtgcgtttgtctggaaggttcaaaggatgggaattttttcagtgacttctatgtacagattgctcatagtgaccgtgatagttttcaattctattgccaagttgcaagattcatttggaacacgcattttattatttttggaattcgaccatcaactagcaagtctaatcttcctgtaattggctaaatggtattcaacctacactaaaggatcattttttttaggaatcacaactttatgttgtaatgtttggttaagtaataataatgtggtttttaatggagccaagactaactcctttttcaaatcattttcagagacgagttaaatttggttggaactttagaaactgaattttagtctccctcgtgtgtcttggtctaaacctgtgttaaaggatgcctttgttgtgtgttgtttgttgggtctaagtactcttgtattatcctttggctgcgtacacccatttgggtgtagaggacatgttttatctatctattatctaaaaaaacacgaccaaaaaataagatgatatgattcatctatgcagctgcggcctgaaattctgaataaatgcttggtattctgctttgcatcataaaacagacaaagatacagcagccgatcgcaacttcacgccatcatcgtcccactttgtctctggagcagtggcaccggcaatatatgtctgtccacacaacaccacatgtcaattcaaattaaatactgtgaccgaaataggatgccaaagtccagcaattaaaaagaaaatgaatcgataatgtcattaaatctctaagataaagctacagattacaagctttcggcacatctgtatatttggtccattgttgttcccagaacagaaacaaacatgaagacaggaaaacattttcccagaacagaactgcccacaaaaacataaaggaaatgagtgaatacctttccactattcacagtagccattacagcaacatgttctttgtccacaccaaactcataaaagtaatatgtcctgcagaaccaatctctcatgaccaaaatcaaaatacaagaacaattctgtccaaattgggacacttattgatgagggataagattttttttttgcctcaaaataaatagaaaaggtcatatagtaccttatatcatcttcatccttaactttaattgttcgagctgagtataattttgcgccacctatgaaatgagacaaaagaatttacaaacaaattggaagagctaagtcagatatttccaaatgagtacattatgctagcactacatgctaacagaatatttttgcttcatgtttcctcatataattttttgaagtgatggaaacaaaaaatggatacaagtttatatttctttgaatattttaaccaagcatcaatattgatcatacaaagttttacgaagacaacagtagataacgacaaagttgtacaatgtgaaagaaacagttcaaaatagaatgtagtaagcatgtgagtacattgtgcaactcattaagaaagcagttaatagtgcacttccttgctggacatttattttaaaaatgatgcaaaattaaccaacatcataagaacattgttaagataagatgccccttcaatttgtaaacatgatgttttagatgttaggtcattcaggtgaaacatcatatatacagcagcgcccacacaagaagctagatcaagagttagcaatttcctttgataagtgaaaactgtgaatatgccgtgtccttattcatcttagaaacttattttaaaagcaaagtacatctctgaagtctaagataacagtaatcaccaggtacaaatatctttgatgcctcctttaaagtgcccaggtctgttatatctttggcctacaaaccaatgtttgtgtcagaacataaattttttggctgattgtgtgcaacataaaataattcaaaataaaaaacatgtctttgggccttgattacagagaattgttgatataaagaaacattatgaacactcctgcacctactagtgcagtaccagtttctactagtcagttggagcaaaaaaagtaatgtttgtcgcctctctgtgaatcaatgctactattgttcattataaatataattaattgggacttgacatgtgttatcaatactatatttatttctatataattcttattattgtttaggggtgtttatcaaaggatggtaaattatcaacatataaagcaccatcaaacttgtcatcatttcgttttcgttaatgaaaacaggaggatcctgcctctctttatcaaaaaaataaaataaaataaagtgccatcaatcatactaccttgcataacacagtgagacaactgcacaatattgtaaatcaatttatagtaactactaactagtgtgcaaagctaagccgctttaatgattaggaaatgggtcgttggtcattccaaagagttgagaacatcagattatacaaatcatcacattatcttgcatcacgaccaactaaaaaaaaaacgaaccggtgctctaccattatttttcttttagacaaaataaatgctgcacatacagaaaaattcgggagggagaacacaaaacaatcaaactatagtaacagaaaaataactagttgctgtgcaaacctctaggaatgtgattttgagctgattcgatggcttaattaccacgcttacaagttcagacctgcattacagaaaaataacagggtaatcatcttagctcgttgaatgtatttagtgatacaaattctacccaatttcttcctagagctattttcgtaggcgaatttgagattaatagtattgtaaaatttataatcattacgcatatctcgaaatgctagagagctcgataagtcaaacgggaccttacttacctacctgtccggagacgcgaagcgagcagcgtatgtcctgggcttcgccttgtcgccgtagtaggtcatcccgacgttgaactcctgatttgtcgataaaattccgaggttaaaaccaaaatgttgagctcgcggcctcgcgcgactacaatgcctgaggaaaccgaacgcgcaaggggacattgggaggagaccagagacctcgggctccaagatgtcgtcgaaggaagggggaacgcggatggagaagccgctgccgtagtactgcgaccaccacttggtgttcgcgatgccgcccagcagaggggagcccttcttattttgggaaggctcccccggtggccgcctcctcttcngcggcggcggcggtggccggacaacggagaaccgcacccccgcggaggccgaggcgatggcggtgtggatggcgaagtcccggcgcgaggcgccgcatgccgaggcggggctccgccgccggggcggcgggttctggggatacgaaggcgagggggcgaggcggaggagcacggcgggggccattgcgcggcgaggcggcggcgccactgccgagcggacggcgcggaagccgcggcgggagaggctggaagttcgccgtggtgagaggaacgcgcacgcacacggggtgaaccgattttttggtggataagcacggcacggtggtgggccctcctttccgcgtgcacggcccacggcccacggaccacggaccacctcccctgcagaatcaaagcccactattcactagttcacctttctgtagctgaagagtccgatccattcacttgttatctactcacccttggttcttcctctctctcttccaaatctccgaatccagtgctccacccgtccatcgagcccggctgagggacggagacgtcttcgccgccgacgaggcgggtcccggccttgtcaggttagggcattcccaagcttcgctgctgtcgaggcacctagtcccgtcgcagaattttttatttttctccatatgattgcatcagtttttctcagtaataactagtatattttttgttgcaaattatcttccattgttttgcttaccggggtatttgtggcccaacaaaaggttgattttctcttgcagtcaagatgtctgtgtcctgtgttgcatcgaggacaatatctgtatttttctttctttttgctggaaacatgtattgatcatacaagtctgttacttttgaaactcttttacttgggtattgaagctagtaaatagaagttgtatgatggaagtgttatctgacatcttttatgtggccaagataattatagaagttctaaaaaattagtggcatagataattgtatcgcgtgtcactccacagacatgtaggtcaaatttgtttttttggatggaagagtaataacaaatccaaatgcaaatgcttttgcaccttgttaagtctggtttgtttttctattttctggtgcgtggattgaatttaacttttgtttgtgtagtgttgtattcgtcataaatgtatttattagccatctcatgtttctttttggtcatcagttgaccaaacagaaagatgttggttcgtttctgtcaagaacgttttgttgtcatcattgcaattgaaactctttgtttttcttgttgcaacaggccgctcaaatttccgtaaaaaaatgacattcacaaatgtagcatgttgagtgtctaatgggattaatccatcagatattcaacccatagtcgcatcctgttttatgccattaacagtgataaatggttgtcgagcacattgtgtgaagggtgatccaagcatctaagttgcatcttttttcttcttttttttttttactttatgcatatgccatatgctatccattagcctatctgtgacaatttggaatctgaccgatccgtgccccgaatttgtatgtaggtaaaccatattcgtgaaaaacagtattaaacagcaaattggcagtggacaccctcagcaactgcacaactcttgtggccgaacgtggagttcttggttacgaggtccgtcaaaaagcccaagaaaaaaagtgaggcagatcaaataacaagcttgagtgcttctctattcgatagaaggttcagagagtggaaaaaaaaaacaaaaagctcgaagaaggtcaggaacataagctgagggagccatgatgtccactctctcattatcttccccactcttcctggcagctcctcccaaaggtaaccatctcccaatccaagaacagctctttctcgcactaccatgggctcctgccatttatggtagataacccttgctgccagtagacgatagtgacaacttagttaccacactctttctcttgagtggtgagctttgttagggtggtgagtagtggctactgactcgtttgtgccatgtttattggagcaagaggaattcaggaccttccatgtgaaactgcactagatcttgagatgagaagctagcactaataggcttcagttgtgcttaagccatgtacttgctgatatgtaaagcgagataagggaactgtccttcattggaatagtttgcggtggtggtgactggttgattacctgcctcctccatataccagaaattattaacagagactgtgaaaggtcacagctttgttgcagctagggtcatgtctcacatgtatttgctatttttgtgatcagtcctgaattaaaaagttgccgttgtttactacgatatgatatactgcattgctgttatcataatgttgtacatgtgaggtgatttgttttttgttctacttctgcagttcaaggtgtgatttcgtgtcgagcggctttagctagtgcatcatggaactctgttatggtacatggtgggaggcaacggcgtgcaacaatagtaaacgtggttagactttgtatagtttacccttcctttttagcacctcttgatgtggttcaatttaagttgtctttttcatgattgaagaggcttaaaatttatttcacgaaataatggcattgatgcaccaattaaatcatccaaggggagcggatataatgaaccagcatagtttataaacatttcatgcacaattgcattaaaaatcctggcttgcccaacacccaagaatttaatttaccagtgaaatggaatttgagtttgttttcattctacagatttttcatgtgcacaagataacttagttcacatttttttttatgatctggtaacctgtgtccttcttttcagcttggaagaaagtcgaagaccagagagactatcgtccctgaccctgactatcgattgccaattgttatacttggtgagccccgtgattattgagtagaatatttctagatttgtacttatacgtgaagtctaaagatgcattagttgttagcattgcgattcctcaattcaactaattaactagtattatccaaatacagggatagctggtgcatttgcatatgcagacaatcttcttgctgctgcacctgtaggcctactggggtgtcttcttttgttccaggtcagcgcaagcctgattaagctctggttttataatatctgcttaagatgttgtgatactatcttttctccgtaggatataatctttaagaccatattgagtaatctgaaatcaaacttcatggaccatactgcatgaatgcagtgttgcaagagctcctcttgctaattaattcaaattaaaactagttgttcataagcacttccatcatcaactagcacccatggcttattttttcgtctctttttgaagagcacctttttttttgcctttttgtactttgattgaattttattggtcatttttgagcaatcgtttgcttcattttcatgctaacacggatctcaatgttttgcagactactagagtacgatttgtcttcgatgatgaggccctggtttgtgttctctatcttctcaagtaaaatacttatgttgctaagtaaatgcattactgctaagatctgtaaatctgtaatgatttacctttttttataaaaaatctgttatgactctctgtcacatgaatgatgttattcttttcacatcatagcttatgtggattaaggtgtatttctgggtcttcatatctataatttcatgagtgtccttgattctatatttgtgttattgcaggaagtgaaagtgggcgatcagttagaggagtcaggtgaaaatgtatttgtcggtggcaagaatcgttggaggtaagtaggcatgtatatcttttacaccatatgtggtccagaacagaatacttttggcaagtcagtcgaaatgatttcgtaagggaaagatatgtcaaaaactaagcattagttgcttgttctatgtccataaaactaaaacatgtcgatcacgcgccaaaggtcgggctatcttgctcgataaatcgctttgatcatggtaacagtagtaatgcctgataattgaatgcacccacaggtactcaacatttgtgaattgggaactgtggtggccacaatttcctatcttggtttatttcaaggagacccaaacaaaacccgaagggcaaattcatttcttccctgtgatttttgtaagtccactaattttactaactttgttgttgtatcatatggaatttgatttggtgttggcgtgttgcaacacagaacggccgacagctttatgatgctatggtggagcgtgctggaccttcggaaactagcggtcctaaatagtgagtgcttccctcagggaggccatgagttgggctccatggatcctgtagatttagttgatacattttagagggacaagacctactactatgatgtacaatattagaacatgcaattaaccttttaagaatgatgtacacagtatatatactctgtacttctgtatgactatgtataaaaaaggctgatttaatgcaacaccaacacggcatattccaatctaagtcaatacgcaggagtttaccttcttatatacttcctccgtttaacactgtaagtcattctagcatttaccacattcatattgatgttaatgaatctatatagatatatatgtctagatttattaaaatcaatatgaatgtggaaaatgttagaatgacttacattgtgaaacgaagggagtagttgcatttattattaactagaaaaaaatatctgtacgttgcaacgggtgaagattattttaatcttattattattattttacggtttagttaaggtaaaattcactgtagtattcgtttagatatatatttttctagaaaatcatgagctataattatgagtccgatcatctcaagttagcatgtgagtttttttaaagaaagttcttatacatctccttctgtattttcaaaaccgaacgaatttaaaacccgactcaaatacagatttgtatttctaaaagcgaacgaacttaaaagttgactcatacatggatgacgtaacaaagtatcggtaaaaacatatttaatttttataatagtagagatagagatagagaagagatatgccagatgttatagtccatcaaatttgtatcggtggaattgtatgcggtaatggatttgggtattgaaccaatgttttgccatacagctgatccgaaaaaaggtttatagcaaatccggaaaaataaacataactactactaaaaacacggcaaagaggtttatttttttatcctatgccatgggtaatttactagcaatataaaaggacaaatatacgtctggttagagaagagtaagagggagcagagcgaccgtcctggaggcagaaacccttgtgcagttctgcccttgtagtatggcgaccagacatggctgtccacgctggcccctcgccttatccggctccagaatcccatccacccaatcacaatccaacccacgccattgcaaccaaatttccaatacacaaaacagcagaaactctagtgatcacaagctcagctcagctcagctccctccttctccccggagaagcagcggccggcacggcagcaatggagaccctcctctccccctccacattgctctcccctctccgcggctccaagaagaagccggcgagccccgccgcgtcggcgtcgtcgtcgtcgtcgtctcccgccaggtccgtcgtctcctgcgcgctcaggaggcagcagccgccgccgcaggcggtcgccgcttggcgcggagacggcggccgcggtggcggcgtcgggagctgggcgacgttcttgcagcacggcctggccgnnnnnnnnnnnnnnnnnnnnnncagcatggcgccggcgcccgcgccggccgtggcgtcggagttcgacgtgctgaacggcgggccgccggaggacacgtacgtggtggacgacgccggcgtgctcagccgcgtgaccaagtccgacgtgaagcggctcgtccgcgacctcgagtcccgcaagaacatcaggatcaacttcatcaccgtgcgcaagctcacggtacgtacgccatcacatcgcatcacatcacgccgccgccaagccaccgcgcgtctctgaccacctcgccgccggcgcgcggctcgtccgtgacgttaattccttgcagagcaaagctgacgcgttcgagtacgcggaccaagtgctggagaagtggtacccgacggtggaggagggcaacaacaagggcatcgtcgtgctcgtcaccagccagaaggagggcgccatcaccggcggcccggccttcgtgcaggccgtcggcgacgagatcctcgactccaccgtctccgagaacctcccaggttagccttcgccccagacgccggcgtgctctgccgttcacgacgcagaacaaaaccaacaggtctgatcgtgcatgcactgcagtgctggcgacggacgagaagtacaacgaggcaatctacacgacggcgaagcggctggcggcggcgatcgacgggctgccggaccccggcgggccgacgttcaaggacaacaagagggagtccaacttcaagacgaaggaggagacggaggagaagcgcggccagttcacgctcgtcgtcggcggcctgctcgtcatcgccttcgtcgtgcccatggcgcagtactacgcctacatctccaagaagtgaacagcagcggctacctgttctttccaacaaaaaaagagagaaaaaatgagcagcatatggtgctgctctgtacagtaaatttgctcaggagatggctaaatctcccggttttctgtcggaattttagaggcgaaacagagaattatgatgaacacaggtgcaccaccgtgccggttaatttttattgtagtagcataactgaggcactgagcaattaggtgcaaatcagcacttccttaccccgattcctcttcttctataaccattttttttgttgttagtttttgctctgttttatccttccagcaatgctgcaacagttcttgcaaaatgtgcaaactctccagcaaaaatttcatgctacaacaatgcaactaaacctgtcttttagtttttttttattattttttttagagaagggtattttctacccggcctccatatccaaccggatatatacggccattgagataagaaacttagccccgcaaacaactcaatctgaaattcgctccataggagatttgaactcaggacctttgggtactactcaggtcactgtaacccctacatgtcttttagttaatcaccgctgaggctttgtagcagtagtagtcgaagtatatatgaacaactgaaaagagctatatatgtgattattatctattgacaagtaacaaatacaacgttttttttttatcaaatacaacacctcgtagtttataaaagcgaaaaaaagatctgctcattagaacttcggttttatgagaaatggcatcttgtcagcaaatggagggtcagagtatctccctgtaaggatctgcgacgcgatgtggaaattcgcagcttctgtgtaatggattccatcccaattgacaaattctgtactgtccttgcaccctttggctgttacaagattaccattcagagacgctgtctgcccacaaggtactctactgtcatagttcaagggtggccctccatatccacagcatgcttggatgggattctcgaaccctgtaataatgcaaaggcagaaattaagagtgttgtttgaagggattattgttttgaaagcctactgcttaatattcttatgagctagctacaatagtcatcactgatccagcatgtgtccaaatgcatagtagaagaaagccaaagaaagaaaatgttgttgtgtagtgtcttgtacaattccattgtctttaaaaaaaagtgtagcagtgcaagggaatgagcaaatagcgaaaaaaaaagggtaaaaagcatctttatttccctcaagcgaggttcataattagaagcctagttcaggactgatggtggcaattcatcataagtcttctagttgaagcatgttaatgttaaaaaaaagctcccagcattgtaatatactgactatagaaatgataaatcatgtatttgatttcaagataaccaaacaatgaggaaattagatagtttggttgcataccatagcgcgaataattagcgatcaggctgtacttgatggtgtagatgtcaacataagtgatactagccccagcgaattcacctcttaactttgtgcaaagtgcatgcagctgtaagttgaaaagctttgcaacacgattatgctttgctacacaacgaagttcatccagctgggatcggtctttgccgaaaaaagctacgttttgaggtaagcagccaagaggacctgtgttgtgaatccagaatttcctggcaccttgctcatataatttctgaaaaagaaggaaaacgtttagagtaggtcctttcccaatcaaacagtacatagttggaccagtatggaaaaatggcaaactgattattttttggccaaggcaaacagattattttttgaagactgaaaaccatattctacaaactactgaagaccattgaagaaaaaaaaaaaggttccatgcactgcaaaagcttaagaatgaaaatactgtgtatacaaaccttcagcccagtttcgaattccaacaaaatagtcggaatggatgcagcaacttggtcctctgttttccagtagaattcaccagcaaggtcattttgacctatgtcaaacgtgtaaagtccccgcgaaaagtaatccgactgaggaatatatctcctgtacgtatctcctgcaaagtaaataaataagattccatcactaataaagttacatagcctatattagaacatggaaaatcaaagacaccaggtggttaggttaacagaggagaatatcattctaattcttgtactgatatatacttcctccgtcccaaaatgaagccatttttgaggttggcacgggtattaagaaagtaagtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttgggacggagggagtattgattaaaaaaacataatggaactacgaaaaaaacttgctaagtgttaaaatctagtcactgcaaggattccaaaaaaacttgttatcattgcgaatgaacaatgataaataatggaaacttctacaattttccagaaacacaatattggcctaaaatgttctgaaaattttcattcactgaaactcactcaacgtctcaactttatgtcctctttaatttattttaagtttgatttgttaatcatcttggagtattttctaggtgcagttctttattttcccctattaatcctatgtaacacaaaattgccaccttcagtcaaaattcattcggtctgcgtgacttttatgggtacatactgcagaagacattttccattttgctttgtatccacaacatctaaagatgtgacgtatggaaaaccttgccatacctttagatagaagcttagtaactttgtccttgaatgcaaagaattgcttaatctgaagaccaaatgaaaatgggctgacagatgttgccgttgctggagtaattgaacagccagcttgagcaaaattaacacccgcacgtaagttaggtgcaccaacagaatccaaatatgcattgaggaacggcatatccattgcatccactgcaggaggaagtttaaaatcatgtcagatagtggcccacataagtttctcatgtgcaaaagtgtgaaaatagaatttcctagtcatagtagcgaaatgctttttttgaaatttatagtagcgaaatgctattgctattcctatcaaaatgtaatgcattaacccactaaagcaacaatatttagaatctaaggttccaggtttatagtgattatatgaaaactatatcactagacctattgttcagaggaatgttttcagaatactaatcttctacatggaccataattgtagattgcacaaaccaattgcaggtcacatctcaaaaactgtgaaagttagtaatgtgaaataacgaagagaaggaggtggggggagggggtgatcaatagcaacttgtgatagtgttttctacaactaaaattgtgctggccatttagatttccttcatagttacgcctccaactcccatggtttcttagtgacaccaccacaccaactccaataataaactgaaaagcagtagcctagttaaactaaataaatggaaacacattacacacggtagttggtgggtcactcttaagtacacccaagaaattaggcactaggcaagtaggcagctggatggagacagagcaaagctcaccgcgagtcaaagcataaaacaacagtgacctaatttccccaaatgcgatgaaaccggatcaagaaacagcacatcctttcctccagatctaacgaatatcccaccaaaatgctgcaagtaacagcggtacaaatggcacgaattggaccacccacatccagcacaattcctccggtgttagaacagagtacactgctatcattgaccatcggcaattgatgccccaatccccatcctaaatcttctaaccaccatcacggccgttctggtgatctggtatgttctgcaaaggacagtcctaactaattcgcccttttccccaaccaccgtgcggaccaaatggcctcactgccgtcaagatcgacgacgaacagtatcaccagcacgccgattctttgtttcttgcaacactagattgggtaccaagaaccaatcggcgacgagcaacgatttttctgatgcaattcagacagaagccacatcgccgatgcccccggttaccatgtgggaataagattgcaacaagcaatgtgaacgacgcactgccacccacatgaagaatctacaaggaaatgggtgagaacaagagaggtgagcttactgaggaagtcgatgatgaggcggccgtcgcagaaccggccggagggggagccgaagaaggtggagccgtagggaggcgcgatggactcgaacccggcggccacgcgccctcccgtgtcggagttggagtcgccgaagttgaacaccgccgggtagttgaactccggcgacgacgcctcgagctcctccgcgcggccgccgaggcagagggcggcggcggcgacgaggagcaccgccgcagcatgcggtggcccgcgcatggtggcttgcgctcgctagctaaactccactctgcttctgctctcctgctcttgcttctccaagcgaagaggaggagaaggttgctgatgcttgaagctcttaagcagtggagatttgatttgagttgattttgggttgtaaagggaagacctggccacccatgattagtgtactgccaagctttttacaattttactgctatttgtttttgcattttagcccttgtgcttttggggctttgcgttagatatggcagtatggagagatgggaggtaattacataaattttggaggggttttgtgaagctggtttctgaaattggaagcgaagagaggtgagctagaggccctagtagagcttgttccgaaattcaatcttgtgtaaagcattcagctcactgcattgcacggaaagattgccgttttatactaccttgctgctttcgtgagaatcggaacaaacataacgtagctgtgcttgtgcttgtgcttgtgctcttctctctctcacacacacatagaaagaggaaaactggagatggaaaaccaaaactttcttatgactaaaattccacgcaagttctagatgaaccatgtaggtttcatgacttcatctgagatttcctattactagaaagtagaaattaatcatgcattcttttcctccccgaaattatacactactcatacgttagaatgaaaatattagcacgggacgaaaacgaactgactggaagggtgcagaggtaaccccaaaaatcactattggtgtggtggaaatgaggggcataggtggggcaggagccaggagacggtgaacaacagtgagaggtggactagtaggcgacagagtaagagagcgagtgtttcgcatcgcattgcaccaatacatccaatatataacacgcaccggcggtgtctggccgactggccctaggcctcaccctcacgatgcggttgccgcgcagctttacccgagtgtcaccacttgcgtgcggaagtgcccatgcagccatgcgcaacgaggcaacgatcgggaccaggtgataattttttttaattttgctttcgtcaatgcctgcctattcgttgcattttcccgtacggattcggttgccttgtcgtgtcatgcgttctcaggctccatgatacagctataaaatatagcaccataaagagatttatttaaatttgtaatattataatgtatcatatttcatataaagtttatttattttgggaatgatggagtagagcctagccaactacatgcgttcgccgaaatgcctggccaaatcggggcatcctttgagagtttggattaaaaggttgaggtgaatctcagagtaaatagaagtaggaatgatagaactgccagggcgttcacaatgcagtgaggtggcattctttccccaaccatccacatcagatattccaccccctctcccaagatgcgtgtgtggcgttcctaaccgaagtccgcggagccaaactaagtcacatgttcttcgtcaaaacttgcaggtgcaggatgaggtacgggttgagcggcgcattgggagagaccgtggcctaatgcgacacccccacatccgtgtgaagcggcagcggtcgccggcgaggccaccgccccaatcagctgcatcgtccccaaagcggtgccgctcgccagatccgacgaacccgaggctagatttggcgagctcgatggggcagcaaaactacgggcataactaaagtgtgacatgaaaaaatgtcttacacttccatacttgaaaaatcaaaagtattgtaaccactacaagtcatcagcttgatacgccaatgccaaagattgagtatgagtagtgacgccgtgtttagttccaaaatatttcttcaaacttccaacttttccatcacatcaaaactttcctacacacataaactttcaacttttccgtcacatcgttccaatttaaaccgaacttccaattttagcgtgaactataaacacagcctgagctgtggagttgtggttttgcggatgtatacaggagatcacattgtgttccaccatcaaatgggctaactcggaacgtcaagaccatctttgcagtgccaaatacaaaataaatcaatgtagtgccaaactatttttgtatttttgcactttagaccttgtcttaaaggtattttctgtggaggttggatggcgcagcagcgtggtaagctaccgtaattaaggagattttggaggggtacgatggaattgatttctgaaattgtaagcaaagagaagtgagctagagcctagaacttgttccaaaattgtgtaaagtatattcagctcactgtattgcgcgaaaagattgccattgtacactttttgctgctttcgtgagaatcggggtaaacagaacaaagaaaaatgagacactgaaattacccataaatatttttttttgctgggatacccataaatattagatgaaaccaatatgatttcttctcaaatttcctagtacaagaaggtacaaatcctgcatcccaaaaccatgacgagtaatctttgtggaaacataagcacgaagccaaacgaacgaactagaagagctgacgaaaaaatttcactgcgaaaaggtagttgcctagttggcgataaggaacgctgaacaccaacagagtagaagcactagagttaatagcactgtagtccaaccggacagcgcgagtgtcatgccaccgtggcaccacatggcggcccatcgctgatgtggcaggaggatggcatcaacattactgccattgccccccctcccccccacggcgccaatagagaatgtcacgggggaatatcaccgaatcccaatccccccttcccccacccatttgccccccctatcttttgtcttagcctgagcgcatctcgtgcacgcgcgctctctctctctctctccactctcacaaatcctcaaatccacttgatttggagccatttttcataggatttttaaggaaaatcgatgagcaaggtatactcctccattccccttttttttcgttttaatcggtggaatttgttgattggagggtaaccctagaactattttttgcccaatttcgtgatcttgacagttgaaattggggatttgatgattgtagtgttacatgcatgcaatgtgctcgttggtgctatgttttttcagtacatatatgtggtatgatattttttagttaag

SEQ ID NO: 73258 - DNA, 12884 bp, Oryza sativa
atctcaactaaaaattatcattaccacatatatgtacttaaaaaaatcataacactaataagcgcactgtacacatgtaacactacaatcatcaaaccctcaatttcaacggtcaagatcactatattagacaaaaaaaaataggttatagggttatccttcgatctacaaattccactaattaaaacgaaaaaacaagagaggggaatgaagggtataccttgctcttctccaagaaatcgcgtgaaaaacaactccaaatcgaatggatttgaggaggaggattggggggaggggggaggtgagcagtgccgcgcacgacctaggtagcgaatggtgaagaaggggcaggggtagggcccacacggtttaagtgcgcccagccctggagggagagcgccagcagtgttggcatggggaggaggggcagtgctagcaagattgacacggtggcatcgtcctcttgccacgttagcacttggtggccatgtggcatcatgatggcatggggccacagcagtggtctaaaagaaaccattaaaagaaaccatttatagaacaagttgtttaagagtttatttataaaataagtttttaaaaagagttaaattgtaaaaaaaattcaggcaccgatgtctgggcaggctgcaggcccctccacctccaggctccttttttgtctattgcacagctttttccagtgtcgccactcgcgttgtcgcgcgccacgcccgccaaggtaccaacccctacaattccacatggcccggcgcaagacatttgccatttcgccgtgaatgctgatgctgccccaacgatcacgaccaggataagatattttatctttattttaggtctatttatatccccataaaaattttatagcccgtcacaacgaatgtttggacatatacatgtagtattaaatataaacaaaaaaaaactaattacacagattacgtgtaaattgcgagacaatttttttaagcctaattgcgccatgatttgacaatgtggcggtacattaaacatttacaaataatggattaattaggcttaataaatttatctcgcggtttacagcagattttgtaatttgttttgttgttaaactataatttaatactttaaatgtgtgtccgtatatccgatgtgacacgctaaaactttacacatactccctccgtccaaaaaaaagataaaccctgatttccgtgttcaacgtttgaccgtccgtcttatttaaaaaaattatgaaaaaaattaaaaagataagtcacgcataaaatattaattatattttatcatctaacaacaataaaaatactaattataaaaatatttcatataagacggacagtcaaacgtgagagcggaaactcagggtttgcctttttttttttttttgacggcgggagtatgtatctagctttgctttcattactgctgtctgcgtcaggccgtgccggtgccgtgccgtgccgtgccggtgcggtgcgttctactgcaatctacagcctccattgttcgtttagttacgagcctatccaaaaagccgactagcggagtcgctaaacagctaaactatagccttgtttagtttcaaaataattatttaaactttcaacttttccatcacatcaaaactttcttacacacataaaacttttaacttttccgtcacatcgttccaattttaaccaaattttcaattttagtgtgaactaaacacacatcgttttaattttaaccaaactttcaattttaatgtgaactaaacacagccatgtactactccgtagtatgaccaaatcagaccatcgttggcaaaatttgtcttaggctgtgtttaatttttgcaaaaaagttgaaagtttagtgaaagttaaaagtttacgtgtttagaaaagttttgaatgtgatgtaatggaaaattgaaagttaagagtaattgggggtgaactaaacacggccttaagcaaacttcggcacccacgaatatactatggcagccaaaggcaaaactgacggcgcaagaaatctccagttctgcaccacatcggtgtcagcgccaacggcgcgcaacaaatgcaggtccttgtaaacgttgcacagagaatacaccgtactatgccagcggcagtgtgcagtggcatacctgcacctgaaggcgggtgcgggatacacactgaaaatgggattccttgtgaaaatactagtacaatcacaagaccaacaatatgcattaatagttccaaacaaatcagctcttgcattatgaactgctgagaagttgcaaatggtgctttgagatgttttacttaatccattactgagcagtactccacagccaaacgtcgccaatagacccacaggccacatggccacattggcatgcttggcacacataggagtactgcagtagggatttcacatgacctgcaggaaattggggaaatgaccacattttaagtggggcataaatccctcggcccacttccaaagaaaacacactgtaaccactgcagcttggtacgccaaatgttgagtatgattaatgagctgtggactagtggaggcccccattatgtttcaccatcagacgggctaactcagtagatgtgcttacatatcatgttaacagtgttttaatctcaaaaacatatagtgcagtcgcttgataaacagctcggccagtcctcaatgtaaagcctagttccagatccgaacaaaatcgaacccttcagcttgaacttataccacagaagacccatcgaattattcgcagtacaacacttgagaaaatgcattagcattacttctagaccctggaggtctgtgcataacaatcgagctgatggaacaggttaagcattatacctctgatatatcatggttggctaaccatattttgttccttgtgccaaagaacgacgtccttgtagggcaaatctcctccgaatatatcaagggcactcccaaccgtaacatcaactcgactgttgcctgctctttttatcctctctaggtcatccattgtagacacacccccagcataagttacaggtatctacagagccaaagatactattatgagttcataaacaatagaactaggaacattcaaatacggttaaagcaaggttttattggtttgcaaactgggagcctgcctgcatgcatgatcactgtcacaacctattgacctgcctaaaccgtatctgaacagcccgagtaaatgtccatctcccaaaagttgtatcagcatgcccatatttatatctaaatggctaccagtgctttgttcgacaattgttttgttcaaaagaaacaaggatggtaaaatgcctagctgcagcttgatttagcatcttgagtttaagaattatgaaggccatggtcatcttgttatatggagtagcttttgaaataacattgcctgtgtagcatttttcttcgctttcaaaaatctagatgctcaactacaatgcagtcaattcagccatttaaatacttggtttattgacagctttttcaattatagataaagcaagaatctaaatttcacaagaaagactaaacttgcagatacagaacaaacattaaggatggaattaagaaacaagaaaaagctggaagaatttaaattaatgaatcaagaatacaattgcacgtacaggtgaataacgtcccaatagttcgacaagttcttcatcaattcctaacctgcaattgccaaactagcttaaatcagaaaagataatggtacaaaaagaaagctgttcactactaagtgaatacacaagtgaactggatatacaaattaacaacctatccaagatatgagcagttgcactactgaagaacacaaataagcttttgaacattagaactcattccaatcaagacaaagaaaaaactaaaaagtgaaaaaaaaaacctgcttctattgggacgatcatgttaacttcatttgctcaatgatgtgtcattaaatttaaatacctaactgaaagcacaaaaaattggatctttaccgagtaattggttatgaaactaagggtgaacagtagcatatagaaagttttggcagacagacatttaaagtcttattacaatatttcatgctgccattaccaatccaattctatcaagaaagcatgaaacagagaaaaggtataaaacacaccttttcccctccacatcaacaccatgaaccaaaaattcatctgcataggcagcaagatgttttaatgttggctcatccacaaagacatcactgaatttctgccatctgtcagtcacgatggcatatcttccatcctatcaagaaatattattgtaagaacgtaattaagtatcaaagtacctgtcaataataagataatgacaaacacattagggtaatcctaattgttctttcttgtatttacagaagagaatgtagctagcttgtgtttctctaacttcgatataaactattaaaaggactaacttgtttaggttaaattttatcttgtttcaggggtaaaatgctcatatctgatggtatgactaattatctttatcagtaaaaatcattctgaatatgaaaaggaatacatggagtaattacacctaaaatagtgatatacacttattgttgttggttcatgctcttggatgtcagtttatcacagaaaccagttagttggaattcaactatactttggtatattgtatactgctctctatataactatcagggcatacatagtgcaaattatatttcacaatcattaaaccattttaggttaaacttgagcagatcaaattgaaaaattcaagaaagggaccctcatgaactgttgtaagcgaaattccaaaaagatgtaatcaaccatgccactgttctaacactttttgcggtatgaaatgccatgcatgccatgcgtttggaattgtcagtataacgacatgcagcataggcatcacactagaagagcgtgaactgcaggtacaaaaggtgtaacatttgtaagaatgtaacgagaacagctcacgtgaagtatttgaagtgctaactttctcattgcacacgcagtaatgaattaattaaatttgaaaagaagatgtccgaagtacttggtaccttttttctacaactaaggtccaaaacaagcctatgtttcccaaccagatcgacaagttgcttcagccgttcaatgttcattttgccttcactaaacacatactgcataaaaagactcagatgcatgattcacaatattcaactactgataagcccaagtacagtaaaaacaaaatgcaggtaaattacacaaaaaaaaatcctatcaagcatttgtaaaatggggtcagctatgtgcaagtgcaatattttgccaacaaaggcaaaatttgcctggctgctagttaggggagaagccagagggggcgagaagaggcctggcctcccccaatgcaaatttttatatcattgatattgatatattatctattgggagccttgaattcacatatatttctacactattttcttcaattgtagggctcatttggtttggtgccccaccaaatcatcggtaagtgccaaatcatgggcaagatttggtactactaatgttttggtagagttggttcataggagttgtattaactttgtcaaattttggcatcaatccaaacatctataaggtactattcaaagtgccaactatttggtagggcaaattttggcagcaaaccaaaacagcccgtaatcacttacaaaattggcccccctcatacataaatcttggcttcgccactgctgttagtaattatcggctatgaatgtattttgttgaactaaaagtaaaattaacattttataccatggaagcgacctctataacagaaaacatgtaagtaatttgtgatgaaccttaatcaagacattgcaatatgctttgacatctattactagatttgatagtactcacagagaatgatgagtaaagaaaatagaaactaaacaaccaaaatactcaaactaagctctatggttcatgtttatggtatgatgggttcatcaaagataacagacatgaccaggtggacatgagaagcttcaaatttatctcctgaagtcaccatgatgaaaaatccacttcatatcaatttactaatatacagtgaaatagctacatctatttatgtaagtaggtgcatcaatgagggatgagcgatagtcatatgatcaaatagatcaaatgtctcgtcatgtcaactggtgttgaccatgtttcagttgaaaatcacaagcaattgaagttctaaaagacttgactcgttacatgtatgcaaatgaagcatgacagcaatgaggaacaatattaaatacactttttataatatgcaatctaatgctgcagccagcactcacaaatagcaccgacctattagtagctgttggcgatcagcctggaaccccgaaggtgttcaacgaaatgcaaatcatgaactggaatgaactcgaacttgaacgtaagagaacctttgtgctggtaaacttggcaatgttttctgatacattgatcaactaaaatagaaaagatgtgatgaaagtctgtcaatctccctacaggaatgtgccatcccacattcggaggcttgccacgccatgtgtcctacaacaaatggttcggaggcttgccacaccaccacgtgggatggcgtggctaagtagggaagcatgcagcgcatggtgcagcaagccccccaacgtggatcgcacattcctgtaaggagattaacggacctgcattgcatctttgctatttaagttgatcaatgcattagaaaatgctgccaagtttagcaacacaaaagttctcttgtgatcgcatttgagtttgttccagttctaaattgtcatttcatcaaacaccttcggggtttgtggctgatcgccaacagtagccagtaggtacaaggctcctaagccccacaacaaagactcccttagattttacagtgatcacccaaagagaacaggagattccttagaccttgtggcttttggaacacttttccgtcaagaagaaaaaaggaggcaaccagcaagcaaattacaccaggaaggagaaaccaccggaatgttattgactgactggacaggactataggcaatgccattgcctgtagatcaatgactagtggtagggtttttgataggttgctcttatatcatgctaggctttggggtaacgttacagtgaaccaacaaattgtatttaacaagaaatggatatgaaatggaaatgcaatggggccaggcttaattttgttccggttaactgatgcacgtattaacatacacaactatatgtggtttcaaagaatgaaagagaaacagaacttatatacacggatcaaggcatgaacacgtacagaagtaacaatcacgtgactggcaccttcattaaggtaagatatcgcattctccaaatttattccacctccaacttgcaaaccacctagtattataatagcccacgtttattacaaatacttcaaattgattttgcttcatggccatagtagaaacaaaccatactagcagaagcaccattagcaggtgaaaaaaaaactctccaaaggctccaatgaccagaaccataataacctaaattagcatctcttgggcttaattttatggcaatgaacatgaaacatggctgtcagcatgaaccatacataattcaaaccccgcaatagtggaatctgacaggtataccactggaaaatatcatgaaacaacaacggaaaaggaagaagtgttattaagttttttcccctagagttgcattttggcaaagtatttttcattgctctcaaatagctacatgatattttgtatcagctagttttttttagaaaataaaaacaaacactgcacttattaaattatatacactgtaagcacccatatattcaatagtcacaaatgtggctttatatcataattattattgataacagtaaagaacaaacaactacagacagctgctcacaaaagaactagtccaaataacaacataattatgctaacaggtaacagctagataacattctcaccaggatatgcatgtagtgcttccatggcagcagcttgactagcaggatctgcaccaagcatgattacatgtccaccaataagttcatcctctttatatatatttgcaaattctgctggaggtttgtctgattcaaaatttgtaacaagtgccgtgccatcgtttgatgaatcccgaagagtagagccaacaatctgtttaactttcccctgaaaatttatattaagaaacagcccatcagataaatgacactgttaatgccagaagtaactgaactcacatggttgcaaaatgacagtagaaatcaatgcataagcctttagttttaatatcacggtgttccaggtgaatcgcatcgcaggaaaatttggagcatacaagctgaaaaaacttctgaaagtactttgcttacaaagttggggtatcaatttacgatcatgttaatgttcagaacacccatgaaacataagaggaagcaagtgttccactcgtacggaccttatgaatatcgatacacggcctgaagataacggcgcacaccacagcacgtcctcctgccaaaacaaacgagcaatcccagtttttcccccaattcgcgacaagcagtaacaaatcgagccatacagagaatcgaatcgaaagggacatcatactcgccacgccggatctcgccggccggacggagaccatcgggacagcccaaccggaccgcgccgccgcgcacggtggagacggaaccctcgatgccatccaatccagtcgctgccacaaccaacaaacaaacacccgcgaagcaaattcagaagcaagcaagcatgcgggagccccccccccccccaacccaggacacgattcggagagaagaagaagaaaccagcgcgtacgtgccgcaccttcgcagccgccgccggcggggaggggagggctccgcggaggcggcgcaagggcggcggcgagtcggagtcggggtcggagtcggagtcggtgcgaggcccaagccgaactaggtaaagagatttattggacggccaggatatgcacaggggcgttgatccgacggctcgaacgcctcgtcagggctaataatattgcctctcgcgagagagaagccaagccagttgagtcgaactgttgaggaatcgctcgctcgctcgctcgctcgccggcggcgcggacgaggagggggcgagatgttcttccacatcgtgctggagcggaacatgcagctgcacccgcggcacttcggcccgcacctccgcgacaagctcgtctccaagctcatcaaggacgtcgagggcacctgcaggtagggctcgggattggttgggcaaaccctagtagggcggggaggggatgtggggttcgacgggattcattcttgttcgtccttttgcagcgggcggcatgggttcgtggtggcgatcacgggggtggaggatgtcggcaaggggctcatcagggagggcacgggctacgtcaccttcccggtcaagtaccagtgcgtcgtcttccgccccttcaagggcgagatcctggaggccgtcgtcaccatggtcaacaaggtgggcgatgtgcctccgtccctcgccggattggtatttggtgttgggtggattagggcttgtttgtggttagtggctccaattcgttttcgtgttggttctgcagatggggttcttcgcggaggctgggcctgtgcagatcttcgtgtccaaccatgtgagtgcctgcattgcttggagctgcttttttctaatgctccaaatttgtggagtaaaagaatcagaatttatgctagaatgatcgatagacgataatggttcagtaccattttcatacacccagtttagctgtaccatcaactcgaaggatggtttttgtcatagaaatttctgatactaatttatcaaacatgttggtttgaacaatcttaaagtgactggaaggcaacataaggttctagttgaatttgtgctttctaaccaactaatgttttgttcttgcattttcccgtttctatttttgttgtgcagttgattcctgatgatatggagttccaatctggggatgtgccaaattatactacttctgatggatcggtatgcttcttttctacagttacttcttatgtcttgtcctctataaacattgacaactgttgacaggttatgattttttttcctgtttatttatgcttattggtgatatgtctgacttaaaaagaaatgctggggaatgtaatgtaatgtccattgtatccaattttggtatcagcatgtcataactatgcttgaaatgcatacacatatatgttcattgtttttcctagaaacgaatagatgtgaatactgtactactgttgaaggctaattgctttggccatcttcttttgcttactaggatttacttgtttgtccgatgcaggtgaaaattcagaaagatagtgaggttcggttgaagattattgggacacgtgttgatgcaacagaaattgtaagtttgttgacatctagtttcgtgcaaaaaaacaaacgaaaaaccaggtgttccctgtcttttagatttttgtagcattgctctcagagtaaccaccatatgcaattattggtgatgtaacccacttttccataccagtagtttgcatgatgtttttctttcctaatgtgtgaaaaagaacagatgtggttttatcagcaaagatcaaccttgatgtgtgtcaagtaaattagttgaaaagtatatcaaaatgaaaatttgacatgtaatcttgtagcaacaaattgcaagtaattaccatgaatgctcataagctagccactagtatggtatcataatagataattgttgaatgcatgtggctatattcttccctgaggcatttctgaatccatgttcttgctgtcataactcataaccccgtttaagctggtgatgtgcaatgctctaacagtttgaatatgtttgttgcagttttgcattggcacaataaaagatgacttcctgggcgttatcagtgatcctggtgcggcagtgtaaattatccggtgacaagattacgcctcttcatgctcttgaacgggaatattccgatgaattgtagtgttaaaatatggaagccccactggaaggggctgtaagtgggttggaacctgtattttcatcactataaatggcgctttaccaagttggcactgttgcttgagtgtgttgtgggattcaactttcaagcagtcatttaactaatcaaactctgacctttttacggactgtacaattttgcactgtatccttgcaattaaacattcaatgcttcgaactgcatccttgcaaaataaaactaaagagaaagaaagggctaagtaaaaaagataggtttacactgtcagttgttcatgttaggatcaagctaagggcagatacaataagttagcaagaacacagcggtcaccccacttaagttcttgacggcacttcctaatgaagacaggaagtatactttgattgtgcagttatactcaatattctcacgtggtccttcaatgaaggatctgcatacggcactgctcctgcggtattaacagaaatcagatgacaggagataaaacattggtaaagagcaaaaattatttggatatataagtctcaactcacctgcaaggctgcaaagaagttagagccagaggttaacctttcagtcttccttccaaaggggcttgcggtgcatacacttgatcaaaatgatcttccaaaatgatcttcctgacgattcaatcgttaccatcgtttccacgattccactacacagaaggggctcctaagatgccccaaaaactgattttgcaactcagcatttttaagcaattaaggggatgaagttgtcgtgatagtctttagttcctgattcctgaaacaatcaagaagatactctcatatgtaataagttcaacactaccatgacatcaaactggtgaatagatcacaggtgccttatcataccatcaaaccaatttgtccgaaatggaagccagggccactagagcaaataggcaaagtaatgaaaagacatccacaatgccaaaagaagattctgtaagaaagtagatcttgtggttgttagggtcaccacgaaatccgcgagcaatcatggcctacaaaaatcagacagacattcagagtatgaagtgcagtcatgtgcaaagtaatttcggctatagtgaaccatgtatgtacaatataagtgcttgaaaatgttgggcagcagcaatgatgtaatttaagttttatcctccttacaagccccgcagtactagtacaagatctttttatcaaaactgtatgttacttttaggtcataaccagtaaaattcttgataagttctcacaatcagctaaccagacaacctgcagtatgattgccttcagcctaaactttggcaagtttaaatagtgtgataagactaaaagctcataattcttaacccagtttggttcaatacattcagaccataataaattttcctcttacacattcatattcaacttaacagacgtgcaacaccactttcacaagaaaggaatgaaggattagacatggacttatactattagtattatcatggacgtcctgtatagcaaaagcccatttaactgtcaggctagccagtacattcatggccatgtatgcaccagcagttagattttgtaataggacccccagctattaggaatagcatatgggtcataagcctatgcttatatatagcc

SEQ ID NO: 73259 - DNA, 645 bp, Oryza sativa
tgtccttcctgtcgctgcctctcctaaccttgtgagacgatgacgatcccccatgcaacaatgcgttgtgtttgtttgttaggcaggcagcatgagcacgaggaggcatgctatgctatcacattcacaccacgtctctctgctgcttctcatatcatctcatctccctcctttttagttatagatagatagtacattagagattactgtactcgaagggagagagatactcctagatagagacagggaaagacatgttatgttattattactagggccaggcggcaatcaatgggttgctttcgaacgctgttccgagttggtgcaagtaacatggacggattattggatcatgccaagattcctcctcctcttcctccccctttcaaaagcacaaaccatggcacctgcacactcatcaccttctttcgacttctccatctacaacagctacagtacctactaccactacggactagtactagatcagaagatgtgacgcccttttgcagcacccactcatcaactgcacttgtccactccagtgcccactgcagctcattgccaaatttcaaggaatcctaagctcgggatgattccattccagcttgacattttgtcaggaatgtcagcccgcttcttcct

SEQ ID NO: 73260 - DNA, 2029 bp, Oryza sativa
tgtgctcttctcttttcgctttccaactttcctcttttttccaaactcgttggttattcccatcagtaagttgtgcacctctgtccctgttagctctgtagggggtccggttgtatctctgtgtccattgaaattctttttcatattcctatacgggtgataccttgggagaaatctcctgtgacccatgtagaccgtcttgtgtgaatgcttcaaccatttgcttcttgtttcctctatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacacccagggaggaaggttatagttaacaagcagaactggccatgtactgtgacgactgctcaaatctccgaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttaacttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattaatagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacaccctgatccaacacttcttcagctgcgacatcaggcgcctcttgctctccatgcttggtccatcaggtatatttcttcatgaatccattcattatcaaatgagcatgcacttcatccttgtcttcgatcatccgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatatgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggt

SEQ ID NO: 73261 - DNA, 11159 bp, Oryza sativa
aagttaacaaaagttctgtattacaacctaaatgcataaaattatcctacattaggtgtttcaatataaacagaacaattgaaaagccatctgctgaaattagccaaattcaccaagtccaacctttgcaagagttatttaacctcacgaactcaagtaaggtttggacttgcaaaagtatatactgcttccatgatccatcccaaaatataagaagttttatagttgggcacgagtattaaggagaaaggtcaaatacaattatggttggttgtgattggttgataagaggaagtaagtggaaatgttaaatgggagatggttgtgattggttaacaggtgaaaaggtggctatatttttgggacaaattttgaatgctaaaggagatatgttttgggacatagggagtagcagacataaaactgctaagtgggtaaatgaattggaataagaaatattggaataaatgaacttgtcggtatcaacaggactacaggaccagttgatataatccattatttacctctgacaggagaccaattctctatagctagacagcacaagccacaagctacctcaaatgaactagactaagaaacagaactcatatattaaagtctttgaatttgaactgagcagaagcacttgaagttggaccaacttcaactaactgtaatcgccttcatttcagtagcgcaaatcatgaaaaacacttagttaaatcttgctgacaaaataaatcaaggtacataacaactagtaaattcagtagagattagttttctgctgcaattcccccaccaaaatcagccagcaactggttcctgactaagtttgtcagctagttcactcccgggcattggttacagaagtaggaagtactcactgtcaatagtttccatagttgccagcttttcccaatttatccgacgtgctacaatcgccagtgctgaattgcgaacctaatgaaaagtatttaaaataatgttacaatcacaatgcatgttctagttagaaagacaaatatagccgatgtttacttgagcaccctatacttgcctcatcaaatacaagattaatgaacctcaaagatagtaagagtgtgagtattatctcaggtactggtacgccgatatgcttcagtggaatcataaaccaccataaagcagaagcaagctgctcaggagtagttgttgtcaagcagagacttgcactttgaaatatctgcatcaaaagaaagtatgggagattatacctaaatggtttattaaaaaaagtgtattgtcaactcaggacatgcttgtcttatgtgccaattgctagatgatgaaagtattggttcaaacaaatcctctgggctttgggttgctggccatattcttttttatttctttggcaagtcctttcatgctaaatctttctctaatgggcttgtttgaattttttcagactcttttctttcttcttaatataatgatgcacagctctcatttgcattagagaaaaaaaacaatttgtatggaaaatattacccataaaaggaaaggacataccgcaaatgagaggcatgctgacgtactcgctactgataggcctttccttgtaaattgcagtggacccagtttcatgattgtgtaagaatagccatttgtggatgtaggtatgtttggcaaacctataacagatgggggaggagttcttgtctggactaatgaaggagcaccatcagaaccaaatcccagcattatgaatatgatgcctgaaagcagagcgacccttccaagttggtcctatagagaatgtaatttgtataaagctaaacagcaggttcacttaaggggtaatattttaacaaagaagatagcataacggcagagactatgtatcgaaggagtgaaaaatagccaaatcgacaggaaaatctataagtaaaacatggacagctttcattggtatacttaaaagtcacataaaattgtgtgtgtgtgtgtttttttttttgggggggggggcgatgaaacgaagccaagcatgatagtttgtcagtacaaaacccatataacttgtccagtacttcacagtcaccctttcaacagtaggaaatcataagccacactcatgtttttttaaaaaaaatgaattgcattcaacatcataagggaatctccatatatatataaagtagtagacaatttaaaccacaactggcaacccaacaggccagcactatttgtgcataaaatggtgaatgcccattttaacagtagatcagagagcgtaccttccaaatatggtttgggagaacccacatagagaggagagtaaggtatgctactaaaccaaaccgcaagtaaatatttgatctggctggtaggacaacaagagccaagagccacacctgagaacaaaagtgattggtcaggttgcagcatgaaattggacgatcatttagttaatcatcaacttaatcattatttttgtgcacaaaagacaattaaatatatactacgaaatttgttaaaacaactaccgtgacaaaatcaaaattccacaaactcgggggaagggaaaaatccgtcggacactatttcttaacttacataaatattctaaataatcatcagacaaagtgtccaatataacttatagatatactgacgcaggttcaatggttaaggtcagtttctaaaatagcagaaaacaaaacgtcaaaacctaatgatttcacagtttgtggctccaatgagaatcagccaatcattgaaaaaacatactagtatgttgtcatgaaagttcacgacagcattatgtatgctcaaccaacaatccaagttaacccgagaataggcacagttggtcagttgcacacgctcacgttggtggtacaaatggctcttagcatataaaattgagcaagatttttggcgatgtatttgcatcagcaattcagcatttcattcatcccttcatagcccaggggcgaacattttcacaagcacttactgtgcatccttatcccctgccgtttactggcgattcgatccaaaaacacggagcagataagcgtgaggtgaggcaaggtgtcttgtctccggggaaatcttagttaccagcttaacccggggatcgatggcgtggaggaaggtgcggggcgagtcgacgaactggcagatgggcgtggccgcggcgccggagatgagcctgaggacctgctccgggccggcccctcccaccgcagcccgcgggatccacgccgcccacctggcgacggcatcccccgcctcgcccttccccgcggccttgctggggtcggaggcggcgcagaccagcaagcttctcctcctccctgcgcctggcttcgccgagagcgggagccagccgggattgggcgtggcggccttggctgcgaggagagggagagggagagacagcgagtggatagggcggaggtggacggcggcggccatcggattctccgctccgggcagcctgcgccgcgccgtgcgcggccggggtaaggataactcggggtgccgaaacgtgatcgcggtggcctatgtgcggcccgtttcagttgggccggaccatctcatgggcctccgtcgatggcgttcttgctagatgtgcccaaattgagggttggtgaaatgaaaatttttggtgttacatcgaacgtttaacccggatgttggaagggattttcggacatgaataaaaaaactaatttcataactcagcctgaaaaccgcgagacgaatcttttgagcctaatcaatccgtcattagcacatgtgggttacgtaacacttatggctaatcatggactaattaggcttaaaagattcgtctcgtgatttacatgcaaaccgttcaattaattttttttatctacatttaatgtttcatacatgtttctaaagattcgatgtgatgtttttagaaactaaacagcccctgccgtacgttccaagtctattttcaggggaggagcgcagttagttggtttgcagtggtttgaaccagccagcacgaattcgactcccacatagcgaattttcacgtggccttacccattaggaaacagggtacatatatgtgcgtgttcagtgaaactgcacgtttccgtaatgtgtgttcgtctgtgttttgagttgtaccataaaagaaatttggggatgtgtggttgtacccttaaaagaagtccattttacaatacagtaattcgtaatcacaagctttagatcaaacttaattaaaagaattaaccgccggagacaatttacaaatgaacaaattcgccacgaccacacggatatacatccacacacaacacactagcataaatcaacacaacgttcctcctcacgcgcgtacacgtacgtacgcacgtacgtacaccacaaaccaaaccgtcgcccaagattgatacggttttgcacagaatcctcctcctcgacccggtcgacgacgccctcacactctgctaaccatcggattctgtatgatggctacgtgtgctccggcgtgcagcgacccggcgcacagcagctgcgtcccggccaagatgatggtgaacgtctccagcgctcgctgcacagagaggcaataacacacacaagaacaattaatctcagattagccacgaaaacgattaaacgacgcgaggaaaatggcgtaattggttcagttttttttttgttgatgaatttaccaggctcggtggcctccagccgatgctgatctccttgcacgccagcctgcaattaacgagcgaatcgacggtttgattaatcagtgataaacctgcgtgcagatgaatggcgaattggttggtggttttgacggttgctttgcttaccccatggcgaggagggtgagggtccaggtgacgatggaggcggcggcggcggacatcatgctggcggggtacccctggctgacgtcgtggaggccggtgagcgaggtggagacgccgacgacgccggcgagcagcgcgaagatgacgaagaaccccgtcgccaggttgccgatcgggaagtagatcgggaacagccgcaccggcggcgacaccccctgcactgcacccacaagcaaggcaacacacacatcaaccaaacactcgagacagctcacataggaattggatggaatctaaaacgagatttggagggagaaatatccctccaaacagatgatttgtgagcgtgttgaagatttaacatgggatctcaaggttaaaactttaaaccatactccccttgccactatacataggaattcggaccattcgaggcgtcgaagttgaaaccacacgtcccttgccactgcacatggaaattggatggaatctgacacttacgtgagttgaagctctcgtcgatgctgtagttgatggcccagccggcgatgacggcgacgacgacgtacaggacgaggttgaggaagaggaggccagcggacatggaactgggacccccggtcgccattgctgatcttccctcttgctctgctctccgaggcaggagaagatcacaacggcgtcgcgagaaaacacactctgctgctgctgctgctgtgttgacgcttcgatcggtcgggagccaatatatacgctaaaaagtgcagtttttctaactgaaaagatcgcagcaaatatttctccttggttgctttgcaagtaagccagccaagtattcctttgatcctttctgccacctggagagattgctctgcttttgctctccacaagggaggaatatccaattctccatctctcatccacggtccatccatatatggtggtcaagaatagaatctgttcttgtctttgatcacaagtgcatatccatccgtgcagataacttagtttacatgcatcgatcattgctggcctgctgcatctgttcttttcctttgtgttcgacaatgtacggctgctgtgatgctgtcctcttagatgatccgttggtagaagcggttcagtgttttagctgagaaggcttatgatcaacattcaataacaagtggtttgcgccaaaaatgtggaattgccaaaatttttggaagaacaaatttgacctcaaacaccaaccgaaatttggcaacaagccaaaaactatatttacttttttttttactattgccaatcttttggtaatgtttggattgaaatgatccaaacaaacggtttgagtatgatttgtgaactataaaattattaatggttagtagcacgattgccacgcttcaagaaatttgaaacacttaagagcatgaaaaaaatcggggatcaaaaatccatataggattttgtgataatatgaaggagagaggggaagagaaaatatgcgagtgactaattagttgcctggctgcactgggcggcccaagattgtggagtctacccatggtgatggtggctcagacaactgtgctagccgctgttgtctcctgcatccgtcgggtcgtcgtcctcgttgtgactgtcgttgtcgcctgcgcctgtcggaccattgttctcgttcaccatggctgcgcgtggggagtctaccatgccctctcccatctgcagcccattgtcctcaccgggcactcgagctggcatcatttgcgagagagagtcatcgagaaggtaaagaaaagaaggaagaagattagaatgaagggtgggatgaagaaagagaagagatagaagaagatggtggatccataaagataatagaatatctgtgttataggaaacataatattttatagacatttggttacaatgtttactatatgaattcgaatgatgtgaccactcattacaagtagtagctactctagctctctttttttttattacacggcagaccatagttattagaaccggaccagaccgatgatccgactggaaaaaaaaggaaccagggcgccggctggtccggtccagctaaaagatcggtgtgcaatcaaaccggtagaaccgggcggtttaccaaaaaaccggataaaaaccggagctggttggaccgctggaacggcgtcacatggaggaaacagaagtgcgcaggttgcagccttacaggtgcatcacgcggagttagaaaatagggaaaaatgctatagaacttgtgaatcgaacccaaaacttccatctttccgcatagagtcttaaccaccaggctgtgaaacttgtgataatattataacacatatctatttgaactgcaataaaccggtggttggaccggtccaaccaataaaccagtgaaccgagtgtcttaccggtttgatcaccggtccggtcttaataactatgtggcagacgcatatgcacacatcactacacgcgtaacacttacacctcgcaaatgcacaccggcaatacatccctgatctctttaaatttctattgaaagcctatctgtatgtgcgtaatattcacgagcaccagaatttaaaccttggtaggtaaagtcaatcatcaatgacttcatcacttcacagcaggtgttttccaagctttgctctagttaggacgcaattgaacatgagaacctgaaccttggcttggtcgcaaactccattcaatttgccacttgtttgggtattctcccaatttcaccaatcttgtggttttatagctaaagcctgaagaagaaaaatactccctccgtttctgaatataaaaacactgttgaatttttaaataatcattcgtcttattcaaaaatttttatgaaatatgtaaaactatatgtatacataaaagtatatttaaccatgaatcaaatgataggaaaagaattaataattacttaaattttttaaacaaaacgaacagtcaaacatgtttataaaaataacggcgtcaaatatttagaaacggaggggtacaaaataggatgtacaattgcacaactcgaaaaaaaaaaaaactgttccttaatttccataccacgacccagcgccagcggcacgaatctcaaaagatggatcggaccgcttggcgcgcccgcctaacgtggggagtcgacgcctctagaaagcgagaggacgccacacgccgagccatctctcgctttgcccccaacgaatccctcccccataccaaactccgccgccgccgccgccgcccgccgccgccgagaccgacccgaccacgatgggcctatgggacgcgctctaccgcgtggtgatgcgccgcaacgcggtctacgtcaccttcgtcgtcgccggagccttcgccggcgagcgggtacgcccaccctctaccccccccttttttttttcttttccctcagatctgtccgggcggcctcgtcgccgtttgacccgatctcatgttgttgcgctctcttggtctcgtcgcaggcggtggactacggggtgcacaaggtctgggagatgaacaacatcggggtaatttttttccccttcactctctatgaatgctttcctatttctaggtttgtttgtcgcgtgtttttggatcgtggcgttctagatcttgcatttgcgatctgggtagggctatatcgacgctgtccttgaaattctgttctccttcatgatgggaatgatccgttgcggaggtgcggataatcttttggtgatggttgtacgtgtgcaaaatgaggaggaagagccatgcgaagagaaggcttggttgcatctagtgctatacttactttatttttctagatttaccgtttctaaattggtagctagcaatgtcttttgttctgatattaaaattcctgaatgaggatctgttttgctttggctgttacttgattcaatgtcatgttaatgcaatgtgttttaccatgccagcgaatttagagagaatagcataaaacaactgagagtgaattgttctatttttgttgtgcatgctcgatttcacttttaaaaaatctgccaccatctgttgtttgttgtgagtatgctaaacaacatgttgtgaagttaaagtctagaatcagggctgtagatatcgttcataagaaaacttcacttgtgctatggtattttgatcagcccagcttgtctgtctactctgcatggtttcttgcggcttcagttgttaattttgctttctgaaatctttgatcaaaatactaaaatctttgatcaaggaatacgcttgcgttatggccatggctctcagatgcaaagccaatggcatgcatatggagataataggaggtttagattgtgatctcagaagggtatatgcactggatgggaattatggtatcagcatcataagaatattttagctcttaaacattaagtgctgctgaaacacgttcatagtttcaagtcagcatagtacttatcaatcaaacatgttcaaagtttacaacagtaattattccggttatatatgaaaaagccctcataggtgatttgatctttgcatatactgccctctactgcttgtgatagtttaaaagggttctatctttcttttactcctaatctcatgtttagatttaatttcttaattttatgattcattagactaaattaaaactgatagctctcatggaacaaactccatgctgtgagacaactcaagataactttgccacatccaacaggactacaggggtatagtacacccacctgtagctggtaattttcttaccatgagatctgattttggtctgcggcttccttcccatctgtcaactaaaaatataataatctgatgaaatgcagctgtagttaattatcatattacctccggactagcacaaaacaaatcaattcttctatcacaaaaatatgtggtgaagtactgaaaacaagagcagatcatgtttaatcctttttttggaaggtattttgatactcactattacgtgacaacgatgagggtggcaatcatcatattgtagaggaaaatacaagaaattatcaaaaagccaatcgcttgtatatataaattaaattaaatttgaacttgtcacttgtataaaaccaatttcttggtgctggtagtaccttttttattgctatgttctcgatttccagaacagcaaggagctgctgttgcataggaatatagttaaggtggagctgagtgtccaaattattagaatgttctcatgtcatagcttatttctgcagtatatgtgctttgttatcttacgaatgatatcttggtaaaccgtggttgaattgtttagtaattttagtttctgttgcagcacatgggcagtccgctagtatattattatttagatttgagcctgaactacctagcaatcttttttgctggatgtgtgtaagtgtatgtaccaaagtatatggaatctttgtctagcctgaagcggagccaggcattatgtctgtggggattcacattcaagtatacaaaatatacctattgatttttctatgggcaactttatggttgcagatgctgatttactacattttggtgtcacatactccctccgtcccataaaaaaacaaatctagtacgggatgtgacacatcttagtactacgaatctggacagactgtcacatcccgttctaggtttgttttttatgggacggagggagtagtatttgcacgatgtttgtttgtttgtatctgcatagcttttgtattgtatgcaactacattatgacgtgtttccccctatctttaattgtccactttcattgcccataccccttaagtcattaggtgaaatgaggactaggttaaattattttttttgttttgaactgattgccatgttcttctcatttaactcattatggatgtacatcattacccattaatttctgaatttggaccagcttagcacaaaaagctgaatgccctattctccagaaaaaaaaaactcatccattttagctgcagattgcctcattgtttcccctatttctgtgcaatattgtttggatgaagttgttctctagaaatctaaatagtctgctgatagttgtttgtttgttggaaatgcagaaaaggtacgaagatatatcagtgctggggcaaaggccggccgagtagaacaatgaaagcccagcactcatcatcttgcttgctttacgtgaaagtagacactcttttaagctctaatgtcttgtcattttcttcggcacaataagcaatgtaaaacccctatctccgtttctgagagtta

SEQ ID NO: 73262 - DNA, 5572 bp, Oryza sativa
ccccccaccaccgcaccttgcagcagctgcgggacgaagaaagactggaatagccgcatcgtcgccggtaccccgatgaacatctcacacaaatgcgcaaagatggccagcgtcatcacgacgttgggtgcgagatgcaaggcatggatttcgtagaaatccaaaacctcgtggaataatccggagaatggcgggatcaaccccgccatagcaaaggacaggaggtgcacggatcgctccgggtaccgtggccgcggccgcgactcccccgccctcacggcggcgtcttccggcatgatcttgcgggggagactaaggtgcctatccgccataatgcgcgatgctggaagcactgcgtcgctggcatcttgagccatgatgactggcggagaaacgacgaggggcttggtgtgcggagtagcgtggagtggcgagaatgttagggcttagggagcgagtgtgcgggtgagcagttggcgaaaggaagaaggcaaagtccccgcctccgtatccttttatccctgcctcgcccgcgctcgcctccttgtttcacgccctctcggttgcccccacgattctcgcgcctgcagttgcctcatcgtttcctgcgaccactcatcacgtcgcccactgaatccgcgtcccgcatttagtgcgcctgtcagcggcacactcggcgtagggcgtgcgacggtcacgggcgcaatctgggcgaaccgtcaccagtaccgccgcatgcgtggcgggtgagggagtctaggtgcagtccatccaaccccctgattttcgcgccttaagcatcctcatcatcagcgcggtcagtggcggtcaaaccgctgttgttgttgatacgccaacctggccactcggcggcatccacttagattccctgccgggcccacaacaccagtttgggaagtcgtgaggcaccacatcagaccgacctcaggaggccaatgtccgatgtggtgccgggggctactgtcggagatatgggcccgggagtatgcgaagtgaggggaatctaccttcccatcctgccacgtgtccctacagcctggtcctgtccccgtattccgtgaaccgcaggaacggctggggggtcggccaaccctcggggtgccacgtcatgcccctcgggcccttgcactactttgccccgaggccctcgcccaaccgccgtttggggggggggagcaagcgaggagggggcccaggctgaacttcctttaatgcgcgcaacgccccaactgccccatgtcgcatttaatgcagtggggcagacgtgcggcgtgctaaactgacgcgcgatggtcaagaatgaccggtctgtgaccggcctgacaccggtcatgtctgactggacggacaaccgtgctcccacgtcgcatctacttccagcggagtggaggtaggtatgacctgtcccatcgggggttcattcggacggcggccaccacaagtcttcacctattaatgagggaatgacagggccatcccccgtgtcaggcgagggacggcgctgggccccgctcaaggataagctgtggtttagtttccaggcgaaggcacaggtcgagttccagtcaagatagggtgggtcctctcccgaaagaagagtaggtagaggcggtgtatgtggtatccccttgaggtataaaaggaggactttgccctccgagaggggggacgactctcagaaaacctgagcttgtggaggagggaagtaagagtgttctcccgagtttaggaacccttgtaactctcagtctaaatcccatacacaggagtagggtattacacttgatagcggcctgaacctatataatttggttgtgtgcgagctagctaggagccttggggacagatatgcgatttctagaggcgagcttcttctcccggccgaactcacgaaagggggggtctcacgatctcccgcaagagagggtcactcctcgacaaagttaattactcgatctgaaaaaaaacatatatatgcacattgctctcgttgcgttcatcattttatatataccaaagcatatgcatgccagtttaatttaatcattaatttacgattatctcaacagtcttagtagtactattactagctgtctcatcttttttgttatgtaaagattagtagtacggatatatcatattaggtactagattgggtttttatgggactgagagggcatatagtaaagtacaagcagccatttgcagaacactgtacctagactctaggttgtgatgaacccaacaaacacctatactagtagctaagctaagaccatggattgactggtaattttattggcaatggccatacaaagctcctaatgatgcgtgaaaggagatcaaaaaagtgttaattagctttaatgacagctcccactaatataaaagggcacagattcctgtagctagcctcctaatgtaatggtggtccggggacacaagttgcatgcaaggcttcattgccatgaactttgttttgttaattacgacaggtcatgccggattagattactgtattaagataagctagcttcacttgttggttagcgctttcctcaaaaaaaaaaaacttgttggttagcgcaacacgtcaaaagacagcactatatgtattcacagcaaattaatctcaactgcagcaatgatcaacgattttttttttgtaaatatgttcagttaatatttggaatctctcatattcttagatgaataatactactgcctttctagtttgctgattaaatcgtgcgccttttgctgcattagttgcgttgtttggattaaactatccattatcaagtaattaatcacctcccttggcccgtgaatggccagttggaattgtaaaatggatgagacaggagagacgatcggagaggtgaggctagcagcaaatacattaatcggacaaccttaggatggtcgaatttttcttaattatgtacgggcaggaagcaaggagtactttaggatttgtgcaattttcggaaccacaagaagtatgcacagaagtttcatccggcttctggatgctaacatgatggatcacatcacaattcacccgtattcctttcattttaaaataaataaatatagtagttttaggtcataagatgttttaactttgatcaaagtcaaactgttttaaatttaactaaatttatagataaatataataatatttatattaccaaattgattttattaaattaatacttaaatatatttttataataaatttatcttagataaaaaatattactatttttttataaacttggtcaaatttaaagcagtttgactttgatccaaatcaaaacattttataatctgacaaagtcagaatattttataacctgaaacagaaggagtacgggatatgacacacattcgtttgtccaggatatgtcatgctactattttgtgatgacggagggagtacgtagacgtgtagcacacagtgacatcattaactcaagaagtcttcagtgatcgatacaacaacttggtggccatgtttgggggcctaacacacagtaaaaacttggcaggggcacagtctctcttggaacgtcaactcgcaatagcgtgaagagcaaaacaacacaactcttcgttcattcattcggtgtccagtgtaacaatcagcaggacaaagtcgccatttgacatttgcagcagccacttgcaggcagtccatcgacagacacacagcatcttctcttctctagcaaatcagtaaaatctcagcagaacaattgcagtgagtgaagcgaatccaaatgctggtttgcatacaacgatggttgaaatgggcacaagtgtagcaccaccaacgagggcatatatcatcaactcgtaactcatcttttgccgtcacaaagttttacaacagttctcaccacattcagaaaacgttcagctcgccttacaatcaatccacacagtttgagataaaattctcaaatgttcggtcatcaagtgcacaaaacttgataaacaccgtcagccatgtactttacgtgcaagcaagaggaaaatgaaaggcagagtcagacaattcttctacttggttaggtagtatataaggaagaagacagaaatgaaagaagccaccatggtagccattctgcgacttgctttggtctcaaaaacctgaagtaagaaaaaaaaaagagcaattgtaagaataacagaacagttaaggagtagcccatgacgtggagataggaactccttaattcattaccatcttaaacttgtccaccgttccagatagaaatcctctggaagcatccatatcattaccgtaaatagcaaagaaatgcattagagagtagtgacaagaaagatagcatcttgcaggatattagtaccattctgtccagcattcggttatgattctccacttcttcatgtatatctcctgtcaactgaagagacaaaccacatcaaaggtacagtaagtttagaatggctataagcacatatgaagattacattgtgatctagcatgcaaaatcttgagaacaataacatacaaaagctaaaagatgcagcgctgtttacttttgatattcagatcatccacatgcaataaccatcatactaattttttgaaatggtatatggcaggaggactgccggttatattaggaggagaaaaataaagataaaaagttattaacaatggatcatagtccgtcgagagagaaagaggagggaaggggcgacttaattacataaggagtgaatcatagactaaggaaaataacatatggtaaattttgcagtgaactttgcgccatgttcctcacaacaaaatatttgcagtgagctaaggactattaacgatgcgtcgggacctcctggaggctggaacagtggaataatttatccttgaatgatatgtctttattcctcttttctagctgtttctataatgctattttggattctcgaatgtgttgatctcacattcagatgttcagaccgtccttatatttttcttcgatggaaaaaattggggtcatttctccctagaaaaatatgtcagacaatctggaaatttatactagcaaatacacaagaaagtgcccaactcttgccgtgttactgtacaaagctataagtagtcaccttctgcagttagcacgaaaacaagtcatgggccatcagtaaataattccaaattaagccgttttatttctaccagctcgataaaaactccatccttggtattatatagtgcaaaacgatctaaccccaacctgcaaagccggtgttaccggagctggccatctaaaccgtggttgctctaggtcgtgccaatttgtatagcgagaataggcaccagtgtttcattatctttttgcacttctcaaaaaaaatctaaccctaaccttattgtaacggctcaaccattatcgcacacaatgcgatccaatcagactgaaccatttagccctttgcagtagcacagggttttgtgttaatgaggtagtaaaaacctttctaggtttgtattgcacataactcaatatgtgaa

SEQ ID NO: 73263 - DNA, 31948 bp, Oryza sativa
tggccaaaacctttcctgtagccatgtgatggtgcgctctggaatcagttgaaaactatacaaactcctcggaatgaaagttattttgaggttttgtttctgtaatcacccattgctgctatggaacgcttggtttttgttgtggtagtggcactgcgtctcttcgtattgcagtcaagcaagtcagtatttttaaatttaggccgagtttagttccaaactttttcttcaaacttccaatttttctattacatcaaaatttttctaacatacaagcttttaacttctccgtcacatcgttccaatttcaatcaaacttttaattttagcttctccgtcacatcgtttcaatttcaatcaaacttttaattttagcgtgaattaaacacacccttaaccctgttagctttcttgtttgttttgttctgttggagcacaatttactggtcacaacacaacgctatacgtgtcgatcggtgatgcacggttttatgacaacgctggatgttgattgttggtacaatgctatacgtgtcgatcggtgatgcacggttttatgacaacgctggatgttgattgttggtacaatgctatacgtctcgattggtgaagcgcggggtttatgaggtacacaaattgtacaccaaagaaagatatgcattacaacatccgttgtagtctagctggttaggatactcggctctcacccgagagacccgggttcgagtcccggcaacggaattttggtttattcataaatttaatatttgtaaatcagtttagtgtttaattttttccatacacttatttttttattcgttgctctctatgagagtttttcaagaaacataaatttaatactccttccttctcgtctcacaaagacttcattttttttctctattcaacgtttcctacacttagtttttctaatttattcataaatttaatatttgtaaatcagttttgtgtttaattttttccctacacttatttttttattcattgctcttatcagagtttttcaagaaacataaatttaatactccttccttcccacgaagatttcattttttttctctattcaacgttctaccgtctgtcttatttgaaaaaaatatatttttttaaaaatagtcacacataatgtattattcatgttttatcatctaacaacaacaaaaatactaattataaaaaaaatttaaataagacaaagagtcaaaagtatatcaaaaactgaaaaatagagtcttcgtcgcacagaggcactaagtgatttgtacctttgtacatcggtctagtgttttattactcctttcatctaaaccatattagctttttacatggtctccagaatcatactttaatcattactttctctcataatttgtacgagcatctataaaattaacgtcatatgaaaatattttcaaatatgaattacactaaatacatatattattggcaaaattggttacatagcattgaaagttcacgtttttggttttataacaccgaaagataccggtttattttaatacacccaaagttcaccctgctccatttcttaagcacttttcgtcaattctcaatcgttttccgtccacattaatcgtaattgactcagccacgtacacgatataaaatttctaccctcattgccttgcattctacttatacttgtgaggggtagaaacgttatatcgcgtgtgtctgggtcaataacgaccaaggcggacgaaaaagatcgagaattgacggaagtgttaaaaatgggaacgggtgaactttaggtgctattaaagtgaactggtatctttctgtactacaaaaccaaaaacgtgttattaattaaaaaattacaaatgttgactttagggaacaaggagaccttatattttagaacgggggagtaaattaattaatagtaaattttaactaacatgaactcttcttttccaaagtaattaatatgtttaacatactattaaaattttaatatttatagtatcgctaataatatcataatacacatcctgtcatgacgcggctgatgaaataaattcaataattactgcaactgaaactctccgtgctgcttcagatactcgtcgaaccactggaccatgtcagcacgagcttcttctgcagttttgacggcgaacggatcgctggcgttgtatctgcaagcgaaggcatggggcgccttggggaaggtcttcacgaagtgatcaacctgcagtcagcagagatggatgtgcttcaaatgaaacgagcgttcacgctgagctaaatcagttgagtatcatctgagtgatgcaaagctacaactgcagtctcagcgatgatttaaactgaaaaggcaaatggaatcagttggaacttaccctgttgttctgatctaaggcatgctcaaactggtgcacaacaagtggtggcgtgatggtatcacgctcacctccaagaatctcaattggacgtttgacctctgagcattacaaaatataaaagtaaaaaaaaaacgaagttggagaaatgatcattgaacaatttaaggttaagtgaaggaaaaagacatatcgacaaaagtatatactctatctattctaaaatataagaatttctaaaattttcttttagcaaaactaaggttaggtttaaaaaaatcttttcaatcacttcagttgttgttttttgaattttaaattgctcagattccttttttatatggttggcttggaatcattgaagtggtggaaattatagaaatcagtataaaaatgcttatattatgattcaatatttgaatcctacatatttttgtattttgaaatagaggtagtattgtactcctatatttgtacctgtcatgtcatgtacggtcactagcgaaggatgtgaaatgactaccgcttgggtttcttcggtctttgatagttccacggccacctttcctgttgagaatgaaataagaaggatgaaagatttacttaattagaattagagaatgaacccatcctggcacaaaaaagagaacaaagaatgaagattcattcacttttacgaaattaagaattgtttgtggttgattgcttagtgctcatgttgtttaactgaataactcaccaccccagcaataacctccaaccccaacagaggacatcccttccttcttcagaaccgcaatgagcggtttagtcttttcagctgcttcctcctgcaatgaaatggcaacaaacattcagatctaagtgattcagttaacattcagatgacaaaaaatggcgtctaactagcaatcattttttcacaatactgaatgttccgtataaaattgcattggaacagtgacaggtttttcttttcatcatgtactttttcttttacggagtgaaaagtaatcaataggtcaaacaaacgaaaagcaccgtgatcaaagaaagaaacacacaccggagagtgagccatgatccacacccaaaatggccttgctggatcatccgtgtaagggtcaccgtacaacaaatcaggaaccacaacgtagtatccggagtatgcaactttgtccgctatttgtcttttaactcaagcaagttgggaataaacaaaaagatcaaatgaaaaattgagttgagaacgaactcagctgcacacgacaaatttgcgtgatgaagacttgaagtttttgtattaatagctttaataaatcgttttgatcgacgatcaaagcatgagacaaatttgtgtaacgcgtattttcagattttgcaaacgtgcgtacctcagctttggtgctcggaaacctgcaaaagttgaagtgccgatattatcagacaaaaaacagaagaggatttatgagatactctcttcatcaccccgccccccccccccccccaaaaaaaaaaacaactctttcaaaggaaaatcaaacttgataacttttaactaacaattatgctaaccatatatatgccaagtattatgcatgttgtaccgttagattcatattttaaattgctttcatgtgatgctaatttcatattcattgaaaatataacatgaaataaattaatagtcaaagtatgttattaaagaccgtgtaaaaaaaatacaggccttataatttgggacagagggagcatatacgagtggctactgtctctcaaggcagtgtttgcaatttttggaaatccaccccctccccctcacctacacacgaaactatttcgcttgaaatttcaattattttcacgagttagcaaaagttattcaggtttgttcaaaatttaaattattctggatatttcgaatttatcatgtctgttttcttttggcgttttttccccaaaattgttaactactccttccgtttcaagttataaattgttttgactttggtctaaatcaatctgttttaagtttgcccaagtttttagaaaaaaatgttagcattttcaaccaaagacaaatttattatgaaagtatattcaattattgatttgatgaactaatttagtattgtaaatattaacatatttccttacaaagttaaacttaaagtagtttgactttaaccaaagtcaaaacgactttttttttaaaatgttaagtcaaaacgacttataatatgaagcggagagagcacgctatgctcctaacatgtatgcgtgcactgaccgtaatagtcagagacgaggatgatggcgcggccggagcggcgggagccggtgacgtagcactccaggccgccgtagtcgtggacgacctcgccggcctccccacccgtcttctccgtcatgttcggcgagttgtccaggcacgggtgcttccctgtcgacggcgccggcgacggggacacttgccgtcccgcgccgccggtgttctcctcggccaaggagagcccagcggaggccacgacgacggcgaggacgacgaggaggcagcgaagcagcgccatggcgagatttcagttgatcggtgtgtgtttcaggttcaggcgttcaaaaccaacccgtttattaatttggtgatccatcaagagctccagcctcagataggcgcgcgtacgtgccgcgcatctctgtgcagaggcttcaggacttcacgcacgttgctcgatcacaaaatcacatgaacgatcgagtcgcagcgatgataattaattgggggaggtatatataattaagattttagtaggttgagtgatgatgcgtatcatgcgaacggatatcgtagttgtgctgcattttgatcagttatctgaatatttctaatctgatcaacgccacgcgaagattaattatatatgagcaaatcaacggacgcgatgacatattccagccaactcagtgtatatcttggtgtttgttagagcctgtggctccgttgtatatgtggtgaagcagacccaatgttatctgggtggtccacggatggtgggtcgggctgcgttccctaataatgttttctaagttgtgagctctagcccgctaacacagcaggtcaacagtaactactccctccatctcaatatgttccaacttatgatgggtctctaaatctggacgtacgcatatctagattcgtagtaagcttgctacatattgggatggaaggagtagctcatatgctttctggtgccattagttctcaacggtctatgcattttccaacaacttattatggtgttgttacttcatacttctaaaacatggcatatgtattcgatataagaaattttacagtttattgagaaagtaactagattttatactaatttgtttagtagtactatgttttatactatagtccttctgatactttcttaagaatgataaagttatccattggataatagttctacatatgtaccggacacgctctagtgatacttcccatatggatatcattatatatttgaagctaataaaaagtctaaatcaaggttatcaattaattactcccacatcctaaatatatataaaatgtgcatgtattcagataaattaatatgtgtaacttttaactaataattatgttatcaatatatttgtttaatgacatacaagtaacactattaattttttattttaaaatacctccaagtgatattaatttcatagttgtaatggtatatactgaaaaaaggtaatggttaaagtacaacatttaagatcgtgaaaaaaactatacactttgtatttttggagtggagagaaatatgtgttattgtcctatcgatcaaattgaatagtcaactcttttatatttaaaaccttaacattttatttcttcatattatattatcattaaatttcatttactattatacatataaccatatccatgtatccatatttctggaaatgcgatctatcatgtatccatatcaaattatcaatgtgacatactacagttagccatcaccaatgcaaccgcctagagtaattaactatttgccactcttacaaatggtgatatagaatttgccactggatccacatgtcatggacacatgacggcccacatgttatagactacgagtgacaaattcttaattgccgcatcttaaaaatggcaaaaagttaaatgtcctgcagcctagggcttaacaaattagctattttagctactccctcgtttctaaatgtttgataccgttgactttttagcacatgtttgaccgttcgtcttattaaaaaaattgtgaaatatgtaaaactatatgtatacatgaaagtatattttacaataaatcaaatgataggaaaaaattaataattacttaattttttaataagacgaatggttaaacatatttaaaaaagtaaatggcgtcaaatatttagaacggatggagtatgtggttaggttagtaattctattaatcaactagaaactaccaggttgacttactttgtaaacatcttagataacttgcttctgtggccgaaagaattaagcgttattagccaaatttttatatcgaattaactaaatcgataattcttgcaaaatatagagtttatagtcttaaacaaaactgatctagacttttatgtttatctttaatgataaaataagcggaaacaaactaaatgatagagtaagatgaatgatcaaacaccgatctacagtgccatacatttaaaaacagagataacaaatattgttcatatttttatcagttagattgcttgtttgtttgttttttatcctcttccgcagcgcaattagccggtcgcaacatgtttaagctcaaaagacactccaccttttatgttcattttgatacaacagtgtcactttgtaagttggcaaactgacgctctaaggtgaatttataggtacaaatgtgacttataccagcatccgtgatctagctttttttttttaacgaatcgatgaacgcaaatttcagtgaataaagtaagtgctctagctatttaggatatactccgttctcaccgaagagacccggttcgagtcctcttttttttcccaacctatatagcttttctttgctttattgcttttcatcatatgcttcaggcaggaaaattttgatgaaactgtaagccaaataattggtttgtaatttactggatacatgaggcgcctagtggttcattttcttcttatttagtagtattggatatccaagtccaaggaaccgtgcaactgaatctttcaccgcttcatgatctccagatacttgtcaaaccatttgaccatgtcagcacgagcttcttctgcagttttgacggcgaacgggtcggtagcgttgtatctgcaggcgaagccatggggcgcatccgggaagatcttcaccaagtgatgaacctgcatacatgcaaccaacaagatgaatgagttcaacacacatcacatgatcgtttcaggccgagctaatttggttgagttaaatcatctgatcagggtcgccaatctgcaactgcaattacagagcaaatgaaaataaaaatgaaatcagttggaacttgcccttttgttctgatctaaggcatcctccaactggtgtattagctgtggtggagagatggtatcaagctcacccccaaggatttcaatgggacatttgacctctgaacatcacaagaactcagaaaatttgagagataataactgaacaatataaggctaagtgagtgaaaatgccagaacaagatcgattatctgtacctttcatgtcatctacaaccactagcgcgggatgcgaaatgacaaccgctttggtttcttcagtctttgatagctccacggccacctttcctgtcaagaatgaaagaggaaggtttgatacataaaagcatatttagaaactcagaattcaaagaatgaacacattcctgcaggcacaaaatgaaaaaaaaaagatccattctactttgattcaataagaactgttcatgtcaggagtggaggcaagcctaaggcagctagagcttgtgccctatgcttctccaaaatcatgtacaaattctcttaaatcaccatgaaaattttaaaggaaacaaacaattcattagttgaaccgttagttccagtctttagcaatttctggctcggttactggttcatgtcatgtctgaatgttttatgctcatggatttaactgaataactcaccaccccagcagtaacctccaactccaacagtagacgtcccatccttcttcagagccgcaataagcggtttagtcttttcagctgcttcaacctgaaatggagagcaacattacggaacaaattaatatccttcattagaaaaaaaaagtgattcagttcaaattcagatgaaaaaaagatggcgtttttagtacgaatcatcttctgcgatacagaatctttgcgtaaattgtactggagctagcaattacagggtttttttttcatatattttttctagaggtgacaaaaggaatcagagaggcaaaacaaaaagattggaaaggcacggggatcaaagaaaagaaacaaaccggagagtgtgtcttgatccactcctcaaatggcctcgctggatcatcggtgtaagggtccccgaacaacaaatcaggaaccacaacgtagcatccaagctggtatgcaactttgtccgctattttccttcagcccaaccaaatgggaaaacgaaaacaaaaaacaaatgcacaaatgagttgtgaacgaactcagcttcacgacagcctgttgcttgtgtgatgaagacatgaagtagtttttgcgatttgatcgatgatcgtaggggtggatccagcacgggggcggcgtgatcttgagcccccactactagcgtgaagactatgagattaccatatatagatgaaagggggactgtaattctatctagtttgctcagactctaatgctatttctttttgaatccgtcacttcatagcgcataagttcatattctgtgcaaacgtgagtacctcagttttggtgctcggaaacctgcagaagatgaagcgccaattaatgttagccacaataattagacgaagaggattaattttaattatccgattcgtgtggacaatgtaaatgtcgtcgctaagctagcctaacatagctctagtggctagtgtctccgggaaggcatgcaggcatgcacatgctgctgcaccgaccgtagtagtcggagacgaggatgacggcgcggccgccggagcggcgggagccggtggcgtagcactccaggccgccgtagccgtggacgacgtcgccggcctccccgcccgtgttctccgtcatgttcggcgggttctccaggcacgggtgcttctgcggcgacggcgccggcgagtacacttgccatctcccacggccgccgttattctccttggccaaggcgaggcgcccagcggcggcggccacgacggcggcgagggcgacgacgaggaggcagcggactagcatcctcgtgaatccggcggcggcgcgtcgcccgtggcgaattcagacgtgttcggtgatcggtgtgtgtgtgtgttaacgcttgagcccgttgattaatttgctgatgtgatccaggcactcgagatggagatatatataggtagcgggacggagggagctagcgagcggtgctgtgtgcacggaactccagaaccatagagcctgtttgatgtcattttcaaccataatatatttgtttcgcaaagttaaaaaacaatatctacgtttagtttattaccaaatttagtcaatacataagaaatcttgccattgccaaaattttagcattgacaaaacttgttaatgtttattttagttacaatctaaacatgcccatacatatatatttaacttttttttctattatgaagtcgcatcatttcggctatttttagcttttaatgattcatcaagaattcaaattgtctatcttctcaaaaagcaacactgtacatcacaatcatttataatcgttggataattgatcagggtaacatatatagactatagagaacatatgaaagaaaattatatagtaagaaaattaaattttacaactcatcaatactattttgttatacagttttctcgtagcaacgtgcagaattcccattagtatacatgtgtgctgtgtgcaaaattgtcagatgtacgcgcgtccacggcgcagggaacgtacgtacttaccgggattcaggaaggtccaggaacggggacaaacctaggacaacgatttttatttttttccgaatgatcagcatccgcgataggacaacaattatgactttatattgcacctacggagagagtatatattgcactacggagagagtactttataaaccatgtatagtctaaagtggcacaagtgaacaatactaacatgatatacacttaaacttgtgaaataaattaaacaaccagaataaaacaaaatcctaaccaatttttttagactaaatagatataaaattgagaagatcacggtaccttaccgtaaaacctagtcacgatgtgatgaagtgtaaccacttgggagttggacattagagcggacaattaatgacgtcctgctagctatattggttagtgatggacccctgaccggcctaggctctaggcgatcgcactagtggtctaggcccatggcccttcttgagatactcggacgctcatttgttcagatcccgcacaagtggtctaggcccatgatctcacccttcttgagatacttggacgtccatttgtttagatgcctgtctatgtatcttatgatagtttctaggtttgcatttcatatggagtttgcactatattttcccatgatcgatgcagccgcccagcagtgctgcaattaaggacatacttcacaacttttttaggagtatattgcctgatcgtaaatcaaatacttgattcgaagtttggaacctttgtagagacgaatattgtttggatgtcccctctttatgcagacactgccctttatttttataggcgggttaaaagaagacctgttttttttttaaaaaaaatgcggagggagtctctggtcaagacctacatatttgtgaaattcgattttcagaaacgaacgcttaagccacttgcgacaacattttcacagacgggcgatttaagtcactcacatttggaaataaaatttgaaaaacacgtatctatacttagtttttcatataaagtttgatgaaggacaactttataataaaattgtagattttgataagatctgcaactttgtagctaggtgacaacctttcattatagagattgtttagagacccaaatattcgttacaagatctcaaatttattattataaaatctcaaatctatattgaaacgatctccaaggctccaatgaagacatactctacactatacgacccccccctactactgagtaatctaagagggattacataattctagtaaaagtgaatacatgagatatgtggagggggaattaaatttgaaaatatactgttgatttgttttttttctcaaaaatattcaggatgtaaattgtttagcagaaatatactatcagtctcgcacatccattgcgcgagagtgacgtaggcgtgtgtcacgccccgaactagccccgagtggaactagcccgtgacgctccgaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaagacttagaccaaacatcacaggcgtgacttgggaactaggccgaaaccctaaaactcatcgtagccgacttgctcctggaagaactcctcgtcagcgggatccgcttcatcttcttcagcaactggggggagattatttatatagagcaagggtgagtacgggagtactcagcaagccatggggaattaagtgtttaatgcaggcttcaaggaaaggctgttgtttttgcaataggttttatttaaactcctttctgaaacaactaagtgagtgcttctcaaacgacacggatgagacagtgcgtctcgtccggttggagtatgtgcaatgtatcagtcttttgaattgatcaagattggcacccggccaacagctttcaaacggccacccgggcctggctgatcccatcagccgcagattttccaaacatcgaacccaaaccacatcagcaaatttcacaagcagtaggcaaacaaaactacgctaggaatcacctcacatccgcccatgaccgtgggcacggctgttcgaacagtttaataacctctgcagagggggtacactttacccacacgacattactaacccgaatcacccagcccgtgcagaacggccacgtctggtgacataaaggttttcatgacaaggcatttcgagagcagacacagggttgccatatgccgacgagaggggtcccagaccaacaacaggttaggtcccagaccatactgtgccaggaagcccgggggttctctccgacaccaccccgttgaatccacatgtctgtcagcatcaaggctcccccgcttagcaatttactcagccaggggtgtcccattccacccatgtggtcgcacttgtcttatgatcggatgaaattccaaggaaacggtccttaagtgcaagagcgggaaaccgtacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtgcagagtgcacgattaccgaggcacaactaggtggttacaagggaacatgatataacaattagcaatagaaggatcagatgcaacaagttaggtaggcccaccggtctgccttgcagacgggcaaacagattaagtgcaatcctatcaatgcatgatattttgcaagcaatataattaagttcaaatataggctcaatatgttcaaaggtggcttgccttgctcgagatcttgagcttgatcctcgaattcctcgcactacgggtcttcgggctccgaaactacacgcgaaacgggacaactcaacaaacagtgaaaattaagccctattaatgacctctaagcgtgccattagatagatctcgaaatttgaggaattttggaagttgaatggagtcaaacggccttacggttgggaagatattgaatttctaagattattggatttttggtctaaaggaaaaaggatttatttaaattatttttgaaaagaaaagaaaagaaaagaaaagaaggagggaggggaattagacttcccacgggcggctagggcgcggcccgagagaaaggagcggctcggcagaccttaatgggccggccggcccaagaaggcggcccaaggcacgcgcacgggcggggggaagagaggaagccgatgggccgggtccaccttgcgtggtcccgggtgggacccgcttgtcggtgactcggctcaccgtgagcgaggagcacgcggggcgtgctagggtttggggaggggaggcgcggcgcatgcgcgcggttcgcggaggacgcggatgcggcgggcccacgcgcagcctcatggctcaccgcggaccatgcgcatgggggaggggggaaacggagggagcggctggccgggtcagccgatccggtcgtgccgaggtggctccgacgtggcgcctacgtggctgccacgcgggccggctggaggaagacgaaggcgccggcctcgaatggacggcgggcggcgacggtttctccgggacgccgtgcgacgacgaggggcgacggggcgtacaccgggatgacgagggagaacgagagggagcgagccaacggcttggattcgccggagggagtccgtcggcggcggattgcggcggcggcaaccggcggagagaaaagggggaaacggcgacgaggtcatgagggaccgattcccggcggtgagagcatctacgcggctacgggaacccaccccttgcgccggattaggaggaaacgcatcgagggaggccggcgacgagagacgcttccgagctcgggcggcgatggcggcgagcacacggcgagcgacggcagcagtcggggcgacgccagctagctactggggtactacacacgctactaaccgagtctaaggggaggagatggatcgaggagggagaatgggggaatgcactaccgagatgaggcggggcgctgtgacgagaggctgacggcatgggagcgatctctccggcctcgtgccggggaagaggaagaagagagcgcgcccggagtccccttccgtgtcctcgctcgtgccggctcctccgacacgcgcgacggcgaatggcgaacagagcatgggaggcggcgacaatggagtggaggcgatgggacaaaacgagaggagaagggagagagggcgcctgggctttataggatggcaacgtcggtttgggaaccgacctagggctgtcaagggagggagctagcgctcggcggtcgcggccaaagcggcgacaggggggaaatgacgccgacgggagagaaaagggaaaaaggaggagggaaaaggggcttgcccccttgccactttggggaagaagagagggcgacgcagcagagggggggagctctgcctctgtcccttggaagctagcgcgcggagtggcggggctgggttgtgacgacggcgatgacggcgggggtggtgtggagcggagcggcgacacggacggcaggcgcggacaggcacggcagaggctgacggcggcggcgaccaggcggtcggccaccacggcgcgcgcgcgcgcgggaagcaacgggcggcgcgacgatttgggcggcgtcggcgggaagcggcagcgagagtggagggcgctcggctcggcgcggctcacgcgcacgcgtgcgcagcgcacgggcagagcgggggagagggagagagagagagagagatggggagggagggggagatgggccgagaggaattcggcccatcgaacctaagggaggcgaaatagacttttgcggagggatttgatttgggaaggattttgattcgggattgaacttgacgatcgatcggggatttgagatccggaatggcacggacactagacaataagcaaggaaacagatttcgaaattagggtttttagaaattacattttcccgctaggcgccacgacggaacgggcgctacagcgtgacgacacggacagtctcgcacgaggatgacgcgagaccgcgcgatacggcgagagtgacgtgggcgtgacgacacatgtaagtctcgcacgaggatgacgtgagaccgtgcggtatcgtggcgagactgtgcggtctcgggcgagcaaacagtgagagcgaacggcttctctgctgagcttccgcttaattaatgactaatcacctcattagcgattaattaataataattaatgagtaataccttgattagcgtttaattgatagttaattaatcactaatcaaggtaattaaacaaaattgaatcagccgcacggtctcgctcgctgctaatgcgagaccgaccggtctcgctatttcgtcccgcgacacctcgcgacactcgtgcggtctcccggtatatatcgtcccacgagaccgcccgtgtcgtcacatccatatcattttcgcataatgtttgtgtcagaccgacggttcccggtatcgtcgcacgagaccgttcgtgtcgtcacgtccacatcattttcgcacaatgtttgtgtgagacggacggtataattctgcaaaaaaaatttatccctaatatttttgagaaaaaaccaaatcaacagtatattttcaaatttaattccgtgaaggggcacctttctcatttgtcctttcatcctcagcgtagaatagtgagtctcctcttatatatatagctatatttcatatatggaatgctaggtttgggacaataaatatatatgtgcaagatcatcatgggcccaaacccatagttttttaatactctatgtcggggcagcatcgatctactgagagtcgcagggagtgtggccaccggaggccctgttcattttctttttcagtggattgggtctaaccacgggaattttttatggggattcctaatgggtgagtctgtgccagcacgctcccccacgcaggttgctcgactaacggcgctcttagcactgtcaggattatggataccacatacctaatagtagttgactaaatctcggcaggacccaccacataccatgtcctatacggaagcaaccttgggatataagaggagttccggataaggaaagacaaccagagttctacatggaaacgacgaggactacttggattgtattcatattgggttccctagttcaacttggacaaggagatacctacgggtataaatacaagcccccctaggaggagaggggacacgagacaatcaacacccaacacaatcagcatagaagcctacatacgccaagacacgccgccggatatcgacttcagggataagcacggctagtaccctacggtgtctccggatactgtcaggagaaacgaaagcgccatctctgatctcgccgggcacggattcgaggagaaaggctaccctattgtcgactacgagtcagatcgtcagaccgccatgttgacaacagttagataggctaccccaaatagtgtattggtgtgattatcatgaataagagcaatatcggctccggccaacaggatgtagggttattacctgacaattcaggggtccgaacttgtataaaaatcctcgtctccgtctcttttacctcagtctcgcgtatatcctagtaccaacgatccctatactgtccaaataccatagtcgtgacatcaaacgtcgacagtggcgcgccaggtagggggactttggtgcttcaggatttcgacgagatgggttcaagagatggattctccaacaataagctactcgacgacttcggctgtgaggagatctaacccaactgaagtacattttccgaccagatcgaaaccatcgtcgtcatcgataactcggtctatcgagatcatccaagcctcaagatacacggcgtaccaaaagatgtcagatcatatgatgtcgaacgagtacgcaataaggtaattggtagattggtttttcaaattgatctactaatttcgtagatacgtccggcatgtatctacaaaggtacgcaatattttatttgcaatttatcgtacctattcagatcatacaacattgtcagatctataatttattatgtttacctagagcatgttttttatacaatatctattgcgcgagtgtccccgatgttaaatcgactacggtttaatgctgagggcttgctctattttcttccgtataaatcatgcttgcttacggtttacataatgcctgatatttacatctgctcgttatatcctgataatactagaagatctatgcagtttttgagtacatactcgatattctctgctatatgtcttgccttctagaaaatatttttcaggaacatttgagcactcgagtaggttgtgatcgagtacaccccactatcgagaacattctcgacaaatgcggagtcgtcgcacccaacttaccaacgaagaccgacgacctatctcatagcaccggccatggctggactactcgagaaaagattgttaacggataattcctcgcaaatgccgtcggtttgatcacccgacatgattgcgagcggacatccggatatgctataagttgggtatgtgagtcatgctggccacatgatatgcacatgtaataaaccaactttagcgcccctataggtgattaagagactcctacttctggttctcgaaccagtaaaacgtagcgatgtagcgtttctcccactgtttccacttcaagtggtcgagttacgactactgcctggtcctcgaccagcgatgtagtgtttctcccactacttccactttaagtggttgagttacgactactgtctggtcctcgaccagcgatgtagcgtttctcctactacttccactttaagtggtcgagttacgactactgcctggtcctcgaccagcgatgtagcgtttctcccactgtttccacttcaagtgatcgagttacgactactgcctggtcctcgaccagcgatgcagcgtttctcccattgtttccacttcaagtggtcgagttacgactacttcctggtcctcgaccagcgatgcagcgtttctcccattgtttccacttcaagtggtcgagttacgactacttcctggtcctcaaccagcggtgtagtgtttctcccaagtggtcgagttacgactactgcttggtcctcgaccagaggtgtagcgattctcccattacccctgcttcaacaaagttgatatcaggagcacaagatcaccaagtgttttacccagagatcccttacccagatgacacctagcgttgaaacctatcctaatgtccctttacgccgtcttgacaaggcctccgaggaacctaagggaacttcggctagggacgcccagagccgataaggccttgtcggatcctttagagacgaaagaccatgtaagatctggtcgtgtaatagttctcgccgtgcgtattaaccaagctgtgtaatcggaaatggaatttccaacttcacggcttggggctaggatcagtgcttgttcaaccaaggcaggtcaaaggtccaagagccttatcatccgagaacaattctccgacgacaaggctgggggctagggagagtgtatgactccacaaactgactgatcggagtcggtaagagagaagacgctcatatacaaaacactggtctgtacattcaattcactagtatgttatattataacatgttaccctttgagcgttcgctcgggggctatttctatctaatattcttttcttagtattgatttcaagaaaattctattcgacaatgacgaaggctccatgtctctatggttgtacaccaagatcgactaaggcgagtacgacaaatgtcgacaaggctccgtcgcagactctacgccttctcgatcgctcgagaacagttgctggatcttgacaaggaatacggaatgaagaaatggtgtacccgccgagataaaatttcttgacttcaatccaaattctcgattacagcaagacgggagacttagtcgtacgctctgtactttctcggtcgacatcagagattgacttagacaaaccctttcggtgcccgcacgaggctgataaaggaagtctaatgttatctctaaactcaccgagaacggttacgtgagctcgataacagttcctccaaagtgtgtggttgagaatatgaactcgttcatttgcatcgaagtcgggggctactgtcagggttatggataccacatacctaatagtagttgactaaatctcggcaggacccacctcataccatgtcctatatggaagcaaccttcggatataggaggagttccggataaggaaagacaaccatagttctacatggaaacgacaaggactactcggattgtatccatattgggtttcctagttctacttggacaagggaacacctatgggtataaatacaaacccccctaggaggagaggggacacgagacaatcaacaccaaacacaatcagcatagaagcctacatacgccaagacaagccgccggatatcgacttcagggataagcacggctagtaccctacggtgactccggataccctcaggagagacgaaagcgctatctctgatctcgccgggcacggattcaaggagaaaggctaccctgttctcgactacgagtcagatcatcagaccgccatgtcgacaatagttagataggctaccccaaatagtgtattggtgtgattatcatgaataagagcaatatcggctccgaccaacaggatgtagggttattacctgacaattcaggggcccgaacctgtataaaaatcctcgtctccgtctcttttacctcagtctcgcgtatatcctagtaccaacgatccctatactgtccaaataccgtagtcgtaacatcaaacgtcgacaagcactagtcacgcttagcgttaatgatgagtctaaaaattttctcataataaaataataaataaccaattgagatggaaatttcaaattttaagttttctgattaaagtttaagttgaaagtcaaatttaaataaaaaacttttaagtcaaaattttaaactttcaacttaaatttaaaaactactaactcttgattaaaaattggtttaaaaaactttcaactcaaaatttcaaacattcaactcaaattatgaaaaatttcaagtcgaatttgaatctttcaagttaaaatttaaaaaactttcaactcaaattttgaaatgaaaaatatttcagtttcaactaaaatttaagaagtttgtactaatgttatcattttttattataacaaattgtacatgtttaagttttaaaagaaatgcacaatcaaatcacttgattagaaaaaaaagatgtatacaagagttgtgggccaagaaagaccacgtggcttcattggaacaggtagcggaaaaagtacaccgaaggtccctcaacttgtcatcgggatacaaaatcgtcctcaaaccacaaaaccaaatatacagggtcctttaactatacaaaaccggtcactcaagatcctttggcggttttggccccggttttggtctacgtggtggctgagtcagcgtgggacccatgtgggccccacatgtcaggatgccacctcatctcctctctcttattcccccctcttctccatttctctctctttcacttttctcaggccagcgacgggcggtgctgtggggaggaggctgctagggggaggggagaggaggaggtccggcggccggccgcccgaaacaacgtcggctcaaacggcccgaaacgatgggcatcgtgtgaatctcccgcgttgaatcttgccaatggtggagcggcaacaaaggcgtcggcggctggacgacagggctgagtggtggtggcggcggtgccgtgctcgcgctcgtcctttcccttgtcctcctcatcgtcgcggcgtggtaggagtacgacgtcacctcgccgccgccgcggggccctgcgacgcctacctcgtgttccgctcctccctaccgctctacgcctccgccgtctcgatctccaacctcctcaacgtcaccgccaccaccggcggcgaggtcgtccgcgaaggagatggaggagcaccagagctagaaaaagaacgcgccggtgctctacgacctcgtcatctcccagccgctcaagtggccgtagctcaccgtctagtggctcccctcccactcccggtcaccggactccaccctttcccaccgcctcatcctcggaacccacacctccgacgagacgcccaaacacctcctgctcgccgacgctgccctcccgctttcgccccacctagcggcgggggccacggcggcgggcggtgccgtcccagcctcgtccgtgtccatctcccgctcggtgccgcacaagggcgaggtcaaccgtgcccgctgcatgccgcaaaggcggtacatggtggctaccaagacctgtgtggatgaggtgcatgtgtaccatcttggcgacgacggcgagaagtgcggcgccgatgtggtgctcagggggcatgaagcggaggggtatgggctggcaccagctcagagtacggcgccgttccaggtgagcatcttcaccagccggtccaccaccgccgccgacgtgccgacccgccggagcgcggcctcgccaagccgtgggttcgccgcgacgttgacgaagatgatgaaggaagggagggagagagagagagagagacagacagagatagatgaggaagggagagaagaggggaaagagggaaagaaggctgacgtggacacttgacatgtggggcccacgtgggtcccacactaactcagccgccacgtagaccaaaaccggggtcaaaaccaccgaaggacctcgggtgaccgattttacatagttaagggacctcgcatatctggttttgttgttcgaggacgtttttttgtcccgatgacaagttgagggaccttcggtgtactttttccaacaggtagcatgcggagtcagcctcatgggcacttgcctgctcacacgacaataaaggacgagctgggcctgtgggccaaaccatgcggtagtaagaaagctagcgcgtatgcgctaattagcgtttccgctttgagtcacgccaggcatgcgagatctaaggcccttcataatgcagtgagttggagtgttacctagttctccagctaggccaaaatctaatgtggaggagaaaaagcagtgggccccgtgtctttgcaaggttttgtacatcctagctaggatctggtttccttacgcccaaaagagaaaccgtgcgtgcctgcgctctgcggtcccctccccaatcctcaccattcttccccaatccgatttccgtcgttggtcgtcagcatccacgcgattcgcacgggcttatagctcgccggccacactaccgagtccggcctccggtgaggaaggggagaagccagaggacggccggaagagaagtgcgacgacagtggtggggagatgtcgtcggtcgcggtctctaagcgaggacgaccacgccgggcgtggaaggagatcagagctggggtcgccgccgtgccgctgccgttgtcgacgccctccagatccgcgctgtcgtgccaccgtcgtcgacgtcctccagatccgcgctgccgtgccgccgtcgtcgagtcatcatcgtcgacgccctccaaatccgtgccgtcgctccggattcaggccgtcgcgtcggcctcctcaaccgccgttgctccggatccacgccgccgcctcggcatcctcgactgccggcgctctggatccacgccaccgcgtcgatctcctcgacatccggcggcgccggtgttcatcgtcgaggtgggggagaggggagaggccgccggctgcggagttcgtcaccgaggtggagagaggccggaggcggcagcgtcgcctgtgaagcttcggatgggttgtgtgggcggggaaagtggagaggggtagtgtgggtgcctggttagggttgagattttgtattattttctccattgtaaggtgttcaatgtaaaatttatacttatttgtaaattgatcaaaatatgagggctgaaatcaaaagtgataggggctgaaacggaaaatcaaagtcacccatgaggccatttgcactgtgggggaatcaaaacttggacacggtgctttttagcctacgtggcattttaggttcctcaagtgagtagcttgcattgctactggcctaaccgagcacgccatgtgtcagcgtgtgactactgcatgcaaagtctttttcactcttgtgtatgtttagttctctcttggttaattacatgatgagggtcaggtaaatcttagggataagtctacgggtcgggcgtctgatcggtttggagaaaaatcgggcgctgacgtcagcgcccgatttacgtgcaaatctacgttaaactgatttttctcttaaattacttatccaaatcataatttgactgcaacattaatttcgttgcaattaaatcttcaaaacaagaccacacatggatatattccgacgaaatttttttagcttattattgaattatttttaaatgttgcacgatgttccactagatatatcggaattgtttcactaagttgatcgaaaatgtttcactcgtttaaatcggatgttgtttcaccttatataaaaagaatgtttcagcaaatagcgaaagaatgcaaaagaaaatttcacttcactgctacattagatctatacatagtgaaacattgtgagtacattaggtgaaacatttttggtggaaaaagaagtaaaccaaattcccttaatagagagttttcaaaatatgtgggtgatttgttgcaaaagaatattttaattcactgtaacattagatctatacatagtgaaacattgtgagtacactaggtgaaacattttctgtgaaaaaaaataaaaccaattcccttaataaagggtttagaaaatatataggtaatttgttgcaacgttatgtgtggtggggataagtgacagtgtggcaggaaagatgtgatgggggcgtccgatttttcctacccccgagcgcccaggaaggagcattatcaaaatcttggtcaaagaaaaaaaggttaggtaaatctaagctagtttatcaaggggtgtttaaaagagagggactaaaccaaaaaattactccgacttatatttttggagagctctcttccaaacaccccttgagtacgcacgttgttgaacgcaacgactccggggggtcagtcgtcgaccgcgtgtttaccgcatttattcacacgacttttcaacatctctgcagtatccccagttccccactaataaagaaattagggtaaggaaccaagatgtacgacgattatcccagctctgttttccggtatgaccattgatttgtatccatttgataggctgatagctgcgacctgcacgcggagattctcttaagcccgagtgacggaggtagtcatcaagtcatggtttctgcctataataccgagcgtacatccgagccgtagcgagtagctcgcaaatcgcaagctaacacagaacagtaatttgatattcacttgctcggagtcggagctctagcttggttcatcggttgcatacttgcatataccaccgtgccatgccttacctcgtccagctcctcctcctaactgtggccttgactctccctacctccgtccatccacagagcggcacaccacgagaagatgatgtgcgctgtctcgagggcctcaagacatccctcggcgacccggatggccgcctcgcctcctggaccttctcaaacacctccgccggtgccatttgcgagctctcgggagtttcgtgctggaaccccgacgagtctcgcatcattgctctctcgctctctggctttggcctcaccggtgctatcccctctgagctccagttctgctccgccatcacaaccctcgacctttcctccaaccggctggggggacaaattcctcccgcactgtgcgactggctccctttcgtcgtcaacctcgacctctccggcaaccagctctccggaccaattcccgcagagctggccaactgcaagttcatcaactcgctgaagctgtcggcgaattccctttcgggaaaaatccccgcctcccttgtgctcctaggtcaccttaagtcgctagacctgtctaacaacaacctggacggcgatatcccgcctaagctagcggcctctttctccgcggacgccttcgccgataaccccgatctcgtcgagccacactccggttttaacctcggtgtcctcttcggaaggccggaggctgcagccgccattgccttcgtcttcggttttgttggcacactcttcttcggtccttccatcattagacgggtcgctggtcgcagttgttagggttaatcttgttgttcatggtttaattaggatgagtacctacttaggagtcgttgtttatagaatatgtctcgttgctgcaatgctgcgttggtttgtaacgtataccggccaggtcgtgtacgtacgtaaacgtatacgaatcaaagcctgttaatcttggaagaggattctaattcctcgaggaacatcccctcgtgtaattaggggtgaaaacggtacggaaatttctgagaattctggctaccgtttccggtttgcaccgaccgtttcagtcagtatcggtaattgtcagtatcggaaatagaaacggtaatctctttcgaaaatggtagcggaaatgggatggggttttttccgaccgttttgtcggtaactgttttttatcggtaatttccgtcaaatttccgacaaaattccgaagaaggaagccggctgggcctcgctagcaggagcaagacaggagcagcccattaggcatttaggccgggaagaaaacccatagggcgtcagccggcgtgtcacttctccttctcatccactccctgtctcgtgactctcgcacagctctccgccgccgccgcaccgccgcttgctagttctagccgtcgtatccttgtgcctcgccgcgtcccttgccggagaagcaagatggcgcctgccggagaaaaacgccgcatccatctggatccatctgaaagcaacaacagagacgaggaacattgagtttgccactgttgccaggtttgccaggtccaccaggtataagtgtatagcttgaatgcttgagcatgatttttttacatgtacagatgaatgtggaacgcctgagccttgatgtgtttgagcacgattttctgttgatgtgcaagcatgattttagtagatgtacaacttttaagccttgagtatttttttagacataccacagttaaatatgggatgataccacagttcactgtttccgacatgaattttcgacttccgaacaatatcggtagattcccgttccgacggttccgtttccgatatactgacgttaccgatatcgttaccgtttccgagtataccgttccgattccattttcgagaaaataaaatgaaaatggaaatggtagagggtttttccgaccgtttccgaccgttttcatccctacgtgtaatatttttgtcaaattcaatgtaaaatggttgtaaaaatactttaaaaaaaacaacataagtacactaacatctatcaaaagacgaagtacaccgaggtcaaaagcggagtgcggctcgacgagaagagtgtccatcgtccattggctccgtcttctgtttaattgttgctacactcttcttcggctcttccataatattggacggccgctggcaagaacaagctgtaggagacaatgaaatatatatgcatgcgttcttgtgagattgcttttcgtcgactgatacctaaccgtgtgagtcatgatccataattccgtattcgagaagatcagtactactttattcatgccatgaccatgcatacatatgggctttcacagatccatgaagaattcctcgcccgaaaccgaaaaatacataaagcaaactcactcactctggctgcagagcgaccgtgcgaagtgcgtactcacacgcaattttattcgatcgatcggggccggcacggcggcgcacacgtctacttcgccgcagacgccgacatgatgtcgccgtcgaacggcgcctggccgaagcagtccaggttgggcccgtagccgacgccgagcacgtcgcagtagcgcttgtagaacgcgacccggtcggcgccgccgttgccgccggcgcactggagcccgccggtgaggatgttcgtggtgagcccgtagcctggcgcgcggccggccgcgctgtccgcgggagtcggagtccactgccccgtgacgacggcgtgcggcgacggctggctcggcgaccgcgcggtcatccacagccacagcgccgtcttgaacgccaccgtcgggtccgttgccaccagctccgggttgcccagcaggtccgcgccgatcgcctcgccggccgccccatagttgtagttgctgaaattgaattgaaaattagattccagtagtggtcatttgttcagtccaaatagtactagtctggaaattgaacgtttcacggatgaaatcccgttgcattttaagatttttctagtgttcgtccattttgtggattttttgtttgcaagttcatttatatggacgttttggtttgctcctttgcgttctcttactatgcgatttgcatgggtccgcgggcgtggtacgccttgccgggcgcgcacggccagcgcgcgttcggcacgcagaagtctgacgtcgcgcccttcacctccttgtagcagtagccccacgagtagggcccacctgcagggacacatgcgcactcgtgcataagacatgtgtacgtacacgtgagttccaacgtgacaagtaaacgttactacgttaccagaggtcgcgtgggaagtctgggccaggaacgcggcgacctcacgcttgcgggtgtcggcgtcgcccgtggcggcgaaggccgggaacgcgccggccgcggcgacgaaggcgcggtaggcgtagaacccgcgggcggggcacgccgcgtcgtcgcggtggggcagcatgcgctcgaactggtccgacgtcacgacggacgccacgccggcgcggccgccgcccggcgccgtgagcagcaccgcggcgacgtcgtcgtcgccgccgtcgcgggagacgcggcactggctctggcagccgcccttgcagtagtcgtcggtgaggccgcaccacccccacctgctgcagcagagcctgttggggcaccgggcgccgccggcctgcctgccgcactgctcggcgcgcgccgtcgccgcggcgtaggcgagggccagcacggccagcgccagggccttcatggccacctgcaggtttgcagcccttgctgcgatcatggcaagatgcttatttcttcaacaaaatcttgcttttcagtggtgtgttggttgagtgtacgtagctggtgagtgatgaagccacagactgcatggcctcttatatagaggagatcatggcctcatctagcttgtgtaaaatcggttatgcaaggtgatggcctcatcttgtgtgaaatgagtaggagtgaaaaccgatcggatagatccgatccactctgaatccgttcgaaacgaggatatggtatgggcttttggaaatccggcggatatgaatgcggatgaggatagtataatgcggatgcggatgaggatatggtatctctaaaatccggtggatgcagattatccgacatttctatcggattatccgattggccgtttgccggataattcgaatttatcaacacatgtaatcactctatctattgcatataacataagttggtctatcgaatgcactaatttatcaattagcatagatttcttagtctgaggctttcaccttctcatggcatacttgcgtagctgtatttttatattatggacatcatgtattcatattgtttaacacttaagcacataattagtatgatggatcgtttattgattattgtattattgtttcttgcattgctaacttaatattgtattgattgtatacacatgtaatatccgataaatttaatctttttcgaactgattccgcactatttccgacatccgaaataatccgctccgcatgcgcatccgtatcctatccgcacccactctgaatcctggtttaggatatggtatgaccattattcgtctgaatccgctctgttttcacccgtagaaatgagtcatgccagtgtggagagtacactgtctttcgggcagcacgagggtgcgttgctcgttttcatctcctgcatgcctgcgtctgctttgtttaactgagcccactgatacatggatgcacgatcgaatatacagggcattaattaaactagatgaagagatagaacagtagtaaaaacgatcgtctttgtttccggggattcgatgtcacacatgcatcagccagatcgagccgtgctctggtttgattcgttggaaagtttgcgttacaactacccaggatgagacaggatctatatgaagaaatgcaacctagatctctttgtatgatagatatgaattcacacacttgtctctctcatgtggttttttactttgtaggtagataaagaatttcatgtacctccctctttgacgtcgttatttacttgtgtagtactaacgaataacgattgaatttggcatggcttaagcctgctactaaacatttctccgatatatcaactttagcatccttgagcaagcagataggaacagcaacatgaagcaaatgcatattggccagaaaacagcatcaactaaaatctgatcccacgattactcaaactgacatgaactgttcttattaacgaaactaattaactaataaaatgattgtataaactctatctcttttctcctgaaatgaaattggcagagttcctgccctttgcccctcaaaaaaaaaaaaactaataaaaccgcgcgcaacaatgcaggcaaactgcaccagaagttcagaacaacgatgcgaccctgatcaaaccaaaggtcaattaacggataagcaaaacgagcataacctgcagctttcttacgcattttttaatcaaagaatttattactaccgaagagattcagaatttcccgaatagtggtatagggttagagttgcatggctgcacccatggagcattggagcctgaaggagtgaaggtgatgccaccttgtccctgaaaatgttcgatgtgcgttgtgcgaaatccctgaacaacgtcggtggacgtggacacactactctagtcactagccatcgcttgttacactgcatcggggcgcagttcagctcgtctggaccgcgcaggccgcgaatcacggtagccaagagattcgaagggattcggagttttattctccgaaccccaccaccgcatgactcaccggagcgcgccgcatcctgcattcctgccttggcctctcgtcaccggcgaccgcaggtacacgaacacccacgcgacggacgacacgctaccgtgcaggaagaacaccctggcatgcatggtgatcccctcggctagtgatatgaaattcaggctcacgccctgcgtacgcaaaattggtgaacttgtcggtacatgcaattatgcaaacgtacgggaaccggtaagctgattgcaatctgaatcctgttttagattctgagattaatggcacaatttgcccttcttttgtcctgaatgttcaggttcatatggatgcatcatgcatgccaaacccaaactcatgcagcgattatctgcatttacatctgcatttgtttgtctgttctgttggcaatttggaagacaagaagcaaatcctgtttccaaaacgaactaccagaaaattatgtgtttctaatacactttgtttgcactttgcttgcatcatggtcaaaattgcacacgcagttggaaaatcaaggggaaaaaaatacttcaggggaagcaacttccaactagcacgccctgaacccaatattaaggacgtgcactatagtcaaacaaatctcttagcctttgcgtgttggaacggattttgcgtcaatagccaccccgcctagactgttcgacttcaccgatcatccagttccaatcaat

SEQ ID NO: 73264 - DNA, 900 bp, Oryza sativa
cacagggttttgtgttaatgaggtagtaaaaccctttctaggtttgtattgcacataactcaatatgtgaagcaaactttgcagagaaatgaagtgcgtcatatgtactttttttgagaacactgaccctgtcatactcttttggtagctcagaaattccgtctttggtattatggtacaacacgatctaacccaaacattaacttaaaaaatgctccaagcattgttgtatactcaatgatcttatcagacggaacaatttagccctttgcagtagtacgggggtttgtgtaattgaggtttgaaaacctttccaggattgtgttgcacatagctcaattcagcaagtaaactttggagagaaaagaaatacatcatacgtactcttttgagaacgctgaccctgtcatgcagactgtccatagcttggtcattctcatgctcatgaatttgagaagagtaagctgaacttctgatcgcaccctcctcaataccatcaaataaagcagctctgtggctgcggaagtccctgcaaacggccaaatgaatataaaaggcattactaccgtgttctggacaactttagtactgtctagtatgcgtcacttccgttagctgagaaaaattacttccagtgattgaaaagtagcagagtagaaacaaacagtttaattattattattttcatatgtgttgtattttcgtaagtttccatgagattatattataattttttttatgaatcatgacatgttaaatgaaaaagggggtattttaattgtggaaaatcagtaaagactaaagaggcatcatacggtacggtaagattggataaggggataagcatgatgaacgaaatggacaaaatgcatatatgcaagaggcaggggctaagagggg

SEQ ID NO: 73265 - DNA, 2143 bp, Oryza sativa
caaaattctccatgcattttggtttctgtcattctttgatgattaaggaactttgcagattatctaaacttggggatttatataccctttttgtctatgaataggtgaattgcatgaattgttgtttatatacatgatttatatacccttgctgctgctgccacataaataattgtgggctgttttattatctacacttgattgaattgaatggatgaattgctgtttacatgaagttagtagtactgtctgtttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttctttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattttgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcagggtacatctgcaaggaggcaatatgggctcaagaagatgcagccgctgcagcagcgaatgtccctgccccgtttcagacatccctgaacaaagagctcgcaactgggcgcgggcaaggggtaaggtcaacccggacggctctgtcacatttgagaacaaaagtgatgccgtcgtccatcaggaactggtga

SEQ ID NO: 73266 - DNA, 2651 bp, Oryza sativa
agctcggtaccctgcgctggcattttgttcttgggtaaaggcaaacattttcactcttttgctggatttgcgaatcgtcctcttgtctttttatcctaccttaattatatatgcatgcatggatgtcgtttccagaagaaaccacatacgatgaccctgactaaatcagaaggacatgcatgagcttcaggacgactatagagtcagcagtattgttgttctggtccacctagctagacgacatgctgggctgtatgagctctattgatcatacatattctggcccaaatgatgtagtgttccatgggccatcagcttaatatgggcgttcaatcattgttggtctggcccagatggttgattgacatattatttggggattaagttcacttgactcccttaattagtggtcgaatcacctaattattaaaactggtgtaatttgacttcctcggtggtttttggagggtagtttcactgacatggcgcctatggtgcggtagtaacctggtcttcgttctacgtggtgttgacgtggcgctaatgtggtattagaattaaggggttgtacagattgatgccatttccaaccataccatttttgataaagttgctaaagatgtgcatacatttatttttttaccaaaccttggtaagtatataagaaatcctatcaaaaattgtcaataggtgtcaacttatcaaaaattgataaagtttattttggctacaatctaaacagcctctaaagaatatgtgtgggactcatttgtcattcaataaaaaaaatactgtgggactcgctgacatggtgaaatcaccaggtaaaacgccaaggtgaagagaaatgggagagaaagagagagaagggtgagagggagggaggaggaagaagcaggatgacatgtgggcccacatgtcagtgggtccctcaaatttttttaaatgttaaatgggtcccacacatattttttcaattctaatgccacataatcgtcatgtcaataccacgtggaacgaagactaggttaacaccgctatgtcagcgaaattgtcctccaaaactacggagggagtcaaattgcaccaattttaatagttgtggagagtcgagatatccggtattgtggttcagtgatacgaattagatttggccactagctacgggagttaaattgaacttagtccttattatttgagcgtcatgtttagctagtgtttgtcatattgtagtgttgattatttgaagcccagcaattcaattctattattaattgccgtcatgtttagctagtgtttgggccggccattaggcaattaaacctaataatctatctggtcgtcttcttcattattccatccatcatatctcctgcgtgattgttaacctctgggggttccttcctttgttcgggcatagaattgaattagaggcaggatcaaatcaacatgactgactgtatacagtacagagagattgtttggaaggtaaacatataagacaggcggctaaagaaaataggaaatcattcgacaacttgagtgcgtgtttcatcaaatagtaatagaaaaatcttcatataacagtgacgagttctaaagaaaattcgacagtatatatagagattgttgatcactctatagacgatatacatttctcaatttgatcgacgaatccggcaactaacagaacaaaccctagttgttaacagttacggatccaggaaatttacgttaagtgtgcctatatatttaggatcactccactatatttttttttaaaaaaagaaaacaccaaagatctgacagcaaaattttaacaaattttgatcgaatttttcaaaaattgatcaaattgtggtctagaattcgtgaggaagtctgtaatattcagaagaaaaaaaacagaaataagcagtccactcctgcttcgtcccttgcagttgcagaaaccagttatcagtgaagatggctgtctagtcctctacacaaaaaccgctatcgagccattcctcttctttgttcttcctccaggctttcttctcctgatctgatttcttggagattaattacaggatctccagacaaatcataaccactattatgctccaatattcatcaagaggattccattttagtgacattttactatcatccatgtccataataatttcatactacattattttagtgtttttccataatttgtgggtatgccggtgcatacccgacacccccggtccgctcctggttattaataatactgtattattcatatttagctatgtgtaaatttaggtttgaaattttacgagacggtaaaactgtgccattaattaaatctttattatttccgtaaatatctcattgggaattaaggaagcagaagccccctgggcatacgtgacacagcaaggggaaagtaaagcggagagacttctgaggttaattagttgagaaaaaatggaggtgaagtgggcgcggcgctcaatcatatcatgcatcactgcatctgcgtgcaccacattggaaggctaggaacgaaagcatctccaatctctcattgctgacctctttaaattaacccccttaatttgaccaccctacgtaccagctttcatttcttaatttaattctctggcttctgtatt

SEQ ID NO: 73267 - DNA, 12214 bp, Oryza sativa
tgtattattcatatttagctatgtgtaaatttaggtttgaaattttacgagacggtaaaactgtgccattaattaaatctttattatttccgtaaatatctcattgggaattaaggaagcagaagccccctgggcatacgtgacacagcaaggggaaagtaaagcggagagacttctgaggttaattagttgagaaaaaatggaggtgaagtgggcgcggcgctcaatcatatcatgcatcactgcatctgcgtgcaccacattggaaggctaggaacgaaagcatctccaatctctcattgctgacctctttaaattaacccccttaatttgaccaccctacgtaccagctttcatttcttaatttaattctctggcttctgtattatattgacagtgctcctatatatatgtactttagcgtggttagttatatattataacagcacgtaatcactgctcagcatgtacttaatttgtcccttggtagaatgatcagccgatgcttttgcacgatcagttcactgtgccatataggggctcccatgcatcatgaacaaattaacatgaccttcggtaaggcggtactctcgaaagtcgctattggggttgcacaagggatgagttcatcttcttctctcttattcctcctcctcatcaacctgtttctataggatgactaggagtttgtgggtggctagtagcttgcagttatggtaggacagagtgtctatgtcccgctgtagagctgtggtgacaggccacacataacagtgataggctcggcgttagttcttttctcaagttggtggttgggagtcgttagtttcatgctggtgagtttttcttttctttcctaattgtagcctcctagagttgtaatattgtatattttttcatgctatattaatatgaagcctcgcagctatctcatgtggtttgttcaaaaaaaataacatgatcaattgttgtttgttgtgtagtggtctctccggtgtcactatcggtgatttgacaaagacactcccaatgttgaatggtgtaaagatagtcatgtctccagtctttgcacatatatataatacatagagtcaaagtttaagatcaaaggtaaccttaataagcgattgaatgctctatgtgatggaaatgtgcatgacgtctatagtcctttctaagactctaagagtgagttacaaaccgcctttgctacctgtacgttgattgagttttagaaaaatcgtagttgattgatcaatcatcaatctgttgttgatctaagggctatagctctatcttgtacctcgagccaagagggagacatgataaggagagggatatgtcagagaggactcgcgacaacgtcctggtggagatgggcgggcggtgggtgggggtgagatcatgtggttaggttgcaagggtgatagatctagcagcgtgagccaccccgagatgaaggagaaaacacatatggatttgttgatgaagagggtgatggcagtgatgtggagggaaagaggacagggataggaaaggcttgtccagcctcgccggtgtcagcgctggcagtgcaaagaggaatgccatcacacgcgagtcaaagttgggacttagaacgttggtggcacaagagacgggatcaggagagggggaggctatgttaaaattagattgttacacaaataacaatgtaatctgagctatttaataaactatatataaaacatcaggcaactaatgaatggtcaagccgttatcaattattctggatggtaactccctgccttcgatgcaggacggagtgtagcgggggcccctgtccgaccatcccttgcgataagagtttttttctttctcagtaacttatatttcctgtatttgtgttttttgtttcttttttttccttgacccctagcaacggccctctgaccgtttgcgttgtgtaaccaaactctgttgtcttcttctaatatattgacgtgcaatcatttagcgcgttcgcgagaaaaaaatggtttggatggttaaatcttactagaaaccagaacaagataggctacgcaattagcaatggatggttggcattaggtcatctaaggtcaaaccgacggagatacatttgctgcataaatagcaactagcgtaatatgtgatgtgatgtacttcctacgtcttataataagtttattttttagctacttatatttgtctagaaataagttaatttttagaataattatttgtatcggagtttatgaaagtaaaaagtaattgtatttggagtacataaagtgaggaagtattgagatttgataaagtagaggtattttagtttttttttattggtacgtatgagattagtgaaaaataaatttatttgggaagggatgtagtacctagctactcttgtaccagctagattaagtataaaccaaaaacaacgggagtagtagtagtaagaatgtaaaacggttccaacataacgcaacaacggaacggttggatattcggttgggaggagaagggagattccgtttgagtaggttataaatagcaaggaatacatacgtacgttccaaatcatcacaaagcaagcaattaagctggcatgggcggcggcggcggggagcagcagcagcttgaggtgctccacgccctgaacgtggccaagacgcaatggtaccatttcacggccatcgtggtggccggaatggggttcttcaccgacgcctatgacctcttctgcatctccctcgtcaccaagctgctgggccgcatctactaccgcgtcgacgggtccccgtcccccggcacgctccccccgcacgtctccgcctgcgtcaacggcgtggccttcgtgggcacgctctcagggcaactcttctttggctggctgggcgacaagctcggccgtaagcgcgtctatggcatcaccctcatgctcatggtgctctgctccctcgcctccgcgctctcctttggccacaccccgacctccgtcatggccaccctctgcttcttccgcttctggctcggcttcggcatcggcggcgactacccgctctccgccaccatcatgtccgagtacgccaacaagaagacgcgtggcgccttcatcgccgccgtcttcgcgatgcagggcttcggcatcatcaccggcggcctcgtcgccatcctcgtctccgcctccttcagggccgccttcccggcgcctccctacggcgaggaccccgtggcctccacgccgccgcaggccgacttcgtgtggaggatcatactcatgctgggcgcgctgccggcggcgctcacctactactggcgcaccaagatgcccgagacggcgcgctacacggcgctcgtggccaccaacgccaagcaggccgcggccgacatgtccaaggtgctgcaggtggtggagatgcgtaatattggtaataatggtggcagcaggaggccgttcgggctgttctccggcgagtttgtccggcggcacgggctgcacctggtgggcacgtcggcgacgtggttgctgctggacattgcgttctacagccagaacctgttccagaaggacatattcagcgcggtggggtggatccccaaggcggcgactatgagcgcgctggaggagctgttccgcatcgcgcgggcgcagacgctgatcgcgctgtgcgggacggtgcccggctactggttcaccgtcacgctcatcgaagtggtgggccgtttcaagatccaggccgttggcttcttcatgatgaccctcttcatgctcaccctcgccctgccgtaccaccactggacggcgccggggaagaaccacgtcggcttcctgctgctctacggcctcaccttcttcttcgccaacttcggccccaactccaccaccttcatcgtgccggcggagattttcccggcgcggctgcgggccacgtgccacggcatctcggcggcgtcggggaagctgggcgccatcgtcggatccttcgggttcctgtacctggcgcagagccccgaccggagcaagacggagcacgggtaccctccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtagcgctgtcgccgtctgcatatctatctatatatacatgcagatatatagccaccatataatataactgatcgatcgagaccagagaagatcgatcgaagaaaccgccagttgatatataactggcctggctatccactatatatatatatatatatatatatatattttgtcgttgtcgtcggcgacaccatgtaccttttcttctccttaattagccttattgtgtttcatgatgtgtcgatctacttctagttcgtcgtcaacgatccctgcctttttacaatcttgagcttttgcgcgcttttgacaaccgatcaagcctaactatatatataatctcgtagaaaatagaatatgtcaatgctagctaactgtacatcattatataggaactgtctaattaatgacctgaaaattcacttagtaacatatttttactcccccgtccttatttctagctatgtatctacacatgtgtatagccataaataaggtttttctataaaagtagtattgaattgctaaacaatatattttgtctgtgatagtgatatctcttgtgcatgtaaacaatatatatactatcccacattcatattgatgctaatgaatctagataaatatatatgtctagattattcattagcatcaatatgaatgtgagaaatgctagaatgacttacattgtgaaacggagagagtagccaatattaacatgaaaacgtgtccaatcaaagcacacagtaaatacatgcggtggcacccgaagatatgccactacaagaacaatacgtgccatcaggttctgcaagtactacagtgaaagttccaggagagaacccatcagggcaagtgcgtgtcgatgtgctataggttggctgacagggcctacggcacccttttacatcgcacaaacgaaataccaatatcaatttggggttggaagggttaagggggatatggattataaaaaaaaaaagtactccctccctttcatattagaagactttttagcattgcccacatttatatagatgtttatgaatctagacacatatatagattcattaacatctatatgaatataggcaatgctagaaaatatatgaaactgaggaagtaatggtttggtgttgttctaatgcttccaatatgaaacaaaactttacccagaaattccaggtagatctctctttcatggaagttttggttcccaacccaaaagtttcaggatatttaggaggtcaaaatctacccatagtgccaacttttggtgtaaacggtcaccaccagtgtgttataggctgttgttatttacactatagagtaaattatatccacggtacaacaatttggcgggtgggtgcgatatagtgcaataacttgaaaattaaacgttcaagtgcaacaacttgacaagtaggcgcgttctagtacaagaacttgacaaattagtattttgatgcatcaacttagctaagcatatgctaggtgagttttttttttcacgatgtcaatatgccattacatagcagtcctacggatattactttacaatattgaatttaatctttaagatttatactgcacattcaatttacatccaattatctttaagaatttttgttttctgtaccttcccaaatctcgaccgaaatataataatttctacatccagttaattgattttcagttattagttattaggataaaaatataaatatgcttatatacaaacccacgctagtatattgtcaaaataaatacttaaaaattaaatatgtatttaaaaagtgctccaaataattaagttgtcgcataacttcttaacttattgtaacaaaatcgtacatatcttgcaagttgttacatttatgcgatcacttataaagttcttgtcctgaattgcacttacctgccaagttattgcactagaacgctcatttctcaagttcttgcatcaaattgcaccaacctacaaagttgatgtaccgtgggtgcaatttactctacactataaatatgctaaatatatctattatttcttttaaaaaatatacttcctccgtcttgtaaaaaatcaatttctggggatgaatctggttgtctttttcttttggactgaaggtatattggcttatactaaaaagagttcttaattattaattttaaagtttggaattaaattaatgacattctaaatcgagagtgcaaaacaaatacaacttcatattatattaattataaattttgaaattattaaatttggaaaactaaaaaaataaaagaatgtgatatttacaattttttagataatgatgtgatatttacaattacatgttttacaatagtatccatgatagtaagtttgacctaatcaaaggctagatttaaaaacatgtaggagctctggcaaagtgtctaattaatacaaagtgtagattcgggacatcaattatatagagagggtacaatttcacgttggactatgccctttgaccaaagttctaatgggaaagggcgtgttcgaaagaaaaggtttgagaatggtttgggaatttttctctcgcgcacagaaaacaggatgactcattagcgtatgattaattaaatactagcttaaaaaaacttgaaaaaaaatattaatacgatttttaaaataacttttccataggaactatttttgcaaaagaaaaatacagtttagtagtttaaaaaatatacgcgtgaaaaacaagaaagtaatattaggaacattgtagtatagaccacaccctaagccaacgtgcaggggcagtataaacatattacatatatatggtggtggatgaactagatatgtgtatagggtgggaagcgtataatcttcaagggacaaccttgaccatcaagattggccatgcagaaaaatgatgtaaagcaattcttgtgctgtgttattagcttgttgtgcataagtcaaattgaaggcaagggatcatgctcttactgcttgggaatatgccggccggggagaagggagaaggaaggaaaagatacatctttctaaaaagtgattcagatattatatattgctcagtgtagcgtgttgctccactggaatgttcctatagtggcttaattggggctacctagtacaatatatacaggaggaggaggaggagaactagattaatgaatgatgatccaatgtggccggtagtgcatcttcgattcactcactacatgctgtcgttcatgttagatgtatactctcttcgtttacttgtgcgtctctattctcagatgcatgtcttcatgccataggtagtttgcacacttcatcgtaactgtcgcttcgaattaagagcctacttggatcatttagttttcgaactaaaattagtctctggaccaaaaactttagtcccctactatttggatccagggactaaaatgtactaaacgcacgtggaccaagagagaagagaaagactgccactttagtcactataagtacctccaagagggactaatggattttagtcatccctgtttggattcttaggaactaaaggtgactaaaatggagggactaatggattagtcctataaaccgaacaaggcctaatttgtctttgtgccatgtgtagtttgcacacttcgtcataactgtcgcttcctacagaagtacctctaagagtgactaatggattttagtcccaatatacacttagtctattttagtcatcccaatttggatttttaggaactaaaagtgactaaaatggagggactaatggattagtcctatgaaccgaatcgggcctaacttgtcttcgtgccatgtgtagtttgcacatttaacttgtcttcgcgccatgtgtagtttacacatttcgtcgtaactgtcgcttccttaggaattaacttgtctcctttcttttttttattacctaaaattttatgataattaaacttggacgaaaaaaaacaacttaggccttcagccctaaaacacgtgtctttattttttttatttttttgagaagggtaatttttacccgtctctatatccaaccggtgtctttttattttattttttatttttttgagaatggtattttttatccagcctctatatccaaccggatatatgtaaacttttttaaattcttagctctcaaattatccaatctaaaattcattcctatggagatttgaactcatgactttaggatgctactcaggttactgcaacactattctacatgctttttccttcagctcaaaatttctgcagccccaagaataactgacattgtcttcccaccaaattacatgattattaacctcataccaaaaatcacatgtctacgcatattagactttgacccaattacacgagtgtacgtatattagactttgacccaattacacgagtgttttttcatgaaggctagctgcggttatttttccccttcttttgtttgtttttgcatcaccacgattttctgtattttttcctcctatatgattttggatttatgagggatgtgtggtgtcacgaggcaccacagacagcggacgggaaaccagccagttttttttatgggaagtactaccaggaaaccagcctagtagttactccatatattataacagagatgaaacaggtttcacaatattacagaagttgtaaccacagcttgttaccagttgatagtattcatcatttttttgtgagggataaccagccatccagccaagacgccaaacttaaaagaaaaaaatatataatctcttataactctccaagtgcaatagtgataattaagatagcaggctactacaaataaattagactccaagatacaagacaaaacttggtttggctattataataaacctccgaggagctgtcaagagaggaagataaaaacgaagggcagatagaactagtcagagagaccagccctgctcctcaagtgctccttgaagtccatgatatcaccttcccacctggtcaccgcctgcttctcgcacacccaaatctcttgagcaacctggttgataagcctgaagtcatgactcaccaggaccaaaccaccgtcccactcgttcagtgcctcagccagagaatcgatggtctcaatgtccagatggttcgtcggctcgtcaagcagcagcagttgaggctgcctgtaagccagccacgcaaagatgacgcggctcctctgcccatcagagagattcctcattggcatcacctgcgccttcccagacaggccaaacttaccaattgcagccctcatcttctcctcctcattcccagggtattccctcatcatgtactgtagggccggcatgtccaggtccagcttctctgcgagatgctgatgatactgcgcaattcgaaggtggttgtggcgcctgaccataccatctaatggagctaggtcacctgtcatgagcttcagaagagtactcttgcccgcaccattggggccaaccagtgcgattctagagtcaagatcaacaccaaagtcgagattcttgtagatgaggttatctggggtatacccgaatgagacttcaacaaactgcagcactggtggtggaagtttgccaacatctgtaaagcggaacaccagtaccttgtccctgacaaccttctcagtgagcccacctcgttccatcttagcaagagttttctctttgctctgagcttgacgagcaagctttgcagatccatggccaaaacgtgcaatgtactccttcattgaagcaatctgttcctgctcccatttgtactgcttcatttgattctcttcaagctcagaacgagtttgaacgtactggtcatagttaccagaatataacttgagcttcttgctctgcatatggatgatgttagtgcaaactccatttaggaaatcttgtgagtgtgatatgacaacaagtatacgatcaaacttctttagtgtctcttccagccagacacaagcctcaagatctgcaaacgaaagaggaaaaaacaattaacctacacaggcaaaaggttcaacaaaatagtatcgcaacaaaaagccaagaaaacccatggggatgcaatagcacatttttatcttgttcagacttttataagcaacgttctttccttgagctacactccaatgatgggtaggcttattatataagtgtcaaccagactatgggaggagagagtcaggtgtagaacaaatttaaggccaacaataagtaatcaggttataactgtgtgttcagaaaacaaaaggtatagcaacataggggccttttgtcccaactctcaattcatagaaccaggtaaaatctaactacaatatacagctatttaaaagatgttccgtttgtatcatcattaagtagggcacaaacatccttgcccatagccagcagccaataatttgacacatagatgtgtttaaaaaaactaaagcaatgtagaaaatgcctttttttcccactggaaataaaagatgaaatcgattctttatttccgtgtggacttagatttcctttagaagactcaccaagatggtttgttggctcatcaagcaaaaggatggttggattcataaacaaagctcttgccaaagcaatcctcatacgccaaccaccagaaaaatcctgagttttctttgcctgcatttgtttattaaagcccaaaccaaacaatatctcagcagcacgcttttcagcagtagatgcatcaagtgcttctaaccgctcatatatacgatccaaagcatcaccgccaccatcatcctgtaaatgtcagtaaagaaactgatgttacaagaccttaagtacccagttataacttgcaacaggaacaaagatgaaataccaatacagatatcaggggcacagatatagcaatatgaagcatttgaagagctggtcacctgagcagacaaaatttcagcttccttttccaacttcatcctctcttcgtcacaacagataacagcctgtagcgcagacatatctgaagcctcaatctcactggagagatggtaaatatccatgtgttcagggatagggagttccctgcagcctatggctgtgagcagagtagatttgccacagccatttaggccgagcaaaccgtaacgcctgtaggttaaataaataagacaagtgttagtgtgaatgaaggggctgtagcaggataatttttgtgattttaaagtgatgaatgggaaataaacgaacctcccatagttgagctccaactcagaatcaacaataaggtcatggccatgaaatgttaatgagagggactctatctgcaacaacatcgaatcgaaagattacgtttcagttagtttttgggggtgcaaataaaataaaagcaagaagtaaatatgaatgaagatgattatagtaagattacgtttaatttgtttatgtatatatgtatatgtatatgtatatatgtatatatatatatatgtatatgtgtatatgtatatatatacatatatatgtatatgtgtatatgtatatatatatacatatacatacatatatatatatatatatatatgtgtgtgtgtgtgtgtgtgtgtgtatcaacatggttattgtatcgatcccttagaaattggagcgcaaggatgtaggagtgcaagttggaagcaggagggatgatacatgggcatctgatctgagattctgagcggagcagcaaagcgcatcttattattacatcttataaagggggggaaagaaaaagaaactaggtattcccctccctcgtcaacacaacacgtacatctggtctaatcaaatctaatagggagcagtaagtaagaaggagggaggggggggacaagatccttacgtggatatcgcgggagagcggatgggaggcgaggactccggtgcaggtgcgatcggaaagcttaagcgcggcgataccgttggccgctttatcggcggcggaggaggaagaagatgaggaggaggagg

SEQ ID NO: 73268 - DNA, 3537 bp, Oryza sativa
tgtgaacaatcttacaaatcactttgtcaaataaagaaataaccaaaatagaagttatagatcttgatgagttatacaactttgttattgacgactttttcagttaaaatcatttagtatttgaaaatgttgtttgaagttgttataatttaaaattcatattcaaactgttcaaacaaagtcatatagaaaaatgaccaatacaaaagttgtagatcttaataagttatacaactttgtttttgacaacttttccatttgaaatcatttactacctgaaaaattatttgaatttcttatattttaaaatttaaattttatatagttcaatcaaactcgaatgaagaaatgactaaaagaaaattggtagatctcaacgagttctacaactttgtttttggcaacattttcatataagttcatttaatatcataaaatttgattcgaacttctcacatttttaaattaatttttaataactattttcgcatgcggtccacctaaggaggcgcatgtaaaaatctatttttgcatgtggctattttaagtggaccacatgtaaaaatatcttcacatcaatagttttttccctcctcaccacttcaaaaattttcatgtcttctcctctcctctctctgatatctcaccccctctatttttctttctcttcctctctctcactctctctcttcctctctctctctttctctcctcgatctacgcccggccgaggaggaggtggcaggagcgggcggcgggcggcgggggctgcgacgaggaggaggcggtgggagcgagcggtggcggcagatgggagcgggcggcgggcgacgcggccgagcagcgggcggcgtgggccgcgacgaggaggaggcggtgggagcgagcggcggctgcggatgggagccgccggcgccgggagagagcggcggcgggcgacggccgggcggcgcagatccggtgcatagggccctccctcgcgcggatctggcggcggtggcggatgggagcgagcagcggcagcgggagtgagcaaccggcgccgggagtgagcggcggcagcggatggcagcgagcgatggctgggcggcgcggatccgacgcagggggccctccctcgcgtggatctggcggcgtctccgactccggcgacgacgacgagtgggcgacgacgacgacgatgcgggtggtggcggcaggcctcgtcccacccagatccagaggcgggagcggccatcgtgatcgagggcggcaggagcgggagctggcggcggcggcgggagcgggggcaagtcgcggatttttgcatgcgggtgccctggccgcatggaaagatggtgatctttgcagaccatttcacgcatgcggctggcccaaccacatgcaaaaatcgtgtgttcctaaccggcaccagcgacgatttatgtagaagtgcttcttcgatataagagtttttctgcatgattaaaagagaattttgttgtccatttatttattctgaaatattggactgacactgtgccacatgcatatatatcggtttcagcccggttacaagtttatgacacaccatacttcgactcgatactagtacgttgtaagtacgtacttgtacgacgacacgtacagggagtgagtggcaaagcactcttattttaccgccagccagtcgccgccggcgaagctactagctgttcactgcgccgccgtcaacccgctgttgaacggcctctggtcgtagcagtcgaggttgctcccgtagccgatgccgagcacgtcgcagtagcgctggtagaagccgatccggttcgccacccggtcgtcggggccgaacccgcactccaacccgccgttgatgatgttggtgatcacgccgtaccccggcacccgcccggccgcgatgtcccccgagctcggcgtccactgccccgtgatcacgtcgtggcacgacggcttcggcgactgcggcgtcatccagaaccacagcgccgtcttgaacgacaccaccgggtcgacgccaccagctccgggttgttcaggaggtcctcgccgatggcctctcccgccggcccgtagttgtagttgctgagagatcgatcgatcaaaagttcaaaaccattcttatcgcgctgagaatttgataaaaaaaattgaacctagctttgatgtgcttactaggagagttggatggggccgcggccgaagtacttcttgtccggggcgcacggccactcggcgctggggacgcagtaggaggccgtggcgccgatctcctccttgaagcagtagccccacgagtaggggccgtcgggcgcggtcgcccacccgcccgtggtctcgtgggaggtctgcccgaggaacgcggcgacctcacgcttgcgcgcctcgtcgtcgcccgtcgcggcgaagtccgggaacgcggcggcggcggtgactaaggcgtcgtaggtgtagaaccctctggcggggcacgccgcgtcgttgcggtggagcagcagctgctcgaagagctccttcgacacgaccgcctccaccgcgccgccacccccacctccaccgccgcccccgccgccaccgccgccacctccgccgccgcagccgtcgcactggctctggcagccgtcgccgcagtagtcggaagtggagccgcaccagccgtaggagctgcagcagaggcagttcgggcacagcgccccaccggcctgcgagccacactgctcggcgactacctgcgccgccatggccgcggcggccacgaggagggccactgctgtcgtcgtggctttcatggctggacttgggagtcctcgtgcttgatttcgagatgggacgatagcgcgtaacgcctgccttttatagacggctggcgagtcggaatggacttcgctagcgagctcgagttttttcatcttcgtccacgtctgcacggaattggtggtgattgctagtttgattgtgaccgctcagctgtcagcctgggcagtacagtacgtagctagactcatcatcaatcatgaagggcaactatttggagttaatgttaagtctcattttagtttcacagatcgatcttcacatagtgagataaactgacaaccattcttgcttgaagaacactaattttgttgcctgattacttccaacctcatgcgagctattatagaacatcggtaactaaacacgaaaatacgtcataagtattcaccaagataattaaccacatcgagatatgatatttactaatgagattgtgctaaaatttatatctcgggacactgattacgggtgttccttagaaaccatgggtgtgccaatgaaacatgagctatagttgtaccccaattttttggaacttatgatttcatagctatattatgtgttttgtgatattatttgtgtaaaaacaagcattcttgagcccaaaatcatcctttctaagggtattcaaatttctccttatatactttacaaaaaaatctgtacaattgattgttattagcactaatgtcaaaattacttcttcatttcacttatagg

SEQ ID NO: 73269 - DNA, 3458 bp, Oryza sativa
acgataaggtttggtctttcgaagttttaagacgacgagatagctatttaataaattttaagtaaaatcatactgaaaaatatatgattttgtttgggggctagccgcgcaattgcgcgggccacccagctaatttttttctaaaaatagctaatacttaattaatcatatgctaatggactgctccgttttacgaaagatgagttgctaacacccaccaacgaacactactcttatatatggatcgatggatgcgtcagtgcactgcatgcgtagtggagacatcggcggccgggtctttttaggtagtatacccgtaagtacgagtaattaaattaattagacatcgagatgcatatctttgatacgtcatgcgcactgatacatgtaatgtgatgaggaggggggaatcgaacaatcattttccaactttcaggtgttgttttggcatgcatttgcatgcgcccgtcgatatatccatcggttaatcgagaattgtgacgttacacggatgcatgattagtgaagcatcaaatcgatgaattgaatcttgtgtggtgtagaagtatagtacttaattttggcgtgcgagagcagcaatcctgataataatatcatgatctccgtcaggggtagagctactgctgtactaacctgtagaataaaggttattggttcgatgtcctccaaccgtctcactccttcatcataattgtatgggggaaggaaacccacccaccttagtgtggtgtgtactcctcatgggccacgacttttcatggcccacacccgacttcatttatgggccggcctgtctggacgacggcccatcacctacctatccatcttctcttgcagctgccctccccgttgccattcgatttatttgtaggtcttcatcactgccgcatgtacatatgtactccctccgtcccataatataatggattttaagtttttacttgtaacatttaaccactcgtcttatttaatttttttaaaaaaattattaattattttatttgtgacttactttattatgcacaagttttcattttttatatttataaaaaaaattaaataagactagtagtcaaacgttgcaagcaaaaactgaaaatcccttgtattgtgagacggagggagtactgtacttcatctagcaggagtacttacttgttggatgttaataactccatcgttttatctttattttttttcccattgcaggtgcagcgagcgaagaagcttaattgtacaggttagtacagcagtagctctacccctgacggagatcatgatattattatcaggattgctgctctcgcacgccaaaattaagtactatacttctacaccacacaagattcaattcatcgatttgatgcttcactaatcatgcatccgtgtaacgtcacaattctcgattaaccgatggatatatcgacgggcgcatgcaaatgcatgccaaaacaacacctgaaagttggaaaatgattgttcgattcccccctcctcatcacattacatgtatcagtgcgcatgacgtatcaaagatatgcatctcgatgtctaattaatttaattactcgtacttacgggtatactacctaaaaagacccggccgccgatgtctccactacgcatgcagtgcactgacgcatccatcgatccatatataagagtagtgttcgttggtgggtgttagcaactcatctttcgtaaaacggagcagtccattagcatatgattaattaagtattagctatttttagaaaaaaattagctgggtggcccgcgcaattgcgcggctagcccccaaacaaaatcatatattttccagtatgattttacgtaaatttattaaatagctatctcgtcgtcttaaaacttggaaagaccaaaccttatcgtccctctatttctaattatatagtttttaaaagtcacaccacatgctacctcttacttttgtcatatccttttttatttgcctactagatctatcactatttctattcattctccttgaaaccttaaaaaattagatattatagttttagagtttattctctcattgggtagtcccgtcaaacgctgccattatactcctctacgacatgtccacagtcttccctctttattgtcattaggattttaaaaatcgaacataattatcgttcggggtttattttttactttacagaagtcccgctaaaccgtcagcagctttgctattgtactcctttatggctcgcccactgcatcgcttctttattgtcattaacattttaaaatcaaatatgattatcattgttattttttttttgctttttagaagttccaaacctttaaaaattggacctttagtttttagagtttattgttttgttgggtttaatttcttataaattttagaagtcccgtcaaacgatgccactatacttctctacgactcatccgctgcctactctttattgtcattgggattctaaaaatcaaacataactatcattggaattcagtttttattttttaaagtcccaccaaccgtcggcggttttgcaactatactgctatacactccgcccgttgcttctcctttttattgtcattgagattttaaaagtcggatatgattatcaatggggtctattttttttactttctagaagtctcggcaaccgctttttatgtttgcttcacggcctacctgtcgccccaccttttaatatgtcgtatcaaccgccaccactctactcctttataggcctggtacttaatttatctcgtcatgtgttttagatggtcttttctttcaatagtctttattttttatcaccaattttagttatttataaatactattcctaactgaaatcttttttctttttctaatttcagaatttatttttttcatattttaattaataccgtatagttttcttttaatatttttattttttttacttttgaatttcagttgtttcaaaattgtattcttacatgaactctcttttaatttttctaactttggatattattttattttttatttaaaattttaattaatctcgtattgagtttcttatatggattcttctttcaatatcgcttatttttaattctgaattttagttaattttaaattgtattcttacttgaactcttcttttctttttgctaatttcggattttttttatttttattttgaatattaattaatctcgtgttgggttcctatatggattcttctatcaatataccttatttttaattccgaattttaattatttttaaattgtatttctacttggactcttcttttcttttataatttcggattttattttgtttttattctgaatttcgattaatctcgtatcgggttcttatatggactcatctttcaatttcagctatttttaaattgtatttctacttagactcttctttt

SEQ ID NO: 73270 - DNA, 3569 bp, Oryza sativa
cttaatggtcaggcataatcccaaaatagtgatgttaaagatattgctgttaaattatagaattctcttatgcaaatgcctattttctaatctgatcttatgccaagaatctttgatgttggtgttgtggtcaagtaaggggaaaaagtgtagcttgaacctcccgatctcagctatttctgacctctaaatttaggtaaaggccaactgaatgaagcaacaagtcgactacaaaattttccaggtcatttcagaaattatacattattcttagaacctttgttttatgtgaactggaactgttgaattgtacaaaatatattttgttttatggtgcctctagctaaatatggagcttaatttcctacacggagggatcactcacctccaccatatcggtacgataacattttgtagtaagatggttcatgtaatcttgtatttagatgtgcttgattttataattgtggaaagaactaatttgtagcttcaaatgcaattgcttcaggtacaacaaagcactgccattttataatctctttcgttgttcacatttcaggagttacatataagtattttcatttgagtataaaaatataataatgtgttgagatgatgattgtgtggtgactagctctgataattgataattttgtttatgctttatacaatgtgcgtttttttagcactgatcaacatgagattgttctactgaccagttaacttttttgcacgcttagtatttatgttgcattgtttatgccttggatgtaaatgcaacaatttgaaaaaaaacctatattgaaatacgtacgtaggaaatggctaccgcatttattaatgtcaaagcagatagttggagataaagaatcattttttatgacatggtttaagttatatatagctttcctcaaggatataattttaaatcatacctattgttggcaactttttgtgacaagtcgacaagcacgattgtaacacctaaatgccttgcggtgatatggagtcgccaaccacctcaatctagccaaagggccaaatcaagatgggttttgcaaaaagaaaagctaaaccggctagcggagccgatttatagatcaaaatcagcctctacgccgatttagatcgatacgaggataactacccgtctcgtgggcaaaacggaaggtttttaggacaaacctacaaagaggtgttgcactctcgcagcggcggcggacggtttacggcgcaaaccgataaagatggactaaaactagggtaaaatagaaaacatagtaaaagaactattcaagtaaattgtattcgggggttttacaatgaaccggtcttgtcccttaaataggggttggttttgccctctacaggcccttctccacgtccaactcgggatagaaaccaaaggaaacacgaaacatgcattcccgagcaaggaaacccaagacccgacgaaaacagactcggactcggaccctgacggtctgaccccccacatacctgcggtcagaccggccctactagctggtcagaccacccacacacctgtggtctgaccggccttatgaaggaaacccgtcactttccaaacaaattgtcttatcctccaactggtagtgtccaccatttgtggtggtgcttgagaggcaagttgatatctatcatcagatatcacgaagaagcaattcattgttcgaaatagacgacattgaacatggtcaaaagtgcaagttggtgggattgaatccattgggttagaatggcatgaaacttggacctcatgagaactatggacacttctggaacttcgacaacagctttggttgcccatgtactattgttcatgtatttaccatgttcatagcaattgattgaaaacaaggatcatcatttgagggtttttgtttatttattgttagatcctatggagttacaaaattatttatgcaaagttgattaattggattgttcaagattcaaatcttatggaatttattgtgtaaatttgtatgcaagaggaactggtgtccttataacaagcgcatatatattgctttaactggcaactggtgcacaggtttggttttgtggcatttgccatctttccatatgtgccaaagatatgcatcttgcccttctgttattttaatttttaggtttgtaaataaaattagttggttgggttaatgattgtgtgtaaactataggaaaaaagctacagatctttcttatcttttcattttctaaagcaatattaagcactatgttatgggcaaaagttatagcacctaaacattttagtatatatctataaaaaaaatctctaggtgcaatatgttcggtttagttcaaatattgatcacaacgtgcattgcatgtgcacgattacttgtggacttgtaaattggcagagtatttgtaatttggctcggctctgtataaatggaccgtataatatggatattgattttggctctgtgtttggactagaaatatacttggactgtaaatgtggatgggacggtatggtgtatattgtataattggtcatttggctataggtcaactcgtgtaataggactgtacatttataattgggactgtatgactggacgttgtatttgtggtgggacggtgtgacttggacagtgctttggaaatgggatttgtggtatgtatagatattccgagaatgcacgagggcagaataaatggattgcaacatgagactttgtttggatggatgcaccgtattgccaaataggagtttagggttaacgcacgataaatgaatttatcggttgttgtaggattattttgagagtgttcgtacaaacgaacgacggtagcgaagaaaggattttagggacaacgcgtagcatacaaatccaatcgtcgcggtaggaatagaatcggagataattgaattgacgcatgataaataaatacgccgatcgattgtagatagtcaagggagagtgttgggtttgaattgatggagtgattttaaataatcgctgggcgagagtttgagagagcaacaatatcgcgataggacaaaaaagttttgggtcattgatttatttagcatcgaagcacataacaaattagaccgcgaaggtaagagaaggtaaggatggaaaaagaaaggtataggaaagggtgtcctttctagagatagggtttaatcaaaatctatggcacaaattctaaacacacacaaataaacaataaatcctaacatgcaaactaggctatacctgagggaaaattagacgttgtgtgagaaggtcatatcttttgaaaatagcctattatgaattatattttgcaaatagggtttttaataaatactttactaatatatattattttgtaattaattttccgaaggcaaattccttttcaaaggttcgtataaaatagccatagctatgtttctttattaaaagggtatttatttcaatatactacccatagagggttttatccaaaacggtaacatgtatttatgtgtagctttattacaaaataattatgctgaaggggttctaatagagaagggtttt

SEQ ID NO: 73271 - DNA, 6819 bp, Oryza sativa
acacacccttttgctttgccccatagggtcctctgccggagtctagggtgttagtcaatggatcaatttaatatagcttagctgactgatattaaagccaatctccaagcatcaaagtgcctaatcccgtacgaatatatatatcatggtccagctattttatattttagttaaccagtttgttgtaaccaccaagcatattaagatacgctgatcgacatggatatatatgtaagttcccattgcagtataatttacaacaaatgctgtagtatcactgtctgaaggcgcccatatatagggtccaaattaaagatgaactcactaccttggggtccactgtcatgcagaaatagtgagatatgaacactttttaccatgtaaaccttggatttaccaatcggtggcatgttgaagctactacattttactccaacttacaaagcaatatgcgcaagtaattacggccttagatctggttgtgcagcttttgaagtttgcatgtcttattttaaagcaagtaaaaaaatgttataaccttcaatttgatcttatcttattgatgcaaattgatcccacgttatatgaaactttttctcgaaaagaagagtattgatgccaacgctgtcgtcttctatatcaaagataactttctccaaattaacggcagataattttcaacaagtgcgacatctcggcaggacttcagtaccactccttttggtttttttttagtgtgggttggtgttcttggctaagtgtgctttatgcacaagttggatgattcaatgaaatgtaaatctcaactggatttgacactgggcctgtgttagtggaaaaactgtctgatcatgactcatgagacctacagtacacacctaaaaaagaagataaatattgtttgcaagggtgatctttcaaaggaaaaaaagaaggaaaaatgaaaggatgaattgataccgaaataaccatgaaattggaccatgatatcgtcccagataataacgtcattccagccaacctctactgatcccctgcatatgcatatcgatcgattgatcgactactcaatctgtcaactatcaaataatttaaaacctgattaaaaactactagatgtgcctttcactgttgattagcaaatcaaatcgtgccaacataatcccagttgtcatgtccgtgggattcgatccatggctgggcttatgctcattttcaaatagattattgtgcgaattgtgctgtggattatctaagttgattactaaaataagttaaatattttgataaataaacgtaataaattattacttaaaacaaatggtctgaataactaacacaattgagagaaagatttatttttttaagggtggagccatacaatgagtttatttttctaagggtggagtaaataatctattttaacaatataaataatgatgaaaaaaactaagcctagtggttaagctcaacaaaccaagacagggacacactgtcgtccatggatggacgtactactgtttatacttagtaggagtatgtagtactagtacaatatgctgtgtagatttgcccatcgttctccttcacctaaccccgtgaaaccgtcacaagggtcgtacaaccaatttcacgcaagtccactgtgactagttttctatgttatcactagatccaattgacaatcctatgattaattcgagttcacttaacttatgttaaatggaaaaaaaaagcgtctcatttccattgcctctttgaaaatctatgggccatgaaccgccgaacggcaatctacttattcctaggactatgttatgtttggagagctcatgggtagctataactattcatataatcttcaattttctcaaacagtttagtttttttttttacatacttcaaatctcagtaggtacaaaatccaaaaagaaatttagtagttataagctgaaaaacccaggttctttaaatctttattagatatttcctgcaatcttcagcttcccaaaccaagccataaaaatatttgtttgtgtaattttaaccacaataattgttcaggactatgttttaggcttatagaaatagtataggccaggtgtatcataatttgtaaaagtattataatattatatttgtttaaacttttcttttttatttgaaaggacttatccaatcaaagtcaccctttgttgaaactttgaaacatccaagaccaagggaagcacaagtgttgtgttggtggagtagctccattttcacaggaatttaaatcctgatatccacaaatattacctagcacggtatcaatatgaatttagtgatgtcatatatagatttgtaatcgactttcgttgctgagtgtgtgaatgtggtgtgtgtatgcattttctatgtaataaaaaaaagcaattggaaaccatatccttttatatcagaaggggtacatgttgtcgaagaagaagaaaaagaagaaagatacatgcttttttccaaggataattaaggtgacttttgctactttccgttgtttttaagacacgttgaatttagatcatgctttgatagtggacgtgatgagtaaacgctgagggaaggcagtacggctgcaatgaagcatagtatttagtacaaccccactgctccaacaaaaacagtttaaatataattaaataacatggcacataggataaacgatgcttcgtctgtgtcaagttagttaaatgagaaattatgaggaaactctaggtcttacatgcatgagacttggtcatttatacaatattcaagactacttgaatatgtaatgtgaaatgaatggtattaaattagcatatatattgaattaaagtttgtgtatttcagagtttagtatacttgtactaattaatttctagacaggtggcgtgaagggatatgaaaactgccgcgccggtagcatatcttgcactacagcacctttaagagcatcttgaacggtctctccaaatcccactctccaaatatctacttagctaactctttatttaatttggcaagttaaattcgttgtttattccaacagcttttctattcatcatctctattctgagtctatgatagtgggacccacctgtcagcctctataccactttcttcctcgttatcctgctccccctcttccccaagccctttttttcttgcggcagtggtggccgtgcgccgcgacggtggggtggcggtctttgtgcgcgggccagcggtcttcatgcccgacgacgacggggcggtagtggccgggcgcggcaacgacggggcggcgatgcggcgacgacggggcggcggtggccgtgcgcggcgacgacggggcggcgccgccctcgctactcctcatctgactccagcgatggaggccacaggtgcgtgccttgtggagagagagggggaaacaggcgtgggtctcacagatggctagccgactttggctggccaaggttggctagcgagggaggcaatttggctagctggacttggccattcgaatagcaagtctgttggagtataattaattttagcctaaaattgctaaaatttagtttggagagtgggatagcaagactcttgagatgctctaaggccttgatcctcgcatctgcacacactagtgcggaacaactcatctgtgtcggcgagaggcttctcgttacgaactaatgattagtgatatgaaaagtcattttttcgagtcgatcaccgtcactgatgactattatctttataaggccacaacatatataagtccatcacggataaatatcattggtgatgggctcggactaaaggtctatagaaattattggtaaatgtaaatctttgtcggtgtttattccacctgttaaaggtgtcgacggtgtgacggatcgcgagttcccgacatagataaactgtccacgataaaaaaaaactgtttattaatttttaattgtactaattattaatttcaccaccttgctatcccagttgattcctctgtatattcacgcacatgcatggttcacttttgtaatatatattatatcacgtgttgtgtttaatacacagcacgtacagttactaacttgcgataagagacaaaattaaccaccaaatgattgtaattaagatactaattaagatgtgctgaactgatatggatgcccaatccggcccagtcgccatcagtgatgtacaggttgtcggttattttgattttgcaccggttcatttgtatatgttccttatagaaatatggctgtaataaagaaatgacacaacgcaaaaaatagggcacgttaaaaatctttagagacggcgattaattatgacatcgatacgatcttcaatactcatgttctatcactaatatttactacacccttcgtccccgaataccttaaagcttttaatttggatgggttaataaagaactggtgtacaaggtaaaagaatatcccccattatattaaagccctttttgtttaggtttataacccaacttataagccgaaaagtctaagcctaaacaaataagcggctttttcgtttggcttttctaaaactataagccactctaacactattaagccaaaagctaagtttgagaagcttttttttggcttatgtgaggtagatgcataactccaccattaaacttaggacattaaatctaccggcttataaatcatataagccaataagctgacttaaaagtctaagccaataaacctatgcctaatcaaagagggcctaagtaggtgcagggctactctcgttgagatagcatagaccattaagggtagaagaggaagttttgtgcaaaaattcatctctttaggttgttgtatttgtgacaaatttaaatatattttgtaacatagggaatacttatataatagaggtttttagaaaaaataaacatatatagatatttttacgacagacgtaataattaatgtcattttcatgtattggtgagttaaaatttattagatttaattatatatgctctcagcattatctgttttttttatctccactttatctgttttagtatggatcggagcaaatatgctacaagaacctttcccagagtgagttaaagctcagctcccaccttggttaaaagcaaggtcaaagaaaaatgcccacatggccacaaacacccgcatagtatatcgtaaattaaatcacgtgcttactactccttccgtcttaaaaaagacaaatcctgagtttccgtgtccaacgtttaactgtccgtcttatatgaatttttttataattagtatttttattgttgttagatgataaaacatgattaatactttatgcgtgacttgtctttttaattttttttcataattttttcaaataagacggacggtcaaacgttggacacggaaacccagggtttgtcttttttttgggacggagggagtactctctaactctcactggtctttattttttttccttaagtaatactagtgttattgctaacagcgcaaatcttatactaccttcgtctcaaaatataagaaattttattcatttaacaataacattttaaaaaaatcagagctagggattttgccaacattttttaaaaaagagcggagctaggaattctgccaacattttaaaaaagagcggagctaatgatgcgtgctaccttaatttggttgtgttagtgttgctaatgatattgaatctaatcacctgaaaacaaaaatacaattaatgtgagatatatggaactccctcggtccatatatatatatatatatatatatatatatatatatatatatatatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttaagttgttttgttgataggtataggtatgaatcgaattcttataactaggtatatactcacaatttgaaaattttgaaaaatttgagtgattttgtgcatttgaaaccatggtgtccgggcaccatggtgccccatatgaatgtcctatatatatatatatatatatatatatatatatatataaagaaattttaggttttaggttctaaatttgttctttgttcttagtttgtccataaatatatagacatttggagtattattttcccgattcatccaaacactagctgtactatcttaattaatttgtccataaatagacattatgttcttaatatatctctctatcttagcataaactatatatagagttaaatcattcatattatctattatatagcttgaacttgaatcagtcaaagattgaatcattcttaacagacaagcatatataacaaacagtcgtcccgacataagcacataattatgaattgatcgatggggatgactttgctgcaggcctcacacatcgtagcactaattaagattaagaaaatgcatgcaagtgactactactaagcacaaaaatattatatcacacgctatcggtaccatgttgtcctacttgcatatgtaactttatcttcttgatatcatgaaaaaggcattttgcgacttaccacttattatttata

SEQ ID NO: 73272 - DNA, 8261 bp, Oryza sativa
tatttattattatttactttgttagttaggtccaactccaatccctccccaactattttcagattcttattagctttgacattcttgtctagttcacctagtctacatatccaattgaactcaatttacatttcatcagacacagttattacagtatagaggtttgcttggaagatgcaccccttctgttcaaatggatcttccctttgagggtcagggaactatgatggcaaggcaaactgtttgttggagaaaccgcctacctctctcgtttattttacttcgttatgttagatcatgtatgtgccactctcgctccgcgagtcctttgtagctgttgtccacttttggtcatagccactatatttgagcgcgtaacttgggctatgcctactcatttgtccaacatcttgaatggtagactgacacattatgccttaggtgacatttctctttttttttttgcacaaaacatctcaaaagcactctctctctctctctctctctctctcgttctgcatgggatatattcgtcatttacttgcttgttgcaatctgcgtacagaatggacactctgaagaagcatctaccagtatcagtgcctgaggggttgaatgaacttcaaaagatagcagtgcgatttgaagagaaaatctatactgcagccaccagccaggtacacttagcctcttgctaactcatcgggttgatccaatctttcagttgtggggctcaagcatggcatttgggatcttagtagaagaaatcgatcgtccaatgtttgcaaatatgtctgttgattttgaagtttgttagagtttcgccgtgaagtatccacattttcttttgaaccgattgtaatatttcgcacttccacctaaatcagattatccaaggctgctgaagcttttccccttccattatcgggggaaaatctcctttgcgccttggatacagggactaagactgattcagtcctatgctagaggtgttgatgtccccacattattttcattgataacatatctcaatagtaaattagtattaatgaattatagaactaaacaatatttttaccatgagactggtttctctcattggccatgttaaaagtacaggagttgtaccttgagttctgtaagcccatcattccatctgttcatgcttgtataaatcacctgtaaaatattccctttatcccagatgaaacatcaaacaatggtttactccagtccttccttttgtgttagcgagtatgtcatcatatatcccacttcattttggtaaacatttttgtaggagcttctttggctgggtatagggattcataatctccaaattccaattgtgttctcctgttcatacttcatcaggcttattcatgccaaagtagtttgctgtatagataagaatttgtataatttaattgattgtataaaaaaacgaagcatatgtttcaattgtgctaaccaccaggacttagggtggcaagttatttattacaaagccaaatcttaccattgtattcttttgtatcaccagtctgattacttgcggaagatttctctaaaaatgctctctatggagacaaagactcaacagaatcctggaaacgcccaagtgattcaaaaccaaaatccccctggctcaggtatcatatgaagtatattcaatatccgattctgaaatactggagtaatagtaagatattcgctggtacccatattttgttcaccgtaaaagtccttgtatatatttttcatgatgtaactatattgcatgtgtgtttacaagccccatttctgagaggaaaccatccaatggaagctctgccacactgggtacaacagtgctctctcgttttagcttgtatcggataatgctcaagcaagtaaattaaggcgagatgcctgtcagtcgaaacctccaaacttgttgattactcgaacctaattaagtaattgctaatcttgatagcaaacacaccatttggatgctggccacgaatccttgcatggtcatattcaaagcttttgggcaccaacatcaaaacagacgaccccttcaatctgcttgttctagtagaggctagatcagccatggcttccaaagtagaaaagcaaagcaaggctcacaccatcacgtctgctgccagcagcccaaagaccaaagatacacatagctttctagcactcattctctctctttttaatcaaagattagtatcatagtctagcccattggcaatacacaatcacttcatcgatataacctctcgcactggatttcctctccctgacaactcggtagctctttgtttatgtatttagaaaatgggctatcaagttgtatggatttgtatgtacttgttgtccatcgttaagcttgcccaggctcaattggatccaccactggatggagttatatgtctaaaagttccctagctagtgtcagttttggtttacatatcttgtattattaacatatgctgtctagttatttgcatgtgcttcacttttttgaactgattagttgtccatgatctatacacaacctagatgtttaattgatgccatatgagtatgaaatgacacattttaaatgattgtcattttcccctgataagtgctaacacatgttatgttagttatttgcgtttgcttcttcacattatttatgctcatttttcttttgaagggggatgtctactttccataattcatgatctataatacctaaaggttcaattaatgccaatataccatgaataattgcacattatgaatcgttgcactgtttaatttattccccctgttaagtttcatgtaactttgctttatgttggagccagattacacttgtgtgactactgaggtaaaataatagttggctattttgagttattgatggaattatgtttattctccttctgctgcaacttgtcagaatttatttgcagtttccttcttagccttatcgaaaaactaattaatggttttttgtctaagctacttgctaacctcttacttgttttggtacatgtgtgttccttggaaaatgtagattctcgtctcaaatatgtctttatcatgcttatttggggtgttgttatgctttttacaattttgcaagtattgtctacaaggtatttatgcacattcacgatcttttctgcaacagtacctggactccctcaaggcagtaatccaacacagtcatcagcgatccctttgatgtctcagcaacaggcccggcagccaaattctacgtctgtccaatcttctcttactaatcttggtcagaacttgccaggtgtcaaccagacatccacactgcagaacatgtctggcatgccgcagaacactatgaataatggcttggcacaaggcgcttcacaagatatatatgctacgcaaaggcaaatggcaggaaggcagcagcagcagcaacaatctcagaaccaattaatttaccagcagcagcaaattatgatgaagcagaagttgcagcaaaattcacttatgcaacagcaatctttgttgcagccaacacagatgcaatcctcacaacagccaatgatgcaaataccatctagcctccaacccgggcagtccattccgcagacacaaccaatggtacagtcatcatctcagggtggtattcaacagaatgctttgaactcggtaccacaatctgtgcaatcgttactccagcaacctacacaatctgctatgaggcagcagcaacactcacagtcctccatgcatccacagccttctctgcagcaagctcaaccaactcagcagcctaacattcctttgcaacatcaattaatgggccagcagcaaaatttacaacaaaatcagttaattggtcagcagaatggtgctgtggatatgccacagcaacagagactaccagttcaatcgaataatcttttgaatatgcagcagacacagcagatgttgaaccagcagtctatgccctcgcaccagcagcaacaattgggctcccaggcaaatatttcaactctacaacagcagcagcaacaaaatcagcagcaacaacagcttcttggaactgtgcctaatgttccgaacattcaacgaatgcatatgctacaaacaaaggcagttcagcaaccacagcagcagcagcatgctcagcagtcatcactgggtttgatgcagcctcaatcacaacataaccaacttcagcaatcacagcagcatcttatgtcacaattccaagctcaacctaaccagctgcagcaacaactgggaatgccgcagcaacctcccatgcaacaaaggcttcaaacgtcagctggcatgctcttgcaacaaaataacattgatcaacaaaagcaatttatgcaggcacaaaggggccttcaagaagtttcgtctagcagtaagttctccatatgctgtctatatagttgcatttattcttttattgtttccccctgttttttcgctgtgttattgttcctttatccctctgttttatccctattcatactgacattagttttctcctacatttatgccagcttacaaatcctaaatttcattagttaacttaataaattggagatagtaaggataacatttgtcagttagagtctattgcaatgtacattgataacatgctgacgaagctgaccctaatgattttgtgccttctgttcaaatttgttttttctgagttgtggacatatttgccacaaaaggctattttcagattactgtttcaatctgacctcaagttcactgttgtatttttctagtaggaatcacacaaggtctcccacttctgtattacatcctatgttgtagtagcagcttgctacttgattgcttgttcattgacatgatgtttgatttccttgcttttcatgcagcatctgtggactccactgcccaaacaggtcatacaggtacaggtacaggagattggcaagaggaggcatatcaaatggtaatgcataccactaccgtttggcgctcgtttgttcacttggaccttcctaaagaaattcagagaaaaggacctctgaacattgtatttgatgtttagaataagatttggtcaaacttctaaaatactgaccataaataatttctcaaatgcttagtcttaaacaaaataaatggtataggtaaatttgcttcaaaaagtactatcataaaatcatatacttataaacttattctaatataaaattgatagtcgaaatctaaaaggtctgaccgaatcttgttgtgacatcaaatatttgaccggagagagtaatattctcccgctatcctttttcattgttgttttgatctgttttccaccaactaaacaataaacagttcccaattgattgcatgtccttttttctctcgagacatctggaacgaattcgacactgcatttttttttcagatctgtacaattttatgtgtaactcattttgttcttaatcttttaaccattgaagtatggtgaaatcaataattggacatgtgtagccaaagaaacaagaatgttatcttttactgataaaggtggaactgatattcatacaactatgcacatgcatgctttctttaagatagaggattctttgtgaatgtggactgtatagcatattgtatctagatgtgataaggttatgatgcagtttgtaatccctttctcttgaccttgcaagttcaatcaacaccatgttttctactggttattatagttttttctttaagttccctatgcatgtaataactattcgaacaatctttgcctgcaccatatctgttagttaaacaacaggccttggtttactgaatgatttcttttctgtagtatccatcccttcatagcttttgtgtttttctttcttgtgatcacaggtgaagaacttaaaggaccaatattttcctgaattaaatgatttgtacaataagatctctttgaagctacagcatgttgacaacatggttccacctcaaaagccaacagaacagtatgaaaagatgaagaatttcaaactgatgttggagcgtacaatgcatgttctgcaattgaacaagggcaacattcagcctgcccttagggacaaaattcctgcgtacgagaggcaaattatcagtatcctaaattcgcaaaagaggccaagggtgcaaggccagcagacacaatttcaacaatctgctgggcaaggtcctacctctaacattccgcaacaacaacaaccttcccaaggtttgcagcagcatgataaccatactaatcagatgcctcaagcaagcatgccaagtatgagcaccggattacaatcctcaggtgcagctggtatccaacatttacctgcatccccagcaacaaactttggtgttccagcaacacagcaaaatgtcacaaatgcaccacaggctacctctaatttggaggttactcaaggaagcaattttaattctttgcagcatggttcaatgagtggtgctttgcaacagggaagcactgggcccatgcagggtacactgaatgcacaacagcaggccagtagtagcatgttatctcacaactcagtaggtacaatgcaggctaatgccaattccatgcaagccaacgcaaattcattacagcagctgaagcagcaacagcaggagcatcatatgatgcagaatcagcaaatgaagcgtcaaatgtttcagcagttccagcaaaaacaaatgcttcagcagcaactcccagcacagcaacaattacagaaacagcagcaatcacagatgcaggttccacagcatcattctggaaatgatgcaaacgagctgaaggttagacaaggagctgcaatgaaacctgggatttatcaacagcacttggctcagcgcaataacttttataatcagcaaatgaaacagggcagtgctttcccaatttcgtcaccacaaaacctccaagcatcatccccccaaatttcacaccattctcctcaggttgatcagcacaatctcttgccgtctcaagtgaagaccgggacaccattgcagtcagctaactcaccatatatgccatctccatcgccacctgttgccccgtctcctataccagtggattcagagaaaccactctccaatttatcatcatcacttactaatactggtcaggctacacatcagcaaacaaacatggcgcctcagtcacaatcaatcgccgttaacactccagggatctcggcctcacccttgttggcagaatttacaagtgttgatggaaatcaggctaacatgccaacccaagttctaaccaaatcaagtgcagcagaaaggcctttagaccgcttacttaaagcggtcagtaactttgccaactttttatttactgtcttttcttcgtttctgtagtgcaaaataaatttattatttaatcagtgctattctgagtatattttaaagcgtaattaactatggcataaagaacacagtaggctcagctaaaatatttagttcaggagttatatatgccatgccttttgcttgtaacctcgtgcacctaccttgctaaagttaatacaaacattaccctgtttcaatcaactagtttatcaaacgataactaaaatgatgcccaaaggttgcagcagatctcagataagtatatcgtaaattctgaacttgataattatgtcaaaaagggatactatgctaaaatcccagtcacatgcacatatgcgtgtgctaagggattatgcaaataacacacatgttagatctgtacacaaatattttgaagtcaaggggatgcaaagcatgggagtcatcatgcctggtcatttcatgttactgcttatttaaagttgactctttgagtcttgacatctgaagaacttgataggtttagcattgacctattttatttatttctcttcactattgctctgtggaatctagctatgttttccggatagcctgttttgctgctgtgctaaaagagaagaaatcattaataccttttattcccctcaaattagcttccttaaacaaattttgatcatatagaaggcatataccctccctttagattgaaattgaggatttaccttcctgtccctttttttttcttgcatgattcatgtcccttgtgttctgtatggcagttgcggacaacacaacgccagtccttgagtgctgcagtaagcgacataggttctgttgtcagcatgattgacaggattgctgggtctgcgcctggtaatggttctagagct

SEQ ID NO: 73273 - DNA, 4973 bp, Oryza sativa
catttcatgttactgcttatttaaagttgactctttgagtcttgacatctgaagaacttgataggtttagcattgacctattttatttatttctcttcactattgctctgtggaatctagctatgttttccggatagcctgttttgctgctgtgctaaaagagaagaaatcattaataccttttattcccctcaaattagcttccttaaacaaattttgatcatatagaaggcatataccctccctttagattgaaattgaggatttaccttcctgtccctttttttttcttgcatgattcatgtcccttgtgttctgtatggcagttgcggacaacacaacgccagtccttgagtgctgcagtaagcgacataggttctgttgtcagcatgattgacaggattgctgggtctgcgcctggtaatggttctagagctgctgttggtgaagatttagttgctatgacaaagtgccgattgcaagccaggaatttcataacacatgatgggaccggtacatcaaagaaaatgaagcgtgacactagtgctatgcctcttaatgtgtcatcagctggaagtgttaatgacagtttgaagcaaacattcagcataggtacccctgaattgcagtcaactgcaacctcacgtgtaaagtggcaaaaaaccgaggtatgctctttattatttcatagggatcaatacattatatgcctcagtgatcagcttcacaatcgtttgtatagatgaaacttagtggcatgatgaataaactaaaatatcatgattatccagctgttttgtttccacaatgacttccattacatatatgggcccagagaagggaagtatagttaaattgacgggagctattctaaatttttggctacctttattatttatcttgtctctggtgcacctgcagataaaccatgctcttatggaggaaatacatgagataaaccaacagctcatagatacagagctccatgtttgcgaggatgatgctgagtcttttggtgctacatcagaagggacagaagggacagtcatcaaatgcacatttactgctgtggctgttagccccagcttgaagtccatgtttgcatcagcacagatggtaagcttctcaaagcatgatctgtggtatcggcttttattgttcgctgatgttccatgttaaaaatgtgtggcagagtccaattttgccattgagggtgcttgtccccgctagctaccctaagtgctccccggttctcctagacaagttcccagatgaacaaaggtcagtatccaatgttttatcagattctacgccaggtactacatattaggctgtcctgattctctgtacataaataaactaaggatgttgcattgtgcttgtgaatctgctatagaaactcggatgacctgtcgaccaaagcgaggtcgaagttcagcatattgcttcggggtttagctgagcccatgtcactaagagaaattgcgaggacgtgggacgcgtgtgcccgcaaagtaattgctgagtatgctcaacagactggtggaggcagtttcagttcgagctatggttgttgggaaaattgcgtgggtgcttaatccccattcttcttcagtcctgctggcaccaatcttcgttttgcatcgatattgtgcgatcgcttgcacgcccttaactggaacggttaatgcatcgctctataaatatatgcacataaatatatgtaaccataattaacattttagcaaacatgcaattgctactggtgtgtacttatttattatgtgtggttgtacttttggaaatcctccctgtttactagctggatttggtagcggcccctcttgtacagaacagtctacatctccagcctggtttgattctaatataaatatactgtgagatcgctgctcgtaatatatgttgtgtattgacaacagttgaaggacgtgtgattttctgagatgtgctgagaccagtttcgtcggacgttttctcttttcttgtgtgttcttttcatatgcggaatggcggtaatcaatgagcatgtacagaatataagaagatcaagctagggaagtatttgacatttttagcttggttgctaagggtgtgtttagttcccgctaaaattgaaagtttaattgaaattggaacgatgtgacggaaaagttggaagttttatgtgtgtaggaaagttttggttcgatggaaaagttagaagtttaaagaaaaagttgggaactaaaccagacctaagtatgatcgcgagagcaagtgacattcacttggttcagttacggaaaattttatccaatttgggacttgtaattcagattgtgtttctgcctgcaaggagtgccagcgctcattatgttatagcacacggtgacgttacaacaggtaatcgtttgatcaggtacagtacagtacagagagggcgtgttaacaggtccagtactggttgcataaaacatataatggtaacaatagtatatatgtaggtctagatggggatacaataatggtaacaatactagaggtggagaagaagcatttccttggctacgaaatgtgatgacatgatggatcttggatttgatgttgggtacaacaggcacctgcgactgagagatgagaaggaacaacatgtaaacgcacagtaatatgtactgtaagcatgatacttgtacgctaaattaattaagctgagatgacagatacaagaaaatgagctaagtactctaggagacatgtatggtagtaacaaggcaaaccagctgctattagttgttaagcttagcttggccggagaaaactgcatatatgtagtgtaggtcctagcaattgcactgcgattgtgcggaggtgtagtacgtagtagtagggtagagagttgatggagtaatttttattaattggcacacagtaattcagtaatcgttggatcgagtagctatagtaatactagaaattgaatggatcgattcattcgatgtgaagtaagatacttactggggaggggaggggaggggaggggagaggagaggagaggagaggaggtcaggcgaggtcttggtcgtcgaagtcgtcggggaaggaattgaagaagtcggcatcgatgggaagggaggaggagggcgggtggcggtcgtcggcgtcgacctccatcatgcccatgcccacggcggaggcggcctccgactccatctcccccggtgagtcctcccactcgttcacgccgcccggcgagctcatctcgatgactcgattaatccaaccacttttggaatcttggattggatgattggatttccgatccccaatctcctcctcctcgctttgcctcctccacttcaacaacgacttgtagttgtaggtagggagggagggtacaccacagcagaggccaccagccggcgtcggcatccaactccaaatgcttttcttcctttctggcctttgtgtgtccaatattaattgctagtggactcgactagacgtgaggcccatttgttggcaagtttcttcccttgtctctctcttgtgagacgaatcttttaaacctaattgctacatgatctgataatatggtgctatatttaatatttactaatgacagattaattagacttaataaatttatctcatggtttactgatggattctataattagtttttttattagtgtccgaacaccccatacgacacgctatataatattcgctgcgacacgccaaaactttatgactctggatttgaacaccacctaagttgcctcttactcctagtattaatatccaaaatactgtatcaaacacaccaaataagcaagtggatggtggtggtggtggggcatcggagacatacagtacacgtgcatttccccaaggagaaaaggagggcagagatggagtgagtggctttgacttacgacgatatagcactagcagtactcgtactcctaaatttgtgttggtttgttggactatctatgtgtgtagtgcatgtgcgcgtgcaagccgcatttttgaaaggaattaatgtgtttttctataaaaagaaaaggagaaaagaaagaatgaagttgctttaattgatgaagttgtcttgtggggtagcagcactttgaagtggtcgctgttcccattggtgtatgtcggtcggagcggaagacaatgcttgatggccatgtgacagtagagtatataagatgccagtcgtaagatgttactactcgtacgtagacacacggagtatggcaagcaatgcaaaaatgtccattggttagcaagactagtgctagtgtagtatagtctgtggaggagtattgacacccctttattatttgcattgcactactcacactcagcaagcattgtctttcacttgagtagtactaggagtggtgctcacttgcacactatttcactccactgctccagtccacagtccagtgtgttcacctgctctaccccaagcccaagggaattgaagcaagcagatgagatgagatctgtgatgatgtgctgcctcctcctcctcctggtctctgccgctgccggggccgaaggcaagtcggaggtggcgctcctcctggagcgcgtgaagccggcgctgcagggggagggcgaagtaggagggaacgcgcagctggccacctggaccgcctccaccccgctctgccagtggcgcggcctccgctggtccaccgccgccaccctcccccgcgagctcccctgcggcaacctctctgcaggcctcgcccaccacccggtcccggacgacctcctcctcctcctctccatccgcctcccggcctccgccctcgccggccacctccctcccgaactcgccgctttctccgccctcgcctccatcttcctcgcccacaactccctctccgggcccatccccctcgccctcgcaacgcccccgccctctccctcctcgacctcgcctccaaccgcct

SEQ ID NO: 73274 - DNA, 13575 bp, Oryza sativa
cccctctttttcccctccccctcctcctctctgctgtagagagcttctttgtacaagcataacggtggtgaagcagagtagcagaccctcgaaaatggatctagaggcctaggccctcctcactgctagacctgccctgagtgcacgttggctacaagctggtcttgtagcctcctccttcatctcatgcttgtgaggtatggcaacacccacaagatctagctcccatgataaaaggaggcaactagcaagtagggaggccgttggaaaggatgctgactagcgtgggctccttggcctcctgcttctaggcgctttgtcaatggtggaggagggacgcgatcaatgaagcttctagatttagagctcatcgccggagtgtgtgcatgtatgtcatgcgatgtatcatccgcaactagtacctgtaggtaccatatctggtacctatggtatcaagggtgatacctaggtatcagacccagtacatgtagataccatgtttagtacgcatggtgtcatgggtggtacctataggttttagacctggtatttgcgaggtatcaagtatcatgcaccgcgcgcctcctctcctcttcttctttcccctcggctcgaccctgtcccctactactggcgcgaccaacgtcactgcctatgtttccacaagcgttggttcaagactcggcgacgcgaacatctcgagtaggggcgggatgactctagacttacgaggagaaagcaagcatgtgggatgacatcatcctctataaagtgtcttgttcgaatggtatctcgtcctctagcagctctctattatatttaagagaatctattatataccactgagtttgttcaagttcaacgatttgccatcgacattgtctctctctacaatataccgacgactttatcaattattctatattacactattgggctgaaccttcctttcaaaaatacccaaaatacccttagacattcaaggttaacatccttacataacacgaaaatttgtatagaagttttaagttttctttgcattcctatttttttagaagaaatataacttatatgttatatgctatataaaatatttttatcattgtttttaatataaacaatctttcataccctacatacgatatttttgtgctattatatattgtataagcaaattctctttcatataccacacaaatatatatttttataaaaccaaaatataccagaaaaaaattgaaacttgtatacaaacttccatgcatgttgtgtaaggaggccacacaatttttttatatttttttgaaacttataatgaaataaatcaattcttaatcttatatgtcactaagggtattttgggtaattttgaaaagaaggcccagaccaatggcgtattgtagaacaattaataaagtcaccgatatattatagaaagagacattgtcgatggcaaattgttgaactcaaacaaactcagtggtatagaatagattctctcattatattttgggtaaatttcataaaacccctcattttaggtcaatgtttaagaaaaaacataagtattatatatgacttttggcatataactatttataggttttatgatctaaatgttttattaatccccacctttatttgaattttcaattgattttagcatatctgaaatatttttttttgaaagtagtgaagagttaaacgaacaaccttaatcaagaaatcaacaactaaagatttcatatacattctctgttctgaaatttttaagtaaagatttgtcaaatatgtatagaggtggggttttgtgaaactttaaaaccataattgttagggttatatgccactagtcataatgccttagggtttgctaaattttgctcttatattttacaagaatggcattagagggtttgtttggcagcaaggttgctgcagccagctgcttccgcagttgtgtgaaataatgttggcgttggcggcaaccctgcaaccaagcagctgaacagatgcagaatgactggcatcgattttgcggcaggtttgtaatagcttatttataaaacggtttcatatttacagtgttgccctaaagtttggcacttttgccgtgggatcaaccatctcaaatttgaggaatcagagtaatttcccaaccgttggtcttgcgttgagattcgtgctccggtggatgttgacggaggcaaaggcagccccaaaacgggatcgtagatatataaaggcgtcaagcgagcgcacaccccttgggggcttgggcagcgcgcgcgcaaaaccgagttcgccgcccacctcgccgccatggccatggagctcgccgcgctctgcaccgaccccgtcgtgctctccgccgccttcctctgcctcctcctccacctctccctccgctcctaccgcccgccctcccccggcggcggccgccgcctcccggcgggacccccgggcctccccgtcctcggcgcgctgccactcgtcggcccggccccgcacgccggcctggcgtcgctggcgcgcaagtacgggcccgtcatgtacctcaagatgggcacctgcggcgtggtggtggcgtcgtcgccgtgcgcggcgaggtcgttcctgaaggcgctcgacgcccggttcgcgaaccggccggcggtggcgagcgccgtggacatcacgtacaactaccagaacatggtgttcgccaactacggcgccaggtggaagctgatgcggaagctggcgagcgtccacctgctcggcgcccgcgcgctcgccgactgggcggcggtgcgccgcgacgaggcccgccggctgctgcgcggcgtggcggaggcgtccgccgccggccgccccgtcgtcatcccggaggtgctcgtctgcgcgctcgccaacatcgtcggccagatcaccgtcagcaagcgggtgttcgacgtgcagggcgacgagtccaacaggtgagctcgccgccgcgccggtggtgccattactatctagcttaattagctaattatttcctatctccactatagtagtagtatagtttcatcttcgttttcgatctttttattctttttgaaaaaaggaagaaaatgaaatggtgtgcaaatccaatgcatatgaaccttttttgtaaaaagaaattggaactatgaatgcaatttaagttgtggtggaatagagccgaccactagtgtgtagttatcatgggataggtaggagagcatgcgtgcgcaagtcagcactagcaatgagtcacacgtcaacaatcatcgatcacctataaaagaattaccgaaagcgagacaaaatccactaacctttgttattcgtaatattagtagacatcagcatcatctaaatgcataaataaatacaaaaatatatactccgaaatatagctatttcttgtacaataccttatctcgaaatatacgtacctaatcctctcaaccattcaccaccattctacttcatctattttctcttttcaatcaatcatacaatttctctaattattctcacatactttttttaatacatatgccattttttacaatgtcgatatcttagaacgagaacggagtaagtactgattaatgcatcgatcgatgtgcacgcgcatgttgatcgggtcgatgacatggaaaatttgcagctataaggatatgatcgtctcgctgttgacgggtgcggggctgttcaacatcagcgacttcgtgccggcgctggcgtggctggacctgcagggagtccaggccaagttgcggcggatccacgaccagttcgacgtcctcatcaccaagctgctcgccgaccacgccgccaccgccgacgaccgcgcccgcgccgggcgcaccgacttcgtcgacaggctccgcgccgccgtcggcgtcgacgacgaggacggcgagaccatctccgaggtcaacatcaagggcctcatcttcgtaagtccttagttacctcaccttgtaatgattaattaactgcattatattgttaccactaattctgttttataagttatttttttattataagtcgttttgatttttttattaaactttttaggtttcactaagtgtatagataaataaaagtgcactacctacctaaattagttttaccattgaatgtatattgataatatatttgttttgtgtttgaaatagtgttatattttttataaacttggttaaaattttaaaaatttgactagggaaaaattaaaatgatttataatataaaacaaagaatagtggaataatttttagcgtgctgcatacgtatgcgtgacataggcgccacgtaacagtgaaaaccgtacacgtgtcagttctgctcttttccctttcttgggtggaaggtgccttgcaatggtgtttgtttgtgggggcagcacattgagctatggatggtacttgatttcattcattgcagtggagttgttggaaagggatactatatcataagcacttgaaatgcacatgccaacctaactgaatgttttttcccaagggaatatatatctcccatgataagtgtcctctagtatctttcagaaaaataatatatgtccttgcagggtacctacacttgatcaatagtaattattagggatccaccgaattttctatgcttcactaaccgcaaagaaacttgtttgtttcctactaattgtagaaaaacataaacttattttcatcctaaattataataataaatttaaaatgttgtaaataactatatatatatatatattctcaatggagagatatgaatttactacctccatttcatattataaatcgctttagctttttctctaataaaaattctttaaatttaaccaagtttatataaaaatatattaatatttttaacacaaaacaaatataatatcaaaatatatgttagttttaatgaaaataatttagtgttgtaggtgttactaaattgttctatgaacttgatcaaacttaaagaagtctgactaaaaaaatcaaaacgacttataatataaggagtagatgtttccttttgagggaaatgataggggctctgtagttcgctatattcatttatatgttaatttggagcaagcatcccctgaaaaagcttgaaaactgtaccaccacaaaaaggaattttggtgttttacaacttgagccaaaatattaaatacgtaagttgcttgacaaaaaacctaccggagttgttataacatcctaccagatcgttacatttggtcgtttgtgctctgaaaaacaacaaaaggaaaaaaaaatcaactataatcaggattgaattgtactatggctagctagctagaaccatatggaccgatctttttagcttccatcagtttctgaaaaccacgtacacttctgaattcaattaatctcggcgatatatgatatgatctgcctccactccacacccacctaaccacttcagaaaactgcatgagtgagtgagagtgatgcttcaaccgcaatattcttctacctatatatctatcgctccaacacgcgattgattaattaaccacttaattagctcgataattaagctggctagccttcagggttagtggcaggtacttgtgagtcagcagtgtcaacacgaagtaacacgcaatctgtagtacattgtccatatggcagcatcattattggtgccacaatgacttgatgcttcaacttaacttcacttaaactaacggattagcggcaccagccgggactgatgatgaagggtaatcaacatctctgcttgacattgcaaccaaattaattgcagctagctagctactcctacccccgatgcagctatctgaagttcctctttagcttaggcaataatgttcagattagtataagcctaaacagactaatcaaaatgcatgtgcatgcagtggtagagtacttgttatgcttatgcttacacattctgcttattagcagctgaaaataatttgtagataaattttttatatatgtatgtctttagcaattgaaaataaatattagcttataagtataagcataaatgaaatggtgagactatcgtgctctcaattagatgattgaagtatatacgtacatacgagtgttagttgcaaccaaatgtttcccgctactcgtgataaaatggatgccttaattgggtacagaaactattgatgacttgtcgataactaccgtaccttggccagtatatatttcctgattgtacgactgcgacatgtagacgtactgacgagacgaactgaacctaccagtctaccacactgtactgtacaagagtcaaattaagatgactgaagcaactcataacaatgatctgcagccgtcactagcttaactaccattaaaagtttagatatagatgacagctgataatatggatggctaattatcatgctgccaagttacatctatatcgatttcacttgccttccaagttccaacgcactgctgtttcccactggaatctatcgatttcactttcatttcaacgcactgctatttttccaatgaagaaaaaaaattgtcggtataggagatcaccgttttcaaatttcttgaccatacttgaaagcaactcatcgttaaatatatatatttgaataaattgtgggcttgatatcaacaggacaacaagtatattaattagttaagttagtcctttttgggttggcgagaagtccacctacggcacacttgatcgatctctccaagtagtgccccatcatcggttggtgcagtgtggctaccccttgctttgcttctcttaaaatgatggacacatacatatctcagtagctagcactttctctgtgcagtaataataaaaacaatttaatcattatgaaaaatagcactgcctcaaattagtgatgttttgggcatcaagtttatatcttcttttcttatgtgattggccatgcatctgtctgaagacacaggaataattcatactaaaactaaaattccccttcaaactgtggtgaacttttcatcatgaccaacaagtgcaaaattgtatgaatgattattaagactgtattttcgttaagcagtttgatctaagtgacatctttccattacgttgactatttcttttactatttatcaatcaccttaattttgcacttcttccgtttcatattataaatagtttaattttttattagtcaaatttcttgaattttgaccaattttatagaataatatactaatatttttaatacaaaacaaatatattatcaaaatatatttaattttaaattcaataaaactaataaggtgtagaagatgttgctattttcttctgtaaatttagtcaaacctaaagaactttaactaataaaaaaataaacaacttataatatgaaacgaaaggagtaacttttttatcgtgttcgactacctccgtcctgaaaaaaaaagtcttcttgactacttcctctgtttctaaatatttgacgacgttgattttttttaaatatgtttgaccgtttgtcttattcaaaaaatttaactaattattaattgttttcctatcatttgattcattgttaaatatacttatatgtatacatatagttttacatgtttcacaaaaaaaatttaataagacaaacggttaaatatgtgctaaaagtcaacggtgttaaatatttagaaatggagggagtataaaaaaaatgtagtacaattttcacgcatgttaatttgatgtatgcatgtatgtacgcaggacatgttcacggccgggacggacacgtcgtcgatcatcgtggagtgggcgatggcggagatgatgaagaacccggcggtgatggcgcgggcgcaggaggagatggaccgcgtcgtcggccgcggccgccgcctggaggagtccgacatcgccagcctcccctacctccaggccgtctgcaaggaggccatgcggctccacccctccacgccgctcagcctcccgcacttctccttcgacgagtgcgacgtcgacggctaccgcatcccggcgaacacgcggctgctcatcaacatctacgccatcggccgcgacccgtcggcgtgggaggacccgctggagttcaggccggagcggttcatgccggggggcgccgccgagcgcgtggacccgctcggcaactacttcgagctcatccccttcggcgccggcaggaggatctgcgccgggaagctcgccggcatggtgttcgtccagtacttcctcggcacgctgctgcactcgttcgactggcggctccccgacggcgaggacaaggtggacatgtcggagacgttcggcctcgcgctgcccaaggccgtcccgctccgcgccctcgtcacgccgcgcctcgcgccggccgcctacgcgtgacggccggccggcgacgacgaggacgacgccgtgtatgtgatcgatcgagttcgccgcggcggcggcggcggcggcgatctgatgttgcggttgtctgtacgtaaatatatttttcgtttgttggtttcgaaagcaaaacacaattaagaacgcccaaatattgcaagcaaatacgcctgtgaattgatttcttctatgatctgtttcatcgatcctagctaacgtgttttatcgaggcaagttaattagaacgaattgacggattgtaattgttggggttaacttaggacaacgtacgttgataatggtaggaggacaaatgtcatccaactttgaaaaatgaaaatcgagtttcaagaaataaagtttattgagtaaatttcagaaaattgtacttttattgactaaattatcattttgctgcaatctttgcatcacatttcagaaaaactgcaaaagtagcgttggaaattatcacatagctgcaattccgtcggataccccgttaatgacattctgggcccacgtgtcatacatatatatgcttgagagaggaagaaacggagggccatgtcagcatgccacctcatgtttttactgcagcaatgccacatcagtgcatgcttgggcgggaaaaatacgtacgtagtccggctgcaccactttggcttgttcaggggcacaggccgacaggtccatcaaaatacacctttaaagtccacatttccttggctatcctaccaagttgccaagaaagagtgatatttgcatttgaacacagcaggaatacgatcgtcaacaaatcacatccctaaccctagaaaaatcaccctccaataaacccgagaaatacaccaatcggacaacaaagaaccattatccaggtgcaaaattactcaaaatctaagttattccctcgatttcgacaacttcagctcctacctgtactaacatcattgtactccactcaaaatatgtgacaaaacgagattcatattgaatatattgaaacattttattaatttaaaagtaatttattacatgttagaaagtaccttccatgttatcaggaagtaactattacatcttatacatggttaattatcattagttattgcatcaatgttatttacaatccatcaaaggttttatcttcttttctcattttacatgaaaaacaaaaatgaaaggaaaaaaacaatcggtgattaaacagatttatagagttaattccgaaccatgcaaaagttagttccaattaacattgaagttacttttaaaaactgttaaacttacgtgtgttgatttatactgattaaataaagttttctagataaagtcatatttttatccctacaacgaatttacttctaatgtcgtgacaaagttactttcgttttattttaagttacttttataatatatgtaaataacttttaaaatttattggatttacttttatatgtctaagaagtaatttagtcgaatctaaaagtaacttatatatatatgataaaagtaacttacatatatgataaaagtcatttgcaaatataaatattttttcatcataatataatcaagtatgatcttgttgtgaagatttaattgttgtgaacacaatggtgtaatcggataagtaatttgagagaaaactttatatttaaagaggaagaagacatacatgtctattaaaaaaatgcatgcatgtagtagacttctccacgtgcatgagacggttcggatgtcgctcgttaaggcaaaagcgagatgcctcttcaaatagattttaccaaagaagcctccacgtttgctctcatggcctaaaaattcctacgttaatcggagaaaaggaaaagtagagtctatataggaatacaatttaaaaatagctgaaatacagaattaaaaataaggaatatggaaagaggagactagggtccatacaagtatataatgtagaattaattaaaattcggaattaaaaaatatgaaaaactaaaagtataaggtagagtccatatagaaatataatttagaaataactaaaattcaaaatgaaaaaaagtaagattgggagaaaagtctagagtccatatataaatacaatttataaatatctgaaattcaaaattttttaaaaaaaatattagaaaaaaaagtctagagtccatataggaatacaatttataaataacttaaattcaaaatcaaagaaatacaaaatattgaaaaataaatttagagtccatataaaaataaaattagaaataacagattgggaattagaaaagtagaaatattggaagaaaagtatattgtccataaaggaatttagaactagctgaaagtcggatctaaaaaataagaaaattaaaagtagagtttagactccatatagaaatacaatttataattaaaaaaattgaaaattgaaaaaataaacaagattgggagaagagtttagcgtccatataggaatacaatttataaataactgaaattcgaaattaacaaataagtaatattgggaaaaaaattctagagtccatataggaatacaatttataaataactagagtaaaatttttaaaataagaaatattggaaaaaaatgtcaagagtcaatataggaatacaatttaccaataattcaaattcaaaatttaaaaaataagaaatattgaaagaagagtttagactccatatagaaatacaatttataaacaactaaaattcagagttaacagaaatgaatattggaagagtagtctagaatccatataagaataaaatttatgaataaaggaaacatgaaatttaaaaaataaggaatatagaaagatgagtcttgagtccatatacaaatacaatttataaataactataatatacaatacaataaaaatatcacacatttgttaattagttcaaccaagaatttaaaattatgttgccattttaatatattttaataataaaatgtaaaaatatttaagctattatatgagaaaatataacaatgctagccgcacaatctacgcggatcaccatgctagttatcttaaaatatatatatatatatatatatatatatatatatatatatatatatatatatatatatatatatatatatatatatatccgtgtcgtgtccctagcttcaactttgggtgtgccttgccaaccagcacgcatatcgaaagggaagcatatagtagtagcatgtgggctacgactgtattcgttggtgagagtttggatgtaaactctccgtacggaaaatagagtggtctcattatgcaccgtggatttataattcctaaacctcttagctatttttttaaaaaaaatggatcaatatgattttttaagcaacttttgtatataaactttttacaacaaacgcaccgtttagcggtttgaaaaacgtgcacgcggaaaaagagaggggtgagttgggaaagggggattcggaacacacccctaagtacatatatacggagagaattaatgccaaagtcacatgcaaattaatttcagtacactataaattaattaatacttctaaaattatttcacccggacacaactaaggtaaggaagaacaagaaaactctactcctcattaataatattgggtgcttggcaatgccatgcatgagcttttgaggttgttttcgaatgattaatccacctttgggtctaaaatattgttgttttcgaaggattaatccacctttgggtctaaaataaaagagtaaactgcatcttgggctactttttattatctatgttgcaatttggacccgggtaaataaaacttttcattttggaccgggtatctttacacaaggttttaatttggactctcttcttctgtacaagatgtagcactagcggaggtcgagcatgagcttgagcgtggctgtctgctacttggcttagttcttatcgtcagttcagtaagtagcaacagttgtctatcattgccagtcagcttcttcatatgctagttgctactagtaagaatacttgttgtgcaccctctgttgtccttgaaattaagccacaagcactagctagtcgatgattggaaatgcaaactaccctttgaattctttggaagactttacagactaaagggaagaaaggaggaagagaattggaggaagaagacgggagtccaaattgaaacatcatgtaaagatatctggtccaaagtgaaaagtttggctttagcctagtccaaattgtagcaatgataatcaaatttggctcaaggtgcaattcactcaaaataaaatcaaatacatgtattagatagtttgaagcaaatctcgacaaaaaagtcaaaaaatttaagcaaatctctctcaaatatttttttttcaacaaaacctaattgattggacgcgcaaagccatcttaggactagggttaaagtatagcacgcccgcccagctagtcctagtatatgggacaagaattttctacacctaggtgccatggcacccaacattcgtatgcgacttaaatagttataaaaaaattaaaaaatatatagtaacatctgacggagcgtggggctcctcaccgggagaccgcgcaggcccccctttgccggttcggccggggactcagggtgagattctaagctctctgtatgtggaaggttcgcgagacaggaagcacacaaaacgccggcgatgtatacaggttcgggccgctgagaagcgtaataccctactcctgtgttttgggagatctgtatatgaaggagctacaaagtatcagtcagcctctcccttcttctgggtttctaatctccaaaagtcccctccctaagtgggcaaggtcctccttttatatcttaaggggataccacatgcaccatttctccctttttttttgtggggacttcccccaccttttcataaatggatggagatttgtatcgttgccgtccgagtcaccttctgatgggacggcccacaactacctccactttcgccgggagcagatgcgacgtggaatcgtggccgccagctgacgacatgaccggagtcagaccagtcacgtcggtcattcttgtccaccacatgtcagctttagcaatctacatgttcgcccttcttcacacaacatcttgcttgtaacggttaggataaa

SEQ ID NO: 73275 - DNA, 5597 bp, Oryza sativa
ccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacgcgctcgtccaaaccgcaataaatgtggctaggtgagcgccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgcctcccgagggtgccaggccacgtgggcgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccagagggcggtgtgaggcagctgcgatgggctcgagctggcctcgggggcggagacgagctcgggagctggggtccactccaccacaaagtcggcgagggcctggctcttgatcgcgtggcttggttcaaagcgcaaatcgaattcagagagttcgattgcccatttcaccacccgtccagtaccctctcgattatgcaagatttggccgagggggtaagacgtaaccaccgtgacccgatgcgcctggaaataatggcgcaacttcctcgaagttatcaggatagcgtaaagcatcttctgggcctgagggtatcgggtctcagcgtcccggagggcctcgctaacgaagtagacgggccgctgcacctttcggcggggccgatcttcttcgtcaggggccacatctccagggcgctctcctatccgagaggccacgcggggcgtactcggcttctgtgccgacgacctcggggtcagagggcgacaggcgcggcctcccgcagtggcctcggggccatcctgggggtcgggggcgcctggcaccgtcggacaagcaggcggagggccagctccggccgtcgggggcgttgggccgccgttcggctcgggggcctctcctccctgctctctctctcttcgggcagaatcccggcggtcgcaaatcgcgcgcatcagcaagggaaaaccgaccgacaataatgagcggcccctcggctcgcgtttgccttcaactccgacgaggagtgcggtgacgacggtgcagacgacagcgacggcaaggccggctacccgggcgcgtcggagtgagcccccaggcctccgccaatcttaatagcttttccttcttcttccgaggcattcgggcccccttcttgttataggctgatttaatctacaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagcctgacccgagcccccgagggtaggattgagcacgagtgacctatttcaagtcaagattcttcaaaaggaaacaaaagcacagacacagcctttaggaaatcgaaaatgcttttattgaaatacggaagagaaaaaagataagcccccggccaaccctgcacgcccgggggggtgcggggttggcccgagcccaagacctgacacccgatccccttttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacgccttcgacggcgaggacatgaccctcgtcgtcggaatgggccgacctcttcttcctcctcctgtcctgccgccctgaccgagcggcggacccgggggcggccgaagctgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactacgtgcaagtccgcttcctcacctgggcgcggatatgtgccttgaaagttcatggtgaactgttggcacaaatcctcccaagagtggacagatgcgggtggcaagttcattagccaaccccgcgcctgtcctctcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggtacggagggctgattcccgcgtccgtgttgaggtgacactctggacgaggaagcgccctccgttgcgtgggtagcacgtcggccattacgccgccgctcgatgctagtgcgggcgtccggccccccacgcagatcttcccgggtcgaaggagtcgacgaaggagtggtggggcgaggcgtgcgtcagaccgcctgtcgccacctaacccgcgatctgaccggtctgtgactggtcacagaccggataaatgagtgcactgcactgcgttacatgcggcgtgacgcgctcgtccaaaccgcaataaatgtggctaggtgagcgcagcggcgctcacctaacccatacacgcggcgcaaaacccacaaggggtcggggcgcctcggtcctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacaacatcgattgcgatgatataagtctatatacaaacatgcatgactaaatttaatctacaataagagaaacaaaaataataaaatcagatagtgaatacctgtacagcgtagataaaatttattatttttgtttttcatatgtcgatcgaatttataccttttttttttcaagtgtcttatattattatagtctattttatcaaattttttgaaatttttatataactgtttaaattaacagcaatccggagataacaattactactactaagcagcagttaatgcctgaagcgaagcgaaagccagcaaatcgagcttgtcgaatcgaaggaaggagttggaggaagcaagcaaggcatcgaccggaccggaacgaacctgcgtgcggttgtcggagctagcgagcgcggatgccatgcgcgtggccatccgccgcgtccgcgcgctgatgcggtggaacggccccacgatctcctcctcctccccctccatcccggcaacggcgagcgaagagcggcggcggcggcggatggcgagagagatcctcgagcggagaggccgtggggagctttgcgtgcggacttgggctggtctgctgcttcggcccattaactaacctgcccaccgaggcccggctctccgcctgctcatgtgaagcaattgggctggtctgctggctcggttcggcccatcaaccagaccaagacgacgacgaagcaactgtttcgatctccataaatctcgcaactattacctgcatgcgcacaagatcgtgagcgtctccacatatggacaacgcggcgccgccgccgtcatctggagcggcggggaaggagatggccacggcggaggcgctaccggacgacctgctcgacgagatcctcctccgcctgccggcgcgttccatcctccggtgccgcgccgtctgcaaggcttggcgctcccgcacctcccacccctacttcctccgagcccacgccgcccgttccaggataatcgccgccgccgtggtggacactactgtaattcccgacggcgaagtctgcaccaccatcagcatcagatcttttggcgacggcgacggctaccgctcgggggcggccgtgtcgtcgtcgtcgtcgttcgcctcggtgcggttcgattcccggccttttgtcctcggctcctgggacggcgtcgtgtgcctggtgccccgtcctactgccggtttcgttcgccctcgcaatcccatcgaccgatacgtgctcgtcaatccgctcaccaaggcctgcaccagcgtgccgccgccggcaacccgcggcatcgtcatctgcggttacgcccacccgaccacgtcgcgctaccacctcctgcacgccgacagcttcttttcctacgacggtacggcgagggcgaccatccagattctgcgagtcggggagaagaacaacgtgtggcgcaagatcgcccgccaccctgcgcctgcgggcgtcgtggagtcgaggacctacattcgattgggcggcgctccacccgtcagcctccacggctgcctgcactggctggtcgccccgtcgtcggcacggcctctcctatcggtgttcgacatggaacgggaggagttccggcagatggacacccccgaacaatgggctcgccatgggaacctgccgcacatgatgagtgtacagatcgctcggcgctccggcaagctgtgcgcgttcgtccacgagccgagcgccagcgcgttggggatgtggatgctcgaggactactccgacccgagcagctggcggctggagcggaggatcgactactcgcgccacggcgccggcagccggaacgtcgcgcgcacgttccgcaacaagttctcggcggccaccaccgcggtggaggtgctacccgatggtgtcaacggcggcggcggcgaggaggagatcatgttccagttcttgatcaaccagttcgacatgagggaggctgtgtacaacgttgggcgcggggcgtggcggtggcgtaggattt

SEQ ID NO: 73276 - DNA, 3169 bp, Oryza sativa
cgtgcagtgcagtgcaggcgtccagcactccagctacataatcctacgtactactactagtagtagctgctcctacgtactccgtactctactgtacggagtactactagtagattttccttttctcaacgcctgtctgcctgcccaaatattaatcctctcttcctaaaaacatgactccagtcccctacaaaaggatgatcactgcactgatttggatatctgggcaaacacagccttttgcccatttgcattgcatatgcttggtttcattagttttaggtcctgtttagttcgcgaaaagaaaatttttaagcgtcatatcggatatttaaccggatgtcggaaggggttttcggacacgaataaaaaaactaatttcataattcgtctggaaaccgcaagacgaatcttttgaacctaattaatccgtcattagcacatatgggttattgtagcacttatggctcaaaagattcgtctcgcgatttccccctaactatgcaattagtttttttaatctctatacatatgtctaaatattttatgtgatgttttttttgaaaaaaaaatggaaactaaaccaggccttataatgaaatatagtagtatgtcaggtccttcaaattacattctggtatttgatcgtatacgactatctatgtgatgctccacgttagcacacattttacatacgcctcctggatagggggtgaaaacggtacagaaacggacggaaaccatctttatcgttttcgttttcatattttttttcggaatcagaatcagaatcagaaaccccggatatgaaaatagaattgaatattatcgaaactgaaaacgaagcaaaaacggcgcgaatacggtaacgaaaatttatcagaataaaaaacccctcaaactgataaatccaattgaataaattatctatgtttaaaagagtaatgttgttgataaatcccaatgtaggacaaaaaatattcttatgtaattttagatttgcataacaaatatttttttaaaaaaaacagccaaacaccatggtattcactatttagtgcttaaaaaagaatcatggtatttcagtcacaacatttctggtaattctgagaaaattttctgaaatttcgagaaaatttccgaaaagttttcgaccgattccgagttccgacggaaattgcccttatcatttccgatttcatttctgagaaaatattttcgaattcgtttccgattccgaaaaattccgaccgacagattctgttttcgaaaataggtccgaaatccagaaagtttccgtaccgttttcacccctacccctggatctcgcacttccgcagcatatacaaatgcatttccctccttcccgctgcaagatgtaccccagtactccctccgtctcctaatacaatggattttgacattttgcttacactgtttgaccatgcatcctacacaaaaaatcttgaggatccattatttaatttatttgtgacttactttattatccaaagtactttaagcacaacttttcgtttttcatatttgcacaaaatttttgaataagacgagtggtcaaacagtgcaagcaaaatgtcaaaattccttatattaggggttggatggagtactaacaaagccaaacacaaggtcctaggactgctaattgcttgtccctccatcctattttgatcatcctcttaaaattttaagatgtcttcccaaaatgatcatcatcctaacatgtatatctttgtttatttgtgtaaggaattaatgtgcatctttaaatgtgttgcatacaaccaaacaagattaatttctgttgatgtaatgacatacaatatttaaaacatgagctattcacagtatactaagcgatgaagcatcttaactgatgggaattaatctgagaataatgaatgttttggccgtgtcgttggccttggtaccctttgcttgggtgtgtttggttctaagactaggtgggatgggatgaaaccatccctgattttgaggctgggatgattccactcgcgtgtttggtttgtagaataggacgatcccatttttttgtttggttgaagggatgagggagggatgggatggacgctgtttgccaccaatggcgacgccgtttgcaacaaccatagccgccgccgcctctgccctcacctccatctctgccaccgaggtgcgccatgccgccggacaggaggaagctactggtctggggcaccgacaggccggcgcggtcgcgaagggacgcaatgcggcgggtgatggcctcggccttcgcgcagagcagctgtggcttggcgacgacgacggtggcgaggtccgcacgggagagggagagggacaggccggcgcggtcgcggagggacgcgatgcggcggctgatggcgtcgtccttcgcgcagagcacccgcggctcggcgacgacgacggcagcgaggtccgcacataggccggtggagaggagggcgagcacggcatcagggttggagcacggagttgaggcgggagagcttcggggacgacgacggacggtcgggccgcctccggatccgtcggcgcagccctccccatcgtcggatccgccgccgccgccttccccaccacaggatccggtgccgctgagccccccgacgccgccgctgccgagcctgtcgccaccgccgtcgcctgagccgtcttccggatccgttggcgcagccctcccaattgtcggatccaccgccgccgcgttccccaccataggatccggagtcgccgagccagtcgacgccgccgctgccgagcctgccgcctacctccgtcgcccgagcctgtcgccactgccgttgccgagcctgtcgcgccgccttagacaagcccgccactgtcgcccaagctgtcttccgccgccatctcctaagggtgagcagggcaagcgcacgagctggcgtcgtcacgccgttcgctcattccaggtgggacgagtttgtccgccagttttggccggattagttggtcccggatctgataggaatattcctctataggggccaacccatcccactcacccctaaaccaaatactcctaaaagtacgttcatcccatcccatcccatcccatctcagcaaccaaacataggggatgattaaaatggaattggggagtact

SEQ ID NO: 73277 - DNA, 1143 bp, Oryza sativa
gccccccctcgagggttttttttttttttttttttttttttttttttttttttttttttaccagggattcattgggtatttaacaacataggcatgcaatctggcaaatttgaaaaacttttaacatacaccccaaatccctgcccaaatttaagaactaggggggacacagggcgtttttccatgtcgcattttctgtgatggggctaccatacgtgggagcaaaaaatggggagggtggagcgcatgccaaatgaggatctattagcaatgggacggggcctccactttagcatttccaccctgctcctttaagaggaccgcctttcattgcattcagctgtgatggtagcacgaacacaggtgcaccgaggacgaggagagcaggagccttgtgctctctctgcatttgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaacctcgtgccgaattcctgcagcccgggggatccactagttctagagcggccgccaccgcggtggagctccagcttttgttccctttagtgagg

SEQ ID NO: 73278 - DNA, 1513 bp, Oryza sativa
aggtctcttccctggccaaactggctaaaaggtgctgagaagtctctccaccgataatttcagctcgtcagtcattcggagcttggtgaagcactaggaaggcactttgcaacattgtatctctagctaagcttcaagccttcaactgcagaatgtgtaagggtgcaaccgtgtacagtaggcttgcacaggtgagatctgtctatagcggtataatagcctaattgtgtatatatgttagccctgaagcgtgtagttttcctcacccaatacctcggtcgccttggcgcgcaaatctttctctagttaaaaggctgttcttagtaatgggaaatggaaaggaaattttgagtgatgctggattgctggttgctccctttttcctccattgagttcagctggtgatggcattctcgtttctgtcatctggcagagaaggcactactgccccaagtgacccatggcatagccagaaacagaatgctccatcagtccatctgatgagatatgtgtgaagaggtttcagctgagctgattatagtgctgtaaagcggcttagcactatgtaaatcatgtgttatgcaccatgtatcatgtatgatccttggaagttctggatgcaaaagtgagttgtgcacttgccatgtaagttctctatgatgaaaaaggccaagtgtactattgtctatgtatatcatttcagtttttgcataactgcaatcggtaaggagtgaaagcctccggatacctaccgggatttgaatatttgatcatgctagactaccccaatgtgaatgctacattttgtttgggttaagggaattagttatttaaccttgtttggcaactaatctagttagtctagtaatgcgtttggccgtttgcctatcttcataaaaatcgatgagtttgttcatctcacgctgttgactttctctttttttttcggggagtagggttactaatcttggactacaagggtgtgctttaagtaagtttatgataattatttgaggccgtaaagtaaaaagtgtggagtatttcaggaaatgctgatgaataaagttttttaaaaaacaaaaatcgcttagtaagcacgcctatgataatggtgcaccgattgctttttcatcggttgagctacgacttgtaaaagaaaaaataaagcaacaaaaatagtaaaacttttatatatgtattatttgtgaatttaaattcaagacggaaaaaaactgctttaaaaaaccctcacatcaactatataataaaattttagctgttgctgataagttaaaagaaaagtattaaattgtaaaataagtactacattcaccttttcaatatataatatcgttaactttttaatcattcgtcttattaaaaaatttaagtaaatattttttatttgttactaaagggactttaagtattatttatatttctaaattttgtaaaaaaaattaaataaaatgaatggtagttacttcctctgtttcacaatgtaagtcattct

SEQ ID NO: 73279 - DNA, 916 bp, Oryza sativa
agaattaaaacgctaacttgggtacattactcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagtcacaaactaagccttacccattagacatgtggaagtacggtagtgctttgcaacagaggcccgaagaccggtccttaaacggccgaggtgctaccatcaaaaccatgcaccccgagcccagcctaaaaccattttagggggttttgaatagagggggcggtgtgaagccaattccacaataatccaacaattccagagtgtccaagtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatg

SEQ ID NO: 73280 - DNA, 10852 bp, Oryza sativa
tatctcgcctcgcgacgacgccatggccaccgcctcctcactcttcctcgcctcccccgtcgccaccgcgccgacagcccgcgcccggtccacaccctcggcttcccctgcccggccgtccctgcgcctccggcggccgtcgacgttggccgcggccgcggtccaggccgagcaccagcccgcggtcgccgcggcgccgaagccgccggcactcccgttccgcgtcggccacggcttcgacctccaccgcctcgagccgggcctccccctcatcatcgggggcatcgacatcccccacgaccgcggctgcgacgcccactccgacggtacgggcgcggtggtggtggtggtggtggtggctattgttgctgcttggttctcttctctatgtgcttccgcttccgctccttgactcgttccgtcgctggcctttctttgtgcgcgcaggggacgtgctgctgcactgcgtggtggacgcgattctcggcgcgctcgggctgcctgacatcgggcagatcttcccggactccgacccccgttggaagggcgccgattcgtcggtgttcatgagggaagctgtgagtttctcgagctctggaaccacttttcagttcattgttttaaggcaattcgattttgtttctgcaagcatgttagactatttgtgtgctattaggactgtttagacttttaggagtccatggaatgcttcacctaaacaaatttgctgaataaatttgcagtttcagatattattgaattcttatgtctagttaactagtttgcctacttgaattagagataggaaatcaagtttgaagtctagactccaaacatccaaagtgtctgtactcgcactctcgcaatgcggtgtgttgcattggtcaaaactaacgcaagtcctccccggaaaaggaagaatttccccttaatgttgttgttgtgggtggaggacagacagttcatttttaccattttatttgttgcatctgaaagaatgaaacaccataaacatcggcggctgcttctgtcttgattatgttagctcctgattgcataaggtgcacgtgagtctgactttcaaattaggtcttggactttttgtactctaccagggcaaaaggtattccacgttttagaatttgagcaaggtgcttatcatgtgcttggaatgctgactgcatgtttccccttggacttttggatggaaagtatccccatgctttagaatttcaactcaacatgtgatcatttctctacatgacctcatggaacattgagaactgaaattagcttatttcctctttgattttgcattaaacagcatttggtcctgtcttagtcatcaggcaattgtatagtgtattatccaactggcctgatatttcgtgtgcactttctctttggtgctatatcattaaagtcaaaacatatgctagttgatgcagctttaggtggcttcatctgtctctgatcatagtgcaaatgtgcaatttcaggtgaaactgatgcatgaagctggctatgagctggggaacctagacgctacattgatcttgcagaaacccaaaattagcccattcaaggagacaatacggtctaacttgtgtgacttgctgggggcggatccatccgtcgtcaatctgaaggccaagacgcacgagaaagtcgacagtcttggtgaaaacaggagcatagctgctcacactgtagttcttctgatgcggaaataggaaaatggaagtgtactacatattacaggaattgaattgtaacatagtgaacaaattgtccttatgtaagtggtttatcactgaaattttagggcaaaaacaataaaaccgagtgcaatgtaaaattttatgtgtccagattgtgtcttgactgtttcacaatgaacattagaattttatggcagcaagattttcagcaacaattctggtggcatacgggatcatcattcatcagaagaaataaaagttactgttaaacatagtaaaagttttttacatcccagattacagcacaggtccgaaactgaaaccaaaatgcaaataattataccaagaacacacacaaacaaagttttaacaggaagagcaaaatagtacaacaaagcagcgtcctcacctcagatgccattttgctttcaatttatactgtttgtatgcccaaatcgatatatcgcatgtcactttaagttagtactttcacacattagtaaattactaaattaaaagagagaatcagtgtatatgagtatattgagacatcaactaattacactcactagactcgattgatgtacatcaccagctacatctgccatgtgtttgttcatactgcgcaatactgcatatatttgctcagagtcgccgtgccttgtatctgctgccacaaacttaaaaccttcgacccctcctacatctacaaaactccaccccgcttcctttttcaagccaactctcttcatttcagtcctaatctttgcagagtccttccatctcccaacaacggcatagacatttgacaaggagactctccatatgtcactctccggttccaagattgacaattctatagcagctttttctgcaagatcaatgttcccgtaaagagagcaagcagccagaagaggtccccaaatggatgaattgggatgaacaggcatgtttctgataaattgttctgcctcagcaaacctcccagatcttccaagtagatcaactacagaagcataatgatccatgctaggctcaattctgtagtcgtttttcatgctttgaaagcatctgtagccttctgaaaccaaaccagaatgactgcaagccgatatcagactcacaaatgtgatagcattgggtgaacatgttccatcatcctgcagctcattaaaaatccttagagatgatagcccatctccatgaataccataagcattgatcattgagttccacgaaacaatgtccttaatatccatctgctcaaatatctgctcagagaaatcaattcttcccaacttagcatacatacttatcagggcattgcagattgagacatcatacaaagatccagactttataatgtatccatggagcatctgcccttgctgcagtaatccagcattagaacatgcctgcactacgctcaagacagtgacaaagtcaggcacaagtccatcaccaccatgaagaatactaaaaagctccaaggcttcatccacatgatcactctttgccaggcatgagatcatggtgttccacgaaacaatatccttaatttgcatacctttgaacaccacatatgctgcatcaacttgctcaaatctagcatacatgcccatcagggagttttcgatgctaatgcttggcaaatcattcattttaatcaagtgcgcatggattccctttccatacttcaaggatcctgaaacagtgcagccaaaaagaagcgcagaaagaacatcagaattagggcatacatctcctctcctcaggtacaaatcctcaaaaagacctgtggcctcctcaacaaatccattcttagcatacattatgatgagagaattcaccactgaaacatcattctcgagccccaagcgaacaacaagcgcatgcaatgaactgaacaatcctgactctcccatcaaagagcacgcctgaataacactcaacattgtaacgttgttgggaaggacgttatcctccagcatcatgacgaacactttgagagcttctgctagcatcccattaagcacgcaccctgaaagcagggcagtccaagaaaccacatccctggaatccattccaagaagcagcttttctgcgctcaccacatccccaaccttggcgtacgtattgaccaacgagccaacaacaaacgggtcacagcaaaacccacttgtcacgaggtggccatgcaccatcctccctagcctcgcgaccttggctagcccacaagcctgaaggagagcggccgccgtgaactcgttggggcggaggccaccgtcctcgtcgtcggcatcctgggtcagcatgtccatgtaggcgcggatggcgtccaggggcgcgccgaggcggcagagagcggagacgagggaggcgcaggtggcggcgtcgcggcggggcatttcgtcgagcaggcggagcgcgtcggagaggaggccgcattggaggtaggcgtgcaggagagagttcgacgcggtgagaggctgggtacggtcgagcgcgccggacttgaggagggcagcgtggagcgcggaggtgagcggcgcatcccgccggtcagctgccccgcggaggaggctgacgggggtgggagcggtggtggcgcggcgaggaggaagaggaggcggaggcgacgacggagtggagagggagagcatcggagcttggagtgagactgagagcgagagcggcccagcaaatggattagaagttgaaccgttctataccttgctaatttctttgcatacgtacctacgtgcaccggctacggagaaagcaaagaaatgcaactttgggtgtaccgtgtacaagatacatcagtgcatctgtgggactccgccgtgctgcgtgtgcatctgaacatttcaatagctgattcacttctatttcttgtcgaaagtagtaggagaatacactgacatgtacttcctccgttttacaatgcaagtcattctagcatttcccacattcatattaatacatcaatatgaatgtggaaaatgctagaataacttacattgtgaaatggaaggagtatatgtcaatatctgtaagccaattaatggaaggcaaactatcttaatcgagagctacatagttgccaacgttcccctgtatgataaatgtttgaacgcttacagtacttctcatgtactcacacattccattaacatcccgaacattgaaacgattccatgacaccgtaaggtaacccatggaagagtaaagacttcggtgtttcaggtggatcaactttccgttagttttcctttttgctgtctgcgtcttcaagagcagagagcctttcaacaaggggtggatgggagtagtggtaggctgaataccacggatctgtgttcattgcagataagttctcttcctgaaatttgaaagcaaattccaaattaggctatgcaaatttgcaagcagtttgtgcaggtgaccaagggcaatacgaacaacgagaaccgacagtacgataagagaacgctaatgcggatgttcagttcaagtgaataatgagcgtgaaagtactttgggtaacagaacaagaatcagacagaccttgcggttcaggtgtctagcaattagagtgagaataaatcaaaaggatctttcgatggttacctgtagtttaacaagggctgcacggagctgaggagcatacccaaggttcttggcaaaagcatcagcctagaaattatatcaaggtaagtgcaactgaaagttataaagcagcagtagcagaaactttgaagggaaatagaaaaatgaacctgaaattcaaatgcccgactgacaaggttcagacaaaaactcagaaggtgctggacaggtattatagtgtgctacaatcaagcaacggacatgtcaatcaagttgtaacttgtaatagagcaatactagaaatccaccaaaaaatgcaagccactgcaaacttaaatgaaaaattacaatacctgtagtactattttcacagtacaagcaggtagttgtgctagggaaagactttgtatatctaaggaagaaaatattcttcacaaatatgagtaaacatacctgaaatatgatcagcccaattattacaggctgatcctcgaaaccaaaactttcaaaaaggtctttggagttccttactagcgtatatcctccaaattgtaggaacataaggagctgcataaaaaggagacgaagtgaaaaaactctcaacacacaaaagaagatttatctgttttttttccttctttgtactaaaaagcagcagtactctccagcaacagatgcaaagggactgtatcacagattcaatttcgaaaaagaaccattaatcctacttacatgctaaacactgtttatttgctctggatattgaatagtaactttttctgctaaccttatgccaaggtttgttttgttaaatagtcatccatctaaggaaatggcatgcttagcataacctagtagccactcatcagtcatcacacatcatatccatcatagaagcaggcatgtcaaacacagtacaaaaaaaggggccaggcgggtccaactggaaaaacccaggaccagatcctagtttggttcggtcagaaaaaaagaaagttatggtaaaaataggggaaatagttttttgagtcaaaccaaacttgggtcccatctcacaagtatgttgggcttctagccaaatggattgagctaaatattattctttggcgatattatgcatatttgaaaaaaagtgtattagttgcgggatcagacttaaaatacgtttgaatataatatttttgacaattcaccaattggaccgggtagaccagtaaaaccaagtaccagcagagtgaccagttaagcaccagtcaggattttcatgctatggtcatgcagtatttactttgaacaaacagggaagtcacttttcttaatagtaaattctttaccagaaacaatattgaaattagctaccctgtcctagtgatcaaatgcttgcatttatgcacttttcttatctgtaaccaaaacaatagttctcattcatgcattacatgatacaatgataaagttggggggaggggcacaaaaatgctgcatgtccttttaggagaaccaacgggacatttcggattacatacacattttttatcccagaagtacacaaatactatatcaacaaaatagatgaacaattgttatgcaaagtttatcatggcatcaaagagaatacctggacagctacaaaggaatacacagtgtggttgagtttccagtgcccaagttcatgtgcaataacagaaactatttcatcctcactactacactgaaaccgacaaaaggatccaggtgagtttcatgcatgtaattcaaaattataatgaaactaaacaacttagcatataacctgctgaatcaacgtgtcatagagaacaatgcgcttgttcttgaaaaacccatacatgtaagcctgaaagaaaattgtcagttcaaagcacacagaaaattacaaactatcagttatcaatgaaccacaaccctgaaggtagagtaatcaacatacattactgtggcttgatctggtagacccatccaccacgaaaagctttttcaatggaaaactgagtgaagctgctaatttctctattttctctctgagtactccttctggaagctgttaaaatatgtgcaaccatatctagttatacctcaaaagagcttttgccatccgtacggcttattaataggtcaacgtagttcaataacatgggacacgaattagaagatgcacaatggatgcatgtacctttctcacacaaaaaacagacaagtgaactaattacagcatactaggtatgctctacaacagaaaaagatactaaccggagtgaatttgttgaacagaggtgctatcacgatggggtatattgtcatcatcacaagagataatgcaaacataaaaccccatagatatattgccaggtagggccctccattctgaagcacagagaaataaactaatcagttcacacacttctacgagtttgtggtattcgggcccagatcccgcaaaaaacaggtaagcctgttctccagatactagccaacaatgaagaagtgtgtggtagaaagacaggagatacctgtactatgatgataatagcagccacaataggaggtccaagtaagatggatagcaaaatccctttgatcatgtccctaatgaagagccaaatagtttgctgaaaaaagtccaaagctagaggttcagaataaatatgttggggattagaacatagcaaattcataagccaagatacttttgtacttcactaatcttgcaggtgaacaccattcaaatgttaaaacatataataactgaggtgctaaaattgagaacacaaacataccttgttaaaaccatgtttagcttcaataacaaatgttgaataaagagagaatggtaagtctgtgatctgcattgcatgaagtatgtatcagtgtttcacatcaaatagtggagttggcatgttttagctgatggcttgcaaaagaagttgattcaccataagagaacactatgccaaagttctagtagatgtagacctaaacaatcaatatcagtatgcaactatgaacataggtgtagattaacatgtaaaagtcactggatgtactcaacagaaaagggcaaaaggatgattactcttatccaaggtaataaatagtgtatagcgggttgttagcggattagtgtctgtgtagcggattgcggatagcgggcgctattgcggacgctaagttccaatagcaaatataagaaaataaccataaatatatcaatattaacatcaaattcatacatttttaattactcctatatttcataacataaaaagtatgaaataacatatagatatataagataaataagataaacaatgtaaagttctacaatccataaatgaagaacaacatttaagcgttataatggtccaacaaagtcaatagcgggctgttatagcggtcgcgaagcgctatatttgagataagactcttatctcaaatatcctgatcttgatacatgcaaatttaagaaaatacaggcaacttttgccactatttttcaagttgaaaaatggtccagtcagagaagaactagagtggctgttcatgtctgtcagggccaaaagcagaatagggaaatgcatgtcaatagtttcataggtgtcactatgctatgcgcttcagtcctgactaataataacttttgatgcagtaactaacgacatagacaatccagcaaccaccatttgtgttaaactaaagctagcgattgtcaatcatggaaagctaaggcttcagtttatacgtaactcaatgtgctggaagacaactggaagctaatttaattttgaatgcaatgaaggtaaaaatatatgtgcaataaacatataagatgcttggcaggtacaagtaattattctatacctgtgaccaaatcatgacacctgctaagaatgcaagagtgtgtagtatctcattttcagcatttaggccagcattggttgctagctctccagatttctacaaaagaaggctaatcacaacaaaatacttgcataaagagtttacagaggcaagctgattgattttgttttaccttccaaacccagggaagaactctatagtacagaattgtggtatccattaatatagttacagcttcatggataaaatggaatttgctgtaacatgagcataaatgtcaacacacaaaatccaaaaaattggcagtctgaattactttagaacgattgcagtaaaatgaataatgtaaggttgcaaaaggtgagagcagtattacacataccttttatcaaggctataagctctggagcgctcaaacttttcaccactaattactcctaccaggggttttggcagtgttggcaacttaagggctctatgctgacggatgtcaagatatgtctcaaatatatacatgagaatcataaagcctgcaaaacgaatacaaatttttaaaaaattatttcatcatatacaatatccagtgttgaatgtaaatatataccatgacctgacttcactcgagaggcatgagtcttagctaacatatgcaagtcacagatcctattacaagtaacttcttttcagaatagatattgccatcttaaactcataaatcaccacaaactctacaaatattgcatcctactgcatgatagagagtgttgcaacacaacaaaaatacagaaattcaaccctcatgatcaattaagccaagatgacttcgcagctctatcgcacatctccactctaactacactcaatcacagacggtcttcactgtatttattaagaacaaaagcgtctgtgccatacattttcacttcaccggttcctataatcacatcattgaatgatgggcactcagcaaatcatcaacacaaaagcaaaccagtatactaggaacagctaatcacgaacaacataaaacatggcatcgataccgacattcagcaacttcattgcatcagcgccaaggcccttctcccccagcgccaacgccatcgccaatcgcattaagctccctcgactcaacttagattaatccaccctacccgctaccaccaagccgccacgcccaatcgccaccacagcacgagcaaatcgagccggagattaaaaacccaagcgcccacccaaaaaccctagggtttacgcacggatcccccgttccaaccgaaacccgacgccatccccacacagatcagcgatcaaggcgagcgtaccaccgcaccaaacgagagatgggggaggcgaggaaatcttacacagcacggcctccaggtaaggaagcgccattggagcaggatgggtggcggaggaggcgctccgggaatcgctaggcggcgggagacgggggagaggaggactgggggaggcacgggccgggccggggacagaaggaccagaagagggggagggagggaataacagaggggctgctgagcgtgatgatgcggaaagggtcgggagtggggatactttgctcgattccgttgctcggacctccgagagccggactggggaggaaggtataggaaaaa

SEQ ID NO: 73281 - DNA, 4061 bp, Oryza sativa
  unsure (1)..(4061): unsure at all n locations
ctgcagccccgtggcgagccgccgcctatgcaaggaagccgtcgaggttggagggcggtgcaaaggacagcggagacagggtgcggaggacggcgacagcgaatgtggtgagggacggcggcgcgaagatggaggagacgaggaagaggaagaagtggtgcgcgtcctcctcctcctcctcctcctagaacctatcaccatcgtcatcgccgtccgccatcaccccgttccgcgccgccgacttcgcacgttgctgctccgcccaccattgccccacttcgcctgcctgctctgcctgacgccgccccgctggctttgcgcgtcatcgtcccactcctcctcctcgaacttgtcgctatcgccatcctcatccgccatcaccccgctccgcgccgctggcttcgcgcgttgtcgctccgccaccatcgccccactttgcctgcctactctgtccgctgccgccccgctgacttcgcatgtcatcgtcccactcctcctgcctgctccgctcgcggccacccaacttcgccccacctgtcttctctgcacatacaaaactatattaaggacaaatctcctaacctcacaccaatcccaaaatgcaaaaacaaaacccctaatttatagtgtattaatgcttattaatgcgataggagctataggttttaaaaacacctcgtaaaactgtctatttgacattagggcagccacaataagccaataaaaaggattataaggctgaaaagatttctttggttggctatatatatattatggcaatagaccataaataataaatataaaaagtaaccataagcttatggcccaaacacaagcaataaaataatacagtatacacacactgaaaaatagaaccaaacaagaggagagaagcagtcagtgcttgatacaaattatttttttacgttgcaccagctataaacattgtgaaatgttctagaccattttttcaagcaagtgaatcctagcttaagagcgtgttaatcttatacaaattaagaatgctcttaacttttttttttcaaaattttgactatcagctttctattagatccaaatggtactttctccgtttcacaatgtaagtcattctagcatttcctacattcatattgatgttaatgaatctagctagatatatatgtctagattcattaacattaatacgaatgtgggaaatgctaaaatgacttacattgtgaaacggatggagtactatctaacaaaattattatatcgttaaaataattataatgaaaaaaacactcatataattcttatgccttaaaaggagctattgatggttaaagtttaaaaattttgaatgaataaagtctaacagtgtcatgtttaaatacaaagagaatatttgtttggacttagactaagttataagtcaattgataagtccaagaaagacggatttaacgtggggcttaaaaatccaaatacatatttattatctaaaaaagaccaaacaaacttcttgtagatatttgtaggttgaaacatgggctattccttttcttttgtttaagaccttgttatcttctagttggctttctccaaaattccaggcaatgagaattaccttccattctcaaaaacaaaaacgtgggctattggaccgcacctggagttcaatgggcaagggctcaatgggctgcgagttcatctagcccacgtcgaacaagttcggcactaataggcctatacgtcgaaaccaaagnnttttcccggggcaataagttcactttgggtccctctattgccccatctgattttcttccctgaccacaaaaccactacgacccgtcccccaacttacaaaaaccggacaaacagtctctcacagtttggctgaatggcacctacgggcttgttaactaagtctctgtccacgtggcattacggtgtgcttacgtggcaattcaacccgaaaaataaataaaacttgtgagacccacatgtcagtgtcacccaagaattataaaaaaagtggggcccacgtgggccccacatatcagtttcacgcagtctttagggcacatctggtgggccccacgttggccttcatggacaggcacctcctagttgttaaggacatcgccgcggtgttcttcccggccaccgagcgcgtcctcggcagggccgacgacctcgtcctcctcgtcgagtccttgcccgccaagctcacggcgcgatcgacggcctcgagctctttcgtcgccggcgccgtggggcacccgctggggcacggggcacggcggtggtggcggccgagcacgggggagctccccatcccatccactgtctttcgcttcgcctagctcgccctccgctgctctgcccgcggccgcgctcgcccgccgcccctccgccgccgcgctcgccctccgctgctttgcccactgttgcgcttgcccgccgccgctcctctgccgcgctcgcatattgtgtgttagtggctggttgcaggaagcaggtaaattagctagctaacaacgctaatgtgctaagcaagctaatgaattaaatatgactcatgcatgagtcatgcacgaaatggcatatacacacacacacacatacatgtgagtgtgctcagccatatacacatgcttggctaatatatacgtctgcatgttgttggcggcaaaccaacaagaagctagctagaggctatagctggtcgtctccatgcatgcatatatatgctcgcacgaagacgcatatgcatgcggccgtctgtacccggcgttatagatggccatctgggccgcccggcacggcacggcccaagcccggccgtgcctgggccgaggcttgtcgggccggcacggcccgaccgatgcaccgggccgtgccgtgccagcccacgggcggcatacacggcccaggcacggtccaatactagtcgggccgtgccgggccggcccgaaggcacgatgggctattgtgctgcctcacagaaagagtctatttttgatccctcaactctgtgggctgtgtttaaatggctggaaataagtctatttttgatccctcaactctgtgggttgtgtttaaatggctggaaataagtctatttttggtccctcaactctgtgggttgtgtttaaatggctggaaaataagtctattttgtatacctattttcttgggccatgccttatacgattatataagtctattttttgtccctatattttttttatttgatcgggccgtgccgggccggccccccgtgcccagggtgcagcccaggcacggcccggctgtcgggccgggccggcacgggcacgaccctagtcgggccgggccgtgcttgggccgggccaaaattgcgggcttcgtgccgggccgtgggcctcgggccatatggccatctatacccggcgtatatgcgtatgagctactcctatgggctcggaaggaactcgagaacttggaggtcgtcacgggcgggaacgacggcggcggtggcggtggcggtggcaacaacgtgcatggcgacaaggctcccgttgacggcaaaggagaggcagcgactccggcgaaacgcgccgacgtatcaggtggccaagaatgcggcgtggtccgcgtggaggatgtacagcgggtggagacgccagctggagagatcacgaatgccatgaaggacacggagatcatgaagaataaggaccaggagagaggaggcagcgagagggaagaagaggagaccgttgccatggccggcacggggagcagggaggaagcattgctggttatcttcgatacagcatggcaacaggggaacctccttatctggcgggagcggcgggacggcgggtgcgcttgcactaactcgtggccatggcgggtcagggaggcaggcgacgccgctggtcgctgggctgtggcggcggatggagtcacgtcgtcggtaaccgtcggcgggcgcgggcggcgaagggcggtggaagaaaaggggatagaatgacatgtggggcccacgtgggccctaccttttttataatttctatgtgaaactgaca

SEQ ID NO: 73282 - DNA, 795 bp, Oryza sativa
tcagttgggaaccatgataatctcaggtctaaggattcaacaccaacactaaatgagataactgatgacacaacacatatggctcttgcagtgtctcatgttgggtctatccaacaacatgttcactaacatgtgtccacattattaatttggtatctctataccatgatccatgagacatgatcatcaattaatacatgtgttgatcatctaaacatatttgttccacatatgatatttgatcagggatcctttagaaatagcaacacataacataaaaagtcttatgaaagaatcacatattcattaaccaataatgagtttatctatttcaaggaacaaaatcggaaaaatatgtaaacatagtatgtgatacaatcatctctatgattgcctctagggcatatcactaacagcggcagcataatgcagaagaccgccggtagcagcttccatggcatgagcactgagagctacaatagagagcaattagccgacaacaaggtggacacgtagactaaggtcccctttgatttataggaaaagtgtagaaaatttgaaggatttcaatcctatggaaaaaattcctataaaagcctttgaaacaaaggattgaatcctatactatcctttaaaattcctatgaaatggctaatcctatagtgattttagaggaaagttagcaagaggtctaacctcttgaaaaaattcctttgagtctatctatctcatccgattcctacgttttttctgtggtccaatcaaacggtcattcctgttttttactgtattttc

SEQ ID NO: 73283 - DNA, 8761 bp, Oryza sativa
  unsure (1)..(8761): unsure at all n locations
cccgcccccggcccaccgaagggggcttgcttttgaccgtttgttaccccgtgggggatgaatttaccccgatagctcaccctaatagaggaattccccaccgatgaacggggaacggggccattgccatccctacatatgagcatgaaaaaaagcagacgcaacacgcaagcggacgccgacactcaagatcagacacgacgtgccatattcagcacggcaccactgccaccacacgaccttacccaacccaacaccaccatttcaccattgcactgcacgggggcacggccgatcgaaaggacaaacgagttttcctttcccaaactattactagtactacagtataaaggtgcctctttaaatcgcataaatgataataagataataagtgtgaaataaaatattacaaaatatacgaaaaatataggaaaaaatataggaatggttgtttgattgaccagcgaaaagaacataaaaatcgaataagagagataaagtcaaaagaaaatttttaaaaggttggagtttttttaaagtttcctcaaaatctctttttattgtccattcaatagaaattttaaattgtatgataggatttaatccattgttttaaaggtcttcacacaaaaattttttataggattaaaaatcctttaaaatttctatgttttcctacaaatcaaagggtccataaaggttggatctacttatgggtccataaaggttggatctacttatggcctatttgttttggaggaatttaaacatataagaatagaaaatgtgaaagaacaggaattcgtaggaattttcccagaggtttgggtggatgaaatttttcatatgctttctctctacatctaataggaatgaaaatttttcttctatttttctatacctatatgcctacaagccgaatgatactaatatgaattaattcttagaaatccaactttttttcgtccaaaccaattttttttgtttcccttatcggtcagcacttacttttcctttttttttgaatttttcttcaaggaaaatgggcttttctctctttgatcctccagaggagagaaaacgtgcattttaacttcctccagtgcaatttacatttaggtcttatctttcaaccataaaatctggtttatcgtttctttcaactatcaaaatattattttgcctctgcaaacgtttttgaaggtgattttgtccaatgtggcacattcgtaacatcttgatatagtcttcatccnaatatggcgtataagtggcaatacagccaaagaaaaataaaaaaaataatgcgacccacatgtcagtggcataaccgttcctctctttatatcgcctttcatcagacaaaaccgttaactatattgacttataagcgccatgtatgataaaactatcttcaaaaccattcgaggaggcaaaatactggttttcataattgaagcaggtgataggttgagggatgcgaactaaattcggttatatttgagggagtgaatatggacgttttcctccagataaagttgcccaagtggaaaaagtacaccgaaagtccctcaacttgtcatcctcaacttgtcatcgagttacaaaatcgtcccccaattgcaaaaccaaatatatgacttccctcaacttacaaaactgttaacttttagatccttcagtggttttgaccccattttgtctgacatggcggctgagtcagcgcgggatccatgtggccccacatgtcagggtgtccacgccaacaccatctctctttcctctattctctcccttctctctgtctcacttctctgcacaggctggccgatgggtggggaggaggcctgcagggtgaggcaggagaggagggtgcgaggcgaggcgggactgccgccgctagggaaggagccgccaccgcaccagaaaggcggccatagcaagtgaagcagcggcggcggcgacgagcgagcgtaggggcggagcagcggcgtcggcgggcaagcgcggtgacggagaggcgccggtggcaggcggctgcggattgggagcgacggcgccgatgactccgcgccgctcggcctcgtcgtcatcggcggctccaggcgcatgcagagcagaaaggcggggggcgcgaacgggcgatcggtggcagggatagggctaatgggaggggccccgagtcgtcatcgtgctccgcatcgccgaccgtcgcccgtcacgcttgccctcctctcaaccgcgctcctccctcgccggcgcgcccaccgtgccagcactcctcccctaccagccgtgctccttgagagaaaaaatgtgtgtgtgtgtgtgtgtgtgtgtgtgagagagagagagagagggaaagggagagtgtgctgccttggcatcccaacacatggggcacatgttggtctcacgctgacttagccgtcacgtcggataaaaccggggtcaaaaccacataaggacttaaaatgaatggttttgtgagttgagggatgccatattatcttgttttatggttggggatgattttgtatcttagatgacaagttgagggaccttcggtgtacttttgtgctgcccaagtctaggtctaagtggctgccgtcgtgcattacttcatcatgggcctgatgggcttcccattgttgtcacaagacaagagtgttatgtactggactatgtagttgggctttattacttggtcattcgactccttcgtcttcctgcgcccctcttctccgggtctagggtttgctgctccccctccccgccgccgccgcctccgcctccgccgctcagatgggaggcaagtgcccgcaccgcaaggtcaagaagcgccgcctctcgcacaagacggcccgccgaggcaagttcctcgtcaaggccgacgacgccgtctacgacgagctggtcaagctcgccgacgccggcaaggacgccgacgctacccagctccccgtcgacgaggacctccccggtatgggacagttctactgcctccactgcgagtatgtgccccctctctactgtccctgctctgccccccctttatatcgaatctccaactaggaatacgcctttgcttcctgcaacgaactctctctctatatatatatatattgacgaacatttacacgtctaatataaccactgattctcgtagtttgcacgctgcctttaattgaattgaactgtaactcctgtgataaaccaataatttagtctcgttgattcttgcaatgcctgcaacccttatcaatcaaataatatgttcaactctcgccgtttatttctgataccaatcatataatgcatgcttgctatgttggttgtcgcctgcagtcgctactttgcaagtgagagtgtcaaggaggagcactaccgctcaaagcgccacaagaaaaggtgatcgccttgtccttgctacttttaaatctctcttctaagaagaatacatattggtaacctgccacattccagcatcacagacccttactgcactgcatgtcatggagctaatatatattatatggtgtcatgacattgtagggtgtcaatatatattacctccatcatggttactgaaaacatactaacttcttaaattttatggtcacaagcatctctattccttattgcatttcatgacattggagctaaacagaaaaaatattctgctctaggttgtcttctacagttttgacgagatagtactttgtttcaataatgtatacatgcacacgttttgttgttcagcaacaaatttttgttgtttggtaaacgcaattgcctagagcatataatgtaacaagctgcaagtaccaacttttgacaaattttacagaagacgaaagtccttttgttttggatgcagctagtacatatcatttatatccgtgtagctagatggtcttcagttctataactttgagcttgaaagttaaaacaccagcgtaataattatgtggtatagaaaaggtctctgttgtggtactactatgcagcttaatctactgaagttgttcaatctacttcgctgtacctatctattactccttcggtttcaaaatatttgttttgttaggacaagactttgactaacaattactctattaggatataatgttttgtgacacaattaaatttattagatccgtattcaaaagtacttataattacatcgtatatatcactacatcagtgtagatagttggtcttcagctctgtaactttgagcttgaaagttaaaatactagttaattatcccctccggttccataattcttgacgttttgaacaatgacacagtctccaaaatatatcctagactatgattttctattataatatatacactaaataaatacatttttacttttattatagtaattttaagaaaaatctatatatgttgttctaggggctttaaaccaaatattattaaagttataaaagcttgacctcagccttacacaaaacatcaagaattatgaaaccagagggagtatgtgctacagaaacatttctttctttgtgcaaagtgatacggttcaatctactatgctatatctaataatgactttgcgatacttgtaggatcaagcaaatgtcagggccagccccacatactcaacttgatgcagagcttgctgctggaatggggatgcctgacaatggcctgaagctcatgtccatgtgaacctcttcttgttcctggtttttactcatatgtttttgtcactgccgtacgtatgtacttgctctgcttagtagttaatggagttgacttgatggtgtctgttggtccaagaatttacttttaagaagccaagggttactctgttttgcctgcctcattttgtctcgcttctgattgaatatcagttacctcagtcagtgcttgggatcaaaacgtcttatcggtttattggcattggcttgagcacaagctaccaaaggcaaggggcgttgatggatgcgctttgcctcacatgctatggctgccttatgcctgtagggactaccagcaatgagcattgtatggcataggtaaactacatataggcccagagtattggccacataaatatagattgtgcctttacaggtgtgttgatctgtttttcacgccccatatgatcttttgcacattctggatctacccttccatgacctggtcatgtctccccactgagtctctgggccatgttgatggtgtcgtctggggctttatgcagctgtaatatgcattttagcatgtattagttgcaccgtcacgtgttactggcaactactagtagtgtgttttggtttggtgtaaggacgagttgaaaaggaataggcggtgccatattaatcaatagggctgtcaatgttgacaaatgttcctccttatctaatctacttgttgatcgcaagtgcgtgatggtcacctgacctgggctgttggcttgttggaatggaagtctgcattgcatagaaagggcgagaaggtgaatgatggagatgaaatgagtagaaagatgcctttgatgatgcagcttttgtcataatagcagctatagaggacatagcgatgcaatgcacgcacgctccttgtttgtgtgcgggcgtcaagatgcatatactacttactactgtactctactatgctgggtgttggacatgcatgcatgcatgccggggggccaagctaagctagcgaaatcaattggtttgcatcatcgccagttgtgcaattgtcctgcctatactccttatctttctttcactttcatgctcccaatcatgtctgtaataaagtactacacgtagtaggagtaataagttataagtgccagaatgaagccccatgagctgactcccccgtctcccttcccctggtgattggcgatgagttggattggatttggatctccagaatccatccagatgctgaaaagaaaattaagagcaaggggccaaaacctgtcacgcgctcgctcaaccccaccacaacaccatccatgctcatcatcttgttgtgcagttgctgctcttgttctccaatcgacacaaacacaacacatgccagccgcccgcccgggccggctgtggattgtggaagagagaaaaaggactaatgattccatggctgtcctttcggatcgaggcgccctggatgattagcagcagcaggggcaggagcatggcaatctatctttgatgccaagcaaagcaatggctggctgatatactaccactcactgatccagttgcagtttgtttagggtgtgccacttgtttcagatctctcttttgccttgtttctggcagcatccacaagctcgccttgcgccaattgacatggccaaccccacaaagactagggtggtgacttgagctccttcgcccacacttgtgctcattgctcgtcagaccagatacacaaacacgcgccctgctctactactggagtactactactccagtactggtagtacagtagtacagacacacacactgacactggccctgctgatggtagtggtagtggcagtgttaggtaccccatcgcagaaagagaagaggagactcgccatggactcacctctacagaggagaggtgtaggagtagagcagtgtcagtgtagtatggggcacatgagttttcgacagcactaaatatggtggcttagatttgacagtgccatttggatttggttcatccatgaaatagaaatagaagaggcccccatactgctttgtccgtccggaggggagggggagggaccatgcagcgagcgagcgagcgagcagtcggtgttggggcacacgacggagacgatcatgtcatgtgcaagcaacaacaagacgtcaacattatgcctgcatgtgcatgtgatagtccttccaagtcaaactttggagggtccagaatttctgcaattctgcctccctccctccctatcccttgcctgcaaaacactgttactttggactttggagtgtgaacgaatgatactcctactcctacgactactctgaatgttgtactagtagtagtgacaaggaagccctaaatcccgggtcatacctgctgatcgaattgacttggtaatggagtaatattatactactccagcagcagcagcagcagcagtggtggtgtatcaatcatcctcaactaatcgaactgagcatgctgcttttgtgctggtccttgatttccggacaaactaatcgaagaatcgagctaaaatgatccatcgatggacacagtactagtagtatcatgagctagctagctagcagtatagtaattcatttcattaattcattcttagaacatctagcagcagcagcagcaagaacacacagcaaaagaagaacatgttgttgtatcaaaacgaatactaggtgccgtgtgttgttgttgaggaggaggggcccggcgcaacgtgggagtgggagaggcgctggagctgcagcatgcgcgcgtagcagccatcggggtggtggttgagcaggtgggagtgcgagccctgctccgccaccttgccgtcgtcgatgacggcgatggtgtgggcgttgcggacggtggccagacggtgggccaccacgatggtggtgcggccggagccagaggaggaggcgagcgcctcctgcacgctccgctccgactcggcgtccagcgcgctggtggcctcgtccagcagcaggatgggcgcctgcttcaccagcgcccgcgcgatggcgatccgctggcgctgcccgcccgacagctgcaccccgcgctccccgaccaacgtcccgtacccctccggcagcgccgatatgaacttgtgcgcgttggccgccgtcgccgcctccaccacctccgcctccgtcgccccctcgcgcccgtacgcgatgttgtcgtggatggtggccgcgaaaaggaagggctcctgcggcaccagcgccatggcgcgacgcagggaccgcaggttgaacttgcgcaggttccggccgtccaggagcacccgcccggagttgggctcgtagaagcgctgcaccagcgccagcaccgagctcttgccgcacccgctcgcccccaccagcgccagcgtccgccccgcccgcgccctcaggctcaggtcccggaacacctgcacctccggccgcgacgggtacgcgaagtccacgtgcttcagctcaacctccccccggggccgctccggcaccgccgccgcgtccacgtcgtccggctcgatctctgtcctccggtccatcgcctcgaacaccgcctgcatcgcccgcccgcccttcacgaagtccggcgccagcgtcagcgtctccgcggcgccgttggccgacaccatcagcaccatgaacacccggatggtcttggagaagtccgacacgccgtgcttcaccagccacgccgcgtaccacagccccagcgcgtacgacgcgtacagcaggaactgcgccaccccgtacccgctcccggcgatctgccccttccagaagcaccgccggagcggccccgccaggttcgcctcgaacagccccacgatcttcgcctccgacccgaacgccgccacggtgcgcacgttcgccaccgcctctcccgcgatctggtcgccctcgcgtgcgcccgctccaggtcgcccgagaaccccttgaggaacatcttctgcagaacggtggcggccaccaccagcgggaagacggccagcagcaccagcgcgaggcgccactgcaggacgaagccggcggtgcaggccaccaa

SEQ ID NO: 73284 - DNA, 920 bp, Oryza sativa
ccggttacaataggtccttcggtggttttgacaccagttttgtcctacgtgacggctgatttagcatgggacccacgtgggtcctacatgtcaggctgagtccgctgagtcatctatcttccccttcttctcttccttggttcctcctctctctctgcgcctgtaggtcggtcggcggagcgaggggggaaaggaggagcgcggcgccgcaatggcggccgccggcggcggccacagtggggatgcccgacggtagcccggcggagctccacgacgcgggcgtgcagcgaccttgcgcaggcgtcgacagggaggcgcgggcgtgtgcaggcgtcgcgggcagctggaaggcgcgaacaacgcgggcatcgacggggcaaggcgggagagaaggaggacggcggcgcaacggcggccggcggtggccggtgggcggtgggcacggaggtcaagctcccagccctcaaccgagctcgagcagaagggaggtggtgctcaccgacgctagttcatggtgctgctcgttttctcagctcgatactctcccgctcgtcaagctccaccacttgaccgaacaaatcgcggccacgctgactcaaaacagagcgagcagaaaaccatgggaggagggaaaatagctaacaaactaacagaaagtaaataagagtataagatcaaatcccaactgacagaagttcatttatttaacacataccaccttccccggcaccacggcagcatcatgatgggccagatcaccccacggcgatggcggcagcgccgctttccgccgctgacattccaatggacggtgcaccccatcgagctgtggagctggttcggcgtctccggcggtgagcagctgagcttggcgtccgctacaccaaggtcaagctggtcggcgagttcctccagcgaag

SEQ ID NO: 73285 - DNA, 25241 bp, Oryza sativa
agaaggttatttttgggacctaatggccatgcacagtactgctgcttggagatggtatgtggaaatggtttttgaacggtcatggcccctcgttatatttgtgtcggtacaagagaaagatacaaatgtttcaatgcaaacggaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggatgacgcatcatccgatgaggaaggtgatgtaatggccactgattgggcaaatgaggacttctctggtcttgttatatcatagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtggtgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcattttgaccaccaatttggcagaggtgtacaactgggtaatgcgaggagtccgggtacttacattggctgctattggtgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtattgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaacttttctttgttttatacttatgtttgaagtttgctctatacaggttgcgtgcggcaggccttctaccactttgtaggcttgttgaggcggcgggggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtacataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgatgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatgatccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttctatagttttcaatataaaaagatttgataactattgatatttatataaaaaaaatatagagcacagtacaaaatcgccctcccccagggcggcaagggggccgcctgcaaaattccatgcccccttgccgcccatttgcaggcgggcccccgcacagtgcaaaatcgcccttgcggagggcggcaagggggccgcctgcaaatttcgttgacggccgtcgcccgagagcgaacggccgtctgccacgtcattttcgccgcccttgggagggcgatttttaaaaatcgccctcccagagggcggtaggcgactatttccgtcaattttcaaaatggaaaattatttttgtaaaacttttaataaaaaaaattataaataaaaaaaattctgcttccgccaggagcgagcaacagcaaccgagtcgccgacattgagctggtatgatctacaaaatcattttgattcctctaaacaaatactccctccatttttaaatatttgacaccgttgactttttagcatatatttaaccgttcgtcttattcaatatttttttaaaatatgtaaaactgtatgtatatatagaagtatatttaacgatgaatcaaatgataggaaaataattaataattacttaaattttttgaataagacaaacggttacatattttaaaaagtcaactgcgtcaaatatttagaaatagatggagtatgtatttccacggagtagttgatgaggtatacattttcttctctgatgaattattggcttgatttatgctattcatgatggttttccctctcccggtccccggcacaaaatctaacgatggaaagaaattaagaaatcaaagctaatatgctataccttgtgacaattcaccctccttcaaaaacaaaattggaaattcagatgtcttagtcctgctcttttcttcaacaagagttggacgaaaattaagatttttgtgacacgcttttcaaacttctaaacggtgcgtttcatacggaaactttctatatgaaagttgctctaagatatcatattaatttaattttcaagtttgtagtaattaaaactcaatcaatcatatgttaataccagctcgttttgcgtaaaaaaacttaatcttcatctttgagaaaataacatcacctaagtcgatactatcaaatatcaatatattagctgagaattcaatgtattacattacatgttacatgaaggaaagtccaaagccatttcctattgaacaacacgcagtgcaactgactgtattccaattgtaagatacaaacagaggaatctccacccttacccatttcccacggtattcatacgatccagaagacatacaaaagttgaactatatggcaccttgccttgttctatgtaatcaatatgacgggacggggtatgacttcctatgagaaacctatctgcttcaaaaacaatgcacacacagggaaagagtcatcatgcatgcttattgattgtcaccagggagagaaatgtcaatttatatggaataaataacaacaacattgtgtgcagaccgttccatttgtcaagccttggacgtcttctgatttggcttgaaaacataccttaccagagaatccttgattgacaaaagttctggaaattccgccttcagcttggtacaatcaagctcattattgcttctcggtgcaactatgaccttggcttgctcctccagggtaaagttcttccaagaaaaattcggatcaatgtaatccctatacatttccaatatttcattgtggctcaccacgccaggattagtgaaattccagatcccagtgaggtttctctttgccatttcgattgagataggaagaagctcatccaatattgtcattgaatttggtatatcaaccactttatcataccgggcgattttagtgatgaagttgcgaggattggatagatcggatgaaataggcatccttacacgaagtgtacatacattctcgtagttttttagcagttcctcaacctgttaaaaacaatgctaagattaactgtgaaatacaagtcaggaaaaataatctgatttaaaaatagaaactatcatgaacatacaggacaacaagatagcatggtaacacaacaaactactctaaccaaattcagacaagtgattctgctagtgagaggatctctctctgtgagactagacaccattttgttcgataaataaacaactgtttgcaaagattcaagatcatggcatataggggattcaaaataactcaaaaaacatacttgtgaaagtaaacgcatatttggtgcttctcatctaactcaaccacctataggttgaaacttcgaaacaaattgtggaaaacaaataatgtggctatgaacaataaacttgacacttaattggaactcgcaaagtattcttttctctagtattacaaaatttcatccaattgcgctacatattcagcatattcatttcatatcggtatgttttcaacctacagaagttaatgatttattttttttctacccagaacatccagcagaaaacctaccaagtgtcagaacacaatagttttggtcacactatacttacaatgcatgtcaggagtttatttctttaaaactaatgcatgcactccaagaaacaatgatctgataatgccagcaaggaaacaatcctaaaacaagatgaaatgcctctgtaaccttggcagcaatcacatacatgaagggtaaaacatatacaattctagtaaagtatatggtagcacattttaagtcgttaattagctaaacctatagaaactccagattcaaatagcacaactttctgtcaaagtaaaggctaagcctatagctagcataaagttaacactcccagaacttcaagatgttgacaggatttctagtgtcaatcttagctatttgattcaaggaaacttgctaccctttatttattaaaattggccaagatcatggagaatgttacacaaaatcaaagcatgatactatgaaaagtttaaaacttagaactagtgtgcaaatgtgcatggaccaataacagatcagaatgctcgacagaccaaaatgaatactgtgttttgattccagaaggcagaaggaaacatgttcctgcaagctttactcaatagtctgccatcattacaactaggagtaagtcaacccaagctgtcaacattgtcaaccataaggatctgcatcagcacgctgaccaagatattggggatattgtacagaccgccatgcaaagtcatgggcatgcagttccatcctatccactatccgttctcatctgacggtgcacactcgttgccccaattcctttcttctccttgctcgcttcactcggtagtttcttggcccgccgcggctgccatcatcggctcaaaaactccttccatcttgtaatcggcgatacaaaacacagaaatggactaaccgttggcaaatcttccggcctcgcacctcatcccggtatctaccttcttggcatccgaatccagaggtgcagccgtgtgcacagagatgattcatctcgacgaagagatggccggaacatttgattatggttgagtaccagtgagagtccattagttggaagaaaatgctcgtattgcagaaggtgatgttcacattcagtgctttgggtagaggtcatgcaaagggagaagcttttaccggatctagcaaccacctatcaccattttaattgttacaacgacaatctgactaaaatagcctacagctttccagcagctgaaattgcgatctggttaggagtgacggacatggcgaccggccttgaaggtgcagactctgaaggggtgagaatggatggtggattgagcagaagaaaggaattgagaaaacaagtggtgtgcaccgtctgatgagaatggatggtggattgagcagaactgcacgcctgtgactttgctaatcacagtcaggggatccgcttcctgtacagaccacgccagatctaatcaaacgagaactaatcaatactagtactggcatgaaactaactaatcatacgtccctcaaggcctcaaccaaagtgtcacctttcactccatgatcacacaaaaccatagttccaactttccaacgtgcaattacacatcgtcatcgtaaactaagcaaaatggagccggccggttagcttgctcagatgtgcacatagtccattcattgtggataagaaaatatatggccgtatatatccggttggatgtgtggccaggtaaaagaaacccttctcttaaaaaaaagaaagaaaagataggtgtcataccatggccttggttttggagtagaatgatccgacgaagttgggcgtgtcctcctccttgaacccgatccctgtgccgagctggtggccggcgtcgtactcgaagatgcagcccgtggcgtagttgatgagcacgaggccgcgggcgcggcagacgtcggcgagcgtaagcgtgccgcagacgttggcgcggatggtctcggtgcggtgggtctcgcaccagtcgacgttggggcggccggtgacccccgcggcattgaacacgtgggtgggcgcgacctcgtcgatgtcggtctcgagctgggcgcggttctcgaggcgcccggcgccgtaggcgaaggggatgccccgcgcggcgcagagctggccgagcaggcccccgatccacccggtccggccgtagatgaggaacttgtacgcctgcgactgcgcggtctccgccgactccgaggtggaggaggaggagccgttggtggcgacgcccatgcccgacgacgcggcgcggaaaagggtggcgcggcgcggcgcggcgagatccggatgggaggtgggaggccaggaggggagagtggaaaatggagcctgtctgggagggaggagaggtgaggtggagaagggggatggattttaatagctaccgaggtgagctgatgctgtcaccgatgtgcgcgcgggtggcggggcggcgtgtgctgcaccgacggtgacgctgcagcggtgtggtgcggccctgcagcacctggcgtgatccaccatgatccatcgccgattcgtctgtgcatccgcgtcgcgattttgcgagagaaatgccatccaccgacaggcgcaagcgcaagacataccactacgtactgacatactgtgcgcgcgagctactagactgcacgtctgtaccagtatagaaaagtctggctcccacagcgtggagtcgtgaacggtgcgtttttattttagagggcggaatttgcgaggggtggtagccggcgggatgatcgggggaagcgagcatgcagcaggggccatgtgatttggtggttggggaggagcgttgagacgaggcctccacgcctctggcgacgcgcacgcgctgctgctagcgcgctagcgacaaccgggcgcggtagatccaccgatcccaccacacataccgcgagtccgcgacaagtaataagttgcatcgcggtctcctgatctatccgatctcttccctttggttctcaaggaaaacgaacccttgtaaattcttacttttcgtaccaccttgtgtaatttttttttagataacgaccaccttgtgtaattctttttttagataatgaccaccttgtgtaatttcgtggccacttcattgttctttgaatatcacggtcactcgctactgctatctttctcagcaacttgctggtattagctttaggattttgctaatggaggtgatttcttttttaataatggattaagaatccggtctctacacaatgtacacaaccaaaaaacgaaactgaataaccgatgctctgttcgtcttttctttttaaggtaaagagagaactttattaatgtgtgaataagggattacattcttggttcattaagtctaggattcttgtgggagtacacagccttcactccgcatgcacaagatcattaccatttgggctaaaacatgtgctaccatatttgcttctctctttatcttatgcacttgcacttgttgaaaacactgcattattcctttaatctcttcaatcgtcatcgccaagccgatttcaaggaacctgctgttttaagtctttggctatttctacattatccatctccatcacaattggaatgtggatcagttcaaccgtcgctcgaagtcattcagcctgggcagcagagccatagtgatgcaaggctttgtggtcggcaagtagcaccaagcccctccagtccttgaagataaacccgacacttgcatccccagtttctttccctatagccagcatcaacattcagttttcattctggtggagcacaccatttctctacctgtctgtcaatacttgtagagagaatttctggtttggttctatacacaaagggcccttccctttgtggtcatcttccctttgtcagattggcaatagttgacttcatagcttactaggaagctaaccgagtcaactattgatgcatttcctttaccatggatcacaacatttcgcaggtgctaggctcttcaaagtaaatacagaacatgtgccttcaccaatctgttcaaactatccagcatcactagcaaccaatcaggccctgtccatttgaaactcctttcttccggcaatacccagtgtgctctcattgtctcctgtaaacctctagccacagtacactccaccgtagcatggacaccatttgcttctgtcagaccatagatcgggcaaatgccactctgttatatcttttgttttctcttgtttccccaagtgagcagtctgtcttgggctagcttccaggcgaaaattcacacttttcgttggacatttgtttgtcatatattcttctagatcttcgtctctccatctgttgccgagctagatgaatattcaatgcatatctttccggctagattctacgctaacttgtaagcactcctgacagtgaatattcctatcttctcaaggtgccatgctgggaaatcaggcatctccctttcgggtattttgatcttttaggatttcagatgcatcattttccttgactacatgtctaattcaaggttcattccatgttttggtgtcaggattcatgagcttgtgtacatatataagacgattccaggtcttcttctgcaagatctttggtttttccccatgtgcaatccattggctcctccagattttggtttggcgcccatctcctactctccatatcaaacccttgttcagcaattctagcccatattcaataccttttcaggttggcgatgcatcagaagagtaagtaccgtaagttgtatcagttaatgatccatttggataatatttctccttcagtacccgagcacacaagttttctggagtatcgatcaatctccatgtctgctaagtaagtagggcttgattaaaacatctaatatctcgaaaacctagtcctccgaataacttgggactcgttaacttttcctagccaatccaatgctctgttcgtctgtttgaagtactggaagttgcacttcggggatccgatgataataggaagcaagcagataaaaagatcaactcaaaatttttgccgggtcggcgaaagaatgccgaccaaatttcattaagattgggagtaaaatacatgtatcccgacattaaattgtcgagtcaaggcaaaagccttgaaacaaagtgagaaaaagaaaaggggagaactatttacagaagcagcaactcaaaggtctactcctcactaaactgaaaaataccggcagctctccagaccatcacatcttctttaatgtctgcaacgagcgactccacagctttctccttttgatcgaaggctcgagcattctgttctttccaaatccgctagcaaaccaacatgaagaaggagtcaaaagcatctctgtagctgggctgacaacagctgcgcgcacgctgccaccaaaccgccagttcttctccactttggccaggcagatcaaagccaatacccagccaagttctcaaaagtgaccaaaccctgttggtgtaggtgcaactggtgaaaaggtgtttgcaatcttcaggtgccgacaagcaaagaagaccgtccggaatattccggcccccccttttggctaaattaatccgcagccaaccttttgcctttggttgccacccaaagaaaaaatctgactctcgccggcgctttggtcttccaaattgcttccccaaaagggcacttagttgaggtaagaaagaagagatcataggctgaggacacagagaaaactccattagcagcaaacctccaaaccaccgaatctctcacaccctcctggacagccactgattgaagttcatcccaaagagaaaggtattcagccagagctctgctggaaagagaaccctgaaggtccctgaagatcaactcaaaattaaaaccaaaaagaaagaaaagcaagacggtacctgcaccggcattaataaagacagcgaaaccgtgtacaaagatgacagactacctacacatcttataaaggcttaaaaacaaaccttacatgcaaagagtaactgatttcagagtgattggaggcttcaatctgacaatatgtagagcatgttcagacattatgacgctaccattaccacacaaaatacgtaacgagtacagcacatgaatacagaatacttgcttgtacagtacatcggcgttggcttgattgaacccgttacaataaaaaaaaaagaagggaagtatcaaatagtttgagtgaaaattgtcagttcaaatcaaggttctcacacgtcagtacaaactgacggttcgttgtttgaccgtttaagatcgaccccaatcaccctgatcgccagtgtccagtgaccgttaattttgcagataagtactcgcttagtgtggcatatcaagcactcagtttatgcataatggcaaactaggttataattaaggtttggaatgcactcgttactccaggacatggaaccatgaaagtatcacggcatatcataattctagaacaaaaaagtttctggcgtcagtaaatttagtgacaaacaccacatcattctttataggtagcatagcattcacaatcgtgcaaattagttaataatgtaatttcaacgattacaattagcatttccgatctataggatgatcactaaagataatccagagagaaattagcaaatgcagcgcgctcgtgtatcatgcagagaagcagactatggttctattcctgatccttcagctatcatcctctccttttggatcttgactcccatgtacctgtcagatttttgcagacacgaaggatacatcaggttgaccactgaactatgcaaagaacattcctggcacgaaatcaaccaatgaacagttgaacacagagagataggagtatacctgccaagcatcatgacggtggcctgcgggttagtccccggcgaggcgttgaacgtggaaccatcgatgacgcgcagcgcctcgatgccgagcacacggtagtcgcggtcgacgaccctgccgacctggcagccgccgtggtagtgccagatggtcatgacggtgtcccggcagaactgctccagcgccctggggtcgctgccgccgcgcatgcgcatcaggttcgccgggaactcggccgtgacgttgatcgtcgccgggaaggcgaagttcgggtacgcgaaccgcgagaaggccctggaccggatgacccgctcgatggtcgcgatgcccgcggcgcagcggcggaggtcgtcggggtggctgaagtagttgaagctgacggtggggttgtcgtcggggtccaggttgcggagcgcgaggcggccggtggactgcgggccgagcaccttctccaggatgaagccgccgcggagcgccgcgtcggggacctggctcatggcctccacggcgcgcgcgatggcctcgggcgtgcgctgcttcggtggcaccgtcgcgagctggcccgtctgcggcgagaacatgccgaagctccgcacctgcgcggcggcggcgcccgaggtgcggctgttccagtcggacccgcttgcgccctcgatgtagctgccgaacctggtgatgccgaccacctggatgagcgacagctccaccggcgacggcgacggcacgtagatggcgttcatggggttgtcggacatgccctgcccgacgcctgggtggtcgaggacgaggctgatgccaaactcctcgaggtggtcggcggggccgacgccgctgagcatcagcagctgcgggctgcccagcgcccccgctgacaggatgatctcgtttctagcgccatggttgaggtacgccatgtgcgatccaccccgctcgtcgtggtacagcacgccacgcgccacgggcttggtccctgcaaatctcgcgcgttttcagtgcgcgcgaactactatggcagtacagcgcagcggcaccaagtgcgtgccagtgccacaacaattacttgccgtctgataattaacaaacttaccggtaagttggtaacacgagcttttgaacaagaaaaatgtggtttttctaaattatgcgtgacatggcctcacctttgcgagagaacacgatcctggccactctagcacggagaaacacgtcgatgccgtcggggcgcgagtaaccagcaagtccgccgccgtgtgccgccgtccctgcgcgtcaaagatggagccaccgaccttggtaccgaggatgtggtcgtacgtgaagccgttgtccggcacgacgccgatctcgagcaaccccctccgcagcgccgcctgccacgggcccagctccggctggaacgccaccacgtcctccacccactggtacgcgctcaccacctccttggggtcccacccgagggccctcacgtagccgggccccgcgcgcgtgaagaagccggcgttgatgcagctgccgccgcccagcacccgcggccgcgcgttgatcacgccgtcctccgacacgaaccgctgcgacggggacgccccggacgtgtccgcgagcacgtccgcgaagtgcgccatgttgaggacgcgcgcgtcgtcgtacggcgagcccccgcgctcgagcaggagcacgcggtaccgctccgacagcgtcgccgccagcgggcaccccgccgtgcccccgcctatgatgatgtagtcgtagtacgccatcaccggcgcctccaccgcctccctcatgaacgtgtagttcacacctcgcactgtcacacacacacacaccatgattacaagaatcagtaaaaatcagacggaccaagaaatcaaaaaacaagactgatcaccttgttgagagaagcacagcagtagctgcccaaacagaaacagggtcgtggcaacgaggaatgccatcgtctgcgtctgtgctgacgagatcaggaatgtgcgtcgtgtttgatgtgtttggcgtacaggatcaggtgtgcttatatactggcgagagatgaatggtttgctaaagaaaccgttgttgcatgggccgttagtctggtttggtacggtttggtgcaagtggaaccggcctccggccttcatgctccgcagcctttgtgtcagctcaagtgttcgacagattcggatatgttaatcacctctgctccgtgcttgtctgcttattttgtaggcgaatgagaggagatgtgggaaacgtaagattgaaatacgccatcctcggtttatggcgtaattatccagagcgtatctgttgtcagaatgcatttctgaagatgatatgtcgtagcatcataaaacaacaaactacaggcacatgtcagattaaaaactgttctttctcgattacacacacatacaccacaaaccacaagcgcacactacgtgcaacatataccgttttagtcagatatatatgaacacaggtgtttgttggagtattatcatagaacagtataatgtctgaattctgatcactggcgaccatgtagacaattttcagcaccagatgcatgctctaataattcgctccgcagaagtatttctctactatagtctatgcacacttgactgagtcgtcctatgttgagcatgccatgagtgtgacgaaagaaaggactcagaattaagaaaccaaaacggcaaaaaccaccggtgatcacctcacttcactctgatccgcaccaattaacctttgcttggccgctgagcctacattttttttatgctcttgccgttgccctggaactcgctggtccggtgcaagcaggattgtccaagaggcttttggagcatttgatcagtagagtttattgaacatgctcttacatcatctgttaacttagtaactgctactacaaacataacctaatcttccacagatgacaattagagaccagcattagctgcatcggcctaacattttacaggccacccaagtggccaggaactgtgtcaactgcttcttgtacatacagacggagagaacagattctcagtacagggagttataggtgcaaaatgtcgcgacgatggaagctacgcagatcacgaaggacggaagcagggttacattcaggaggctgttctggccaaggtaacccgccgccgtgatcgtcatgtccgccgcgacgcgagccaaagtgccggcttccgtcgagaggagcccgccgttgtaggttccgcgcgagagcctcgacgacatcacccgggaaaggagggacaggttcactcctgcatcgttttgttcacagggtcagaagtgaaatggtggtttcagaaaattcagacacgcctcacttctgtttcagtctcttgtttactgtcacttaccttcgagcacctcagcgaagacgaacgtgatgagagccgaggagacgtattgcgggacggagtagtgagaggtgaaacggaagctcatggctatgccgatcaggaccatgatttccgatgccactaaaatttgcctaaagaaaacaaaagagaaacgagtggaaattaaacactgaggattatagtggaaaaggaaacaaaacttaatgtgctagtgctagtatgtatgcttacctgtcttggaacaagttggtgacatagctcccaacgatgacatttacaggaagaactgtcaacccaagaactgctagaaacatggccacggtgcttgtagaccagttgaagtagaacgtagtgaccacgctcgactcggacagtagaatttccattgcaaacttgagcataaagtagatcaatagctgaactttcacagatggtgtcagcaatctgtatgctgcagcaagtgatgttgctggtttatgtgagtcttcagggtcttcttcattttcgtcattatcctctccattttcatccagactctcctttgcatctatgagaaaaggctgtgctagaccatcttccaaattactatttcttcgatggcctgctatgcaaagcaaattacttaattactattttcagagcatttaccatcatgtccttggcataacttctcaaactatgttttaaactatgcaacggagaaattttacctgaatcagatgacggtgtgttgactgaattctctctaacaatgtggtctggctctttaaatgaaatccacaaccaaaataagtacgtaatccaagccaagcacatgatccacccgggcaacgtgttctgatcaaatgtaaaaccgtagatcttaaaatttgtctgcagcaaaccggcaagagcaggaccacaggccattccaagagcactagcactaacaaatcctgcagatgcctgcagcctggttttgagaggcacacagtcgctgatgtacctgcggttcactgctctggcagaacccaacctacacaacatatatcagtgtgatcactagaacagctttatattgcaatgattaaacgagcacaacaaacattacaaagtttcaggaagctaacaaaaaaaaagcataagtactagatcaaaaagaacaagacattccatacccgcagagcagccggccaactataagaacagttaaggaattcacatcatatgccaaagcatacagcaggttacccaaaaacagcataatgctgctgaacacgaggggcctgaaatatgacttatttgaccaggcactgaagtaaactgaagagaacacttgagcaacagccatcgatccgatgatcacgccgcaaacggtagctgctgctccgaggctgactgagtagtcatctgcagtcggcacgatgatgtatgtgttcaccatgtaaagaaatgtgttagctaggttcagaagcagcgacatgaaatggtagctctggtcatcgacaagatcttctgagccactatgcatatcttctggaatgataagtgcatgttgccctatgaattgcagtaagtttgttgcgtgtgtgagtttctgcaccgaatgatttatttggtctatgatagggtcctgaggcatcagaaggaaagttagttcactccattttacagcataaatgtctgatcttgtcatgtgaacatttaacaagaaatggagtacctttaaggtaattgatggatgatcatagatggatggaaagtttccttgatgatcttggagaaatgcaaggttgcgcgacaaagcaccaactacagccacaataccctgcacccataaactgcatcataagtacatgaggtgtcaagtgcaaagttataaggaacaatataacctcacagcgcaaattatgttttcgaagatgcaagaaagagaatttaccacttgcttgaagatctgctgaagctgggaacagggatggtttgcacgagtggagacgtaatagtccgtgaatttgtagccaaaacgcttatcgaatttcttgagtatttttcggatgccggtagcattcatatcaacaaatctaagagcttcataagatcaattccaacctccctatatgcctctctagctcagaaatttgggatgcatctgcttgttccatgagcaatgcacgctcttctcccaatttctcgattctgctagcaagatggccttgttgttgcagaagaaagagcacaatcttctcaatctacacaaaagaaacttgatgttaagtggtaaaacaagaacgacattttttatcaacaactcaggtcttttctttctttcatattttgaaggaaattcagtctgttttacctgatcatcaagcatccttgagaactctttaagaacctgttcacgatttcttccaccattctgcgtctgctgaacatactgttttacctttttcttcatcattttgtaattgatgtagtacctacaatagcaaaaataaataattagtaacaatatttagaagatcagaagtatggcttctgtacaggattcagtctcctttcactacctgtttccgtatattacaattcacaaatttcattcataacttcaaggaaaaggaaagggtgggcaatcaagcaacatccacattatgctcttttttttctttcaaaaagacatatacatctaatttatgcatatcaatcggtgtaagtgggccaacccgcaagcccacttataggccaaataagtgggttcgcgggtcgacccacttataccctattcagatcagtgcatccacatggcaaaatgttaaggaactttcagagttcaaaatcaacatactctttccactcctccaattggtccgccatcagtctcttcccgaaattaaccatcttggcgttttactgagggaacctgaaactgcaatggaacaattagcatgccgctagaaacgaatcgatcaagtctagtggtatagcatttacagttcaattcagaacgacaaccagtactgtttgttcagagttcaggaaatacaacttttctgttgaagcaaaacatgaagaaagcgacatagtgatgatctaaatctttcagcaaatgacctagaagcttaatgtactatacatatggttagtgccaaagtacagatcaagcctcaacatgaataaaggcataaaatctcatggtccaacatgtcagtgacagagagtacatggaaaaggacagaactttaacacaagaaccacaaagataatgttaacatgtctgcaaaagcttaaaatattcgcgacagatccagaacgacaggacacttagcaaggtgacacagaatcatctagtcacactttcagataaatctctggcctccttttagcgatgcccaactccaggatgcagaacaacatagattagatggctcaatggtgttccaagagccaagtaagcatctttcgacactatggtttgttacgtcccttgttcccacgcttccctagcaaagaaatactcaagtgcagctgcaggctgcagctagcactgtactttgaaactttttttgaaagaagacagtactaggaaaccattttaatggcacgaatccaattagcccttctcgacagtactaggaaactaaaggtgcatgcttttcctcctattgttttggactctgaagatactactccctccgttttattttaagtgcagtcgtgagtttccgtatccaacttttatcgtccgtcttatttatttttttttaaaaaaaataaaaaacataagtcacgcataaagtattattcatattttatcataaagtattattcatattttatcatctaataacaataaaagtactaatcataaaaaaaataaataagacgaatgattaaaattagatataaaaacttatggttgcgtttaaatgggacggagggagtactccctccgtttcataatgtaagactttctattattgctcatatttatataaatgttaacgaatctagacatatataaaaatatgagtaatgctagaaagacttacattatgaaaaggataaagtagtaaactagccattacgctcggagagtgaaccatcagctgaaattctgaagtaggtctattgatcaaatcacgagcgagtgtttcttttgtaaatacccaatgtaagtatactcatcaaccactcaagacatgactcccatgtcctcgcaagaagaaagacaagaaaaacagaacacggctgcatgctagcgttagcctttaggtgcaccacctgaagtcagtgacgatggcatatcaccattattgggatgcgcattgcaagtgactcatgtttgtcacttcttcccgttaattcaccatcgccagtatggagagacaggaaagggctagaaaggcaacttaggttggcattgccaatcagaaagcaagaaaatggtaagaaagaagagagcaaagattgaacttcgggcctaaggcatatagattatcacaatcacaagcaattgaagcaaaaacgagcccctaatccttatgcaaatcgtatttttggcaattcggcatagcagaaattagaaaatattagttatctctcatcttaccgcgcgttcttcggtgattccctgatttcgtcctcctcccggcgaaacgatctctcctcctgttagatgaccatcaacaaatccaccgaatcgtaccaagcgctgaggccagaattatcgcgggaatccgtttctctcctccggttccagctgcggcaccaacgaatcattgtatgcacacccaagaacacgatcgaatcagaaaaccacacacaacccaaacggaaagagagaaccacacgcgcctgcatgcatgcagcgggtgcggagatcgcttacgaggggatcccgtcgcaattcagaggacgcgcccgagtgctgcaacggctaatgtcgacactgtctgtgtgtgtgctgggctccgctcaggggagatgaggaggagagggccggggggcaatatttatagcggcgactgcgggagagagaagacatggaggagggggcctcctcgccggggctgtggccgggacagccataggtatgcgtgtgtggaggcctggccgtcggtcgtatcgcgcgcggaggccgacgtggagggggggatctcgaccgggacggttccgttttggcgtttgcgtggccaaaaacgcctcgccatccccctccaccacctaggcccctttggttcttggctggctggcctcttgtgtagtcgtgtgtacgtgcttacgcacgttgctaccgcgcgcatgcggtgtgtgacttggcttggcttggatcaacttggctgcctcagggttcacaatcttggaaccaaatttatgagattttggatctatcggtggatcccaataggaatataggacacggccaaatatattgtgcaaatacatgaaaaatatttaaattcaactaaaatttgttcaagttgcaaaacttttgtcctctcacccaaccaacacacggagagagagagagagagataaaatactaactttgatacagataattcgagtcgggtaattaaaaccgctcaatccttgattcaataggttaaaaagtgtcttcaacctaccgggaagcatgatagtcggggagagatggcaacccagactcattgacatagttattaggaccggaccgaacattgagctggtcatagcctcggttcatggtttgattggttcaaccggttgaaccgccagctcaacacaattcatatggtctgagatatgcactattatcacacaacccaacatagctcagtgatggggttgctcgtatgaaatgaggaggttgaggattcgaatcccaccacacaaccttttatcatatattttcttctctctatcccacctgcgccccatctcctcaggtccccaccaacgcggcgatttaattgacctcatcgactagtccttgatgggaaatatcgacaggggatacccgtataccgggtagtgtgagtattaaagtacgttggtacgaggatctacatgattcgacatcaagcagacaaagaggtaatgattatactggttcaggccccttgcaaggtactaacttaataggttaatagctaccggatagtatgagtattgaagtacgttggtacgaggatctacatgattcgacatcaagcat

SEQ ID NO: 73286 - DNA, 2748 bp, Oryza sativa
cccctacctggcgcgccactatcgatggggaatacccgtagaccggatatagagggtactagggtatgctggtacgaggatctatgtagtacgacatcaagcagataaaaaaacaaagattatactggttcaagccccttgataggtaatagccctaatccagttgatatgagattatatgatggaaaccacagattagaaagggaattgcggaactcgatgataccgacgagattgtaatcgaacaggttcaattagatctcacggcgacttggcttctgtaggcttcaactccgtaggctgtggtggatgtgttggctatgagattcgatgccttaggtcctcccgggggtcccttttatatcgcaggtcaaccggtctccaagtaggactcggagacatcgaacccgacacgatacaatgacgacccagttctgtccgagtatgactccttccatctgtgaactccgtgatgaattttcttaacgtatgccggaaccgtccgtattcgcgcaagcatacaatatcgatatgtgacgtatatcgaagggtagagggtataccttacctataaccctgataacaaccactatgcataaacttgtatggtagatgcaaatagatgcaatatctatttggccggatagatagagtaatatgaaataaagacatgtgaattgggtgaaaatttcttaaaaccctataaattggatgacaaattatcggtctgaatataggatacctcgtactcatactttgagtacaaatataccaaaatatacaagtacaagtatgagagatatcccatatccagaagacacaaatagtaaacaatgattacttactactatcttcgttttttaattagtttttactaatacatttaacggttggctttctcaagcaccaatattttgagcaaaagtctaagaaaagcattccgtagcgacaagagccgcagaaagtgaaaaactaccgtagtgaattaggagcgcaacaaattaaggggtaaactgacgacaaattaagggatctaaggtgaacttattccataccgtaggaggaacccgcggaagagatccagcccagtagagcccaacctggtacttagcagccctgaccatcatcagaagcatggggctgcaagttttccctgttataattaggagcgcaagctgcgcaacaaatgcgactgtaaattctgtgattaagtattaactagaaaatcagcatgtttgttggcgcaccgaccagttttacttttatataagtttaaggatcactgcagcatatgagttttcgtaaaattcgttaaaaaaatcattcaaacatctctatggattttaattcttcgtggaactaatcaaattacagtggggattgtctacagtgttacagctgtagtagcagccgctgacatgtgaaaccggcactgctactgcaaatacagtactgcagagcatccatatccatcaaattaggatagtaatatatggctgaggatggcctgtttaatttttacctagctgtgttcggtactcttcccaactctcctctctcgttttccgcgcgcacgtttttcaaactactaaacggtgtgtttttttgcaaaaagtttctatacgaaagttgcttaaaaaatcatattgatccatttttttaaaaaaattagctaatacttaattaatcacgcgctaatagaccgctccgtttccgtgcatgggagatgggttcccaacaccaacctccgaacacagctagagtacatttctctttacgcaatcttttattagatatttctctttaaccattctttagccaatatttttgttttcaaccagataattttacctttgttacactttggatcaccgtgactattcttaaccgtacggatctcaaatatactagccactaagagtcgcgcgtttgcgcgaccataaaaagccatctttgttaaagattaaggttgccttttttttcctgttgcaactaaaatgatcttggccctaaacattaatacgaagttgcccatatgttacatacatgaccaccgtagtatttctttttttttcacagaaacaatttatactacctatgtttttaataaatgacgccattaacttatattcacacggttgaccatttgtcttattaaaaaatttacatatttctaatttattttattgtgagttgtgttacaaactgaaagtacttcaagcatgatatatatcttatttatttaaaaaagaatttggaagacaaatagttaaatatgtatctaaaagtcaatgatgccatatattaaaagacaaagggagtattgttttacttggtccatgtgtcaaatttcaaaaaaacccaacttatgaaattgaagcccattaagtttcataagtgtctatctgtgttgcttgctctctttcatgctggcaagtacgtgaggagaggcactagaaggctccggagggataatgcagtacgtatttgatcggacggtcaacatttatccaatcatgcatctgatggcctttgttttttagcttacgtggcctaatgtgcttttgagaaagattagttccttcattactttagactagctcctacttgtcaatgaaatcccatagccgtatgtagataatttctttgacatatgacaaattaaaatcatatggataaaagacttgatagtggttcaaggtatcacaaatgtcaaattattcggttcaaattaagtgaaaattagtt

SEQ ID NO: 73287 - DNA, 7496 bp, Oryza sativa
  unsure (1)..(7496): unsure at all n locations
tactactccccctgttactaaatgctaatgcagcaggcaggcgtgtcagctactcagctggcaagaataattaatgaagggccggagtgttaaggtttaattaagcaaaccgcctggcaagagctcatgactccatgagcgagcggcgagccccatcaaacaagagggaaagaaaagaaaagaaaagaaaacaaaggattgattattgggaggaagaagcgggctgacattcctgacaaaatgtcaagctggaatggaatcatcccgagcttaggattccttgaaatttggcaatgagctgcagtgggcactggagtggacaagtgcagttgatgagtgggtgctgcaaaagggcgtcacatcttctgatctagtactagtccgtagtggtagtaggtactgtagctgttgtagatggagaagtcgaaagaaggtgatgagtgtgcaggtgccatggtttgtgcttttgaaagggggaggaagaggaggaggaatcttggcatgatccaataatccgtccatgttacttgcaccaactcggaacagcgttcgaaagcaacccattgattgccgcctggccctagtaataataacataacatgtctttccctgtctctatctaggagtatctctctccctccgagtacagtaatctctaatgtactatctatctataactaaaaaggagggagatgagatgatatgagaagcagcagagagacgtggtgtgaatgtgatagcatagcatgcctcctcgtgctcatgctgcctgcctaacaaacaaacacaacgcattgttgcatggtggatcgtcatcgtctcacagggttaggagaggcagcgacaggaaggacaaacagcaacaacaacaacaagtgaaacgaaggaaattgacggaagcagcaaaatacttgcctgcgtgttgtaggcgtcggggagcttgacgatgaaggagtgggcgttggcgaccctggcggcctcctccaactcctcctgcgtggcgccgtccctccccagcagcaggttctcccggatggtggtggcgaacagcgccggctcctggctcaccagaccaatctggcggcgcagccaccgcaggttgaggtccctcaggtcgtggccgtccagcaggatggtcccggcgttgggctcgtagaacctctcgatcagcgacaccaccgtgctcttccctgacccggagctccccaccagcgcgatcgtcttccccgccggcacgctcagcgacaacccccgcaggatccccacgtctggccgcgacgggtacgagaactccacatcccgcagctccacccgccccgtcaccgcctccagctccaccccgccctcccgctccatgctcggcttgtgctccatcatccggaatatcttcgccgccgccacccgcgccttggcgaacgccgccatgctcggagccgactgcccaagagccctgcggatcggattggatttttgttttgtttttactctcaatccggccaatcggagtacgtatatgctacggagtactacaaagctttacttacaggccgcctatcattactgagaacatggtggcgatggcgaggcctccgttggtgtgggcgcgtcggacgaggtgacccccgtaccagaggagcagcgcgtagcagcagaagacggtgaagtaggtgccgcccagtccgatgcccttggcgaagccggagcggtagccgatccgctgcgccacggccagcgccgccgagtaggcccgcatcacccgctcctcgcccacgaacgactgcacgatgcgtatctgcgccagcgcctgctccgcgatgccgctggcgtcggacagcgcgtcctggctcctggaggagagcttggcgagcgcggcggcgctgaggccgccgatgacggcgatgagcgggacgacggcgagggtgacgagggcgagctgccaggcggcggtgaatccgacgacgaagccggagacgaaggtggcgaggtagtggatgaggttgccgagcttctcgctgatggcgtcctggacgacgacagcgtcggcgttgatggcgtggatgacgtcggaggtgcggacgtcggtgtcgaagaaggagacgtcctggtgnaggcggncgtgaaggtagcggatgcgcatccgggtggactgccgctcgccggtccacatccagcaggagatctcggcccaggaggaggcccagatggcggcgccgacgacgaggaagtagaaggcgtacttgacgacgaggcggagcatggtgtccgggtgggcggcgtgggagccgaaggagtcgacgaggtcggcgaagaagcggaggaagaccgggagggagcagccgtggacgagggcgcccagcgtgcccagggtcatgaggacgtagtcgaggccgtcggcgaagctgaagagttgacggagcggggccggcgggaggggcttgggcggtggaaggtcggtggtttggatgtggggaggcggcggcggcgacttaggaggaggaggagtaaggggagcaggtggcggtggcgctgctgctgctggtgcatcaggttgaggatgggattgtggagaatggtggtggtggaggaggtgcgagtgcgggggctggtcggcggaggggagatggaaggcctcgagctccgggtcggcggcggcatcggcgccgaggacgacgacgcggccctttatctcctcctccatgcctagcctaccgccgccctgcccttgctcgatcgcactctgctctgctctcctgttcctgtactaataatctcttgctgctctgctcttctctaattctagctctacttcctaataattctagctcaaccctccaattcttgagttgacgagttgctcaattcctctcttcccatctgtgactgtgagcaaggaggaggaggaggattgccttgcctaatggcttatggctggtggtaagaggggacgacatgtttataaatagagagactactggactaatagaaaagaaaaggcacgtggccttgcacaacaagcctggtccactaggccacaccaagtcggcttctagttctacaccagccagccctttttcccttcatgtagagtagtagttatccacggtaatactcttaccgggtgtgtgtggcctccttcaacctcaccggccgacccgcccggagccccaagctcggagctccggtaatctctctctctctttccacggtaatataatatccgcaggcaggcaggatgttgcagttggtcctttcacatattgttgcttcagagttcacacgagctaactaccaatcatccaaaccaaaacctaccacatgcttcacttgacaatataatcaagcttttatttccaacgacgaccgacgaccactgtcacaaatcactatgctacgtaagaagtagtagtatgcacatgttgtcgcactccattttcactgtacgcatttgtacaactcgtactggagtactagtatgcatgtatgcgcatgctggactagctgctagtatatactccctctgttttgaaatatttgacaccgttgactttttagtaaatatttgaccgtttgtcttattcaaaaacttttgtgaaatatgtaaaattatatgcctacataaaaatatatttaacaatgaatcaaatgatataaaaagaattaataattacttaaattttttgaataagacgaacggtcaaacatgtactaaaaagtcaacggcgtcagacatttcgaaacggagaggttactccctattacgtactcgatcggtactcctaagcatggctgtgcatagttcgtgtgccaaaattctttttaagtatacggacacacatttaaattattaaacgtagattaataataaaatcaattatagatttcacctataaactgtgagacgaatcgattaagcctaattaatccgtcattagtcaatatttactgtagcatcaaattgtcaaatcatggcgtaattaggctcaaaaattcatcttacgatttacatacaaaccgtgcaattgatttttttaatccatatttaatgctctatgcatgtgtccaaacatttaatatgacggaaaagttaaaagttttaaaaaaaagtttaaatctaagcacggccaatactactagtactactcctcctccaatcaaaccttcaacacctacacagagtgcagacagagttgctagctaggtgccgcccgaccggccagcagtctcaaatcttttttttttaagaaaaaattcttccaatacttatgctaactgccacagtcaccaagtccacccgtacatatcgatctacacctatatctctctctcgcaccaaaccattcctgcaaactttctttcttcaattttaaaacaaacccccaagtagcttatactagtagtatttctttctaaaaagatatattttcatcacaaacacccatggaccatggtgcatggtgtggtaattttatactcctactttatggtacgatggtagtaactaatttaattaattactattgtaactgtatgccacaggtgatgcacggccagccaaatgcttgcaacttacgctgattcacgccaacggagaaaatgttatgtggccaatcgctttacttatcttatggaaccacgtgatctctaacaatgttgtaccattacaacaatgtcgtcaaccatcttatcgcaccccaatccattccgctcacgcattgcacggacggcattgcggtaagtcattacatggcttgtacgcacaatcataagtaaccaacatttatttactgtactatatacttactatagtagcacatttaatttgacaactcaaaaaaaataaagaaaagattagattaaaaaaaagtaagtaactactggggacaggggcaaatccagcctagagacaaagctggtgtcggcctatgctaatttttcatcatctcaacccgtcatggtgaaaaaagagtctcgacccatgggctttcaacaccagatgggtcatggcggtttgggtctgctccttactaagggatttgccagttctcatatgattaagattcccctgtcacctttctcaaggaatcgtcgtcaaactccaagcaaggaagagggagaagactcaccaatggcaacgactcctcaacaatggtgacgaccagtagcgaacccagaataaaaattaccgggatccaatgcgtaccaattatctaaatttttacttatatactaattaacatcatataatttagttagaattgaataatttactggggtccgaggaaccgggtaaatgtaactaggatcgccactggtgacgatgtcgaaactcttacgaataacctagggtttaggtttccagggtaggggtcgtgagggaatggccgtgagcagtggtaagaccggcggtgggtggcggagtacatgggcggtgggtaacggagatgccaccgaagctgtgtagttagaaaagaatgttcaaatatatggacatctagatataatttttccataaataaatcataacattaaacatgtaaaccaatagaaccatcttaaataaatcaaacatactaaacatgattgatacatctcgacgattttgattctattgtggaagtggagcagcacaacgcactgcacatatatacagtgcacggtattggatattgatgatgcacaacaccctaacgtagatgaagatgagtcgttgtggacgaacaacgagcagtcgcacgagcgattccaaaaatccttattagtgccttctcccgatgcaggatgtctaagacgaaggtttcagagatatgcggaaggttgtggccgtacggcggtggagtgagatgtatggttgtgacgcctgccttattgcccgtgagctgtatgcggctagggttagaccacaattagtggttagctggtgagttggtggagcagtgggctatttgggccttgtggctgtggttggaacgaactttgtggtagtcaagtattcgggtaaaatccagatatttaaaaaggtaatatccgtgttttataccagataacacgcatatgtaagatatcgtcatcccaaacccgatcttatatccaacagaaaatacctatatttggacctgaaaacagtaaaaactcccgaatacctcaatttttaacctaaaattgtcacaaattaatacacccgggcaggcgatcaggaaatacccaccctgttttcacccctagccagcaggcatgaaaagtagactacgagcaactacgcggtagagaggagtatccaaaaccctataatttttttgcgtgtgttgcatagaggtggtggctcgatatttacaaagatataagaatgcatgatcaggacaccatacaatctccatcggataagctgcgtgtaacctatctagagattcctcgccacttcacgcaccaagaatgcgatgagtttccaaacaccaaattatgcagcaaaaccaatctgaaaaaaaagagaagtcgtgtctgcataagcataagaaaccatttttgtggaccattcacacgtatgcctaccaaccggcctgtgcctagtgaggcgagcgagcacgtgtgtgtcccgtaattctcacccccacacattacttaagtgcttagaagagcgctttctcttttaagaaaatcaccctgttttggaaaaggcaaacatagtactaaagattaaaatacatcccttcccatgagatgagactttgtgattttcttagaaattaatcttcgtatgagtcttagcctacatattaattcgagtagaggacgtcgggcagggtcgttagcagagggttatatcctggatggttagtaggcggaggcaacgacaagatagtgggccaatgggcgcgatggggagttattgctttctggtgccgacgaggctaagaggtagggcatgggggtggggggagggggaaagggggtatgtgttaggtggttaacgaacacacgtcacgatggagaggagatgtgtgtagtgggagaaatgcatgaatctggaaagcaatatagctagtgtaaatttggctgaaatttatggttgtttttagatgactataaactagatctcttatgattatgatgatacccgtacattttagtaaggcaagacaaacctagtagtccctctctctcaaaagagatatctaaccctagagtgaatttagatttatcaccggaattgggttttttttttacaagggagacagggacccatagcctatattttttatataggcagacataagttgattttttttttacaaaaaggcgtatgtgttaagtagtatgccgtgtatatacgatgcagatgcaagcatgttcagcgtcgtacgctcatcgcagattaccgaagcacttcctatatatatatatatatatatatatatatatatatatatatatatatatatatatataccagccagttaatttgcttcgcggtatacaagcacttttaagcaaggcgtatt

SEQ ID NO: 73288 - DNA, 3374 bp, Oryza sativa
atgaataatgcatgaaactgagtttataaaattatttaatggcataaataaataaattaaatattataaagttgaatagttgatttaaaaagttattagaaatgatgatgaataaagttttttagataaacatatcatttagaagcttaggaggcttgtccttcaatttgtaggtagaaaaagaacgtgaccttaatttctcatatacttgcaaatttatatgataattaatttgaatgtcccaaacgacgtaagcagacagtactcttttgaagtataggaatacttgtttaatttttgtgtgtcgtggtgcatcgatctgcatctgcatgtgagcctcactccctaactatccttttggttaatgtacattataatcgagttcactttacaagttagtggtgtgttgccctttaatttgtctttctcgtgcatcaagctaattaatttaggattgcactacgggtttcacgatcaaatgaaatctcttctttcttccaagctactcctagcttaatttatagtagtaacttttcttttcatgttacttgctaactcagtctgtgtttagttcgtgtaccaatttttttataccgacacatatttaaagtattaaacgtatactaataacaaaacaaattacagatttcatctgtaaactacgagacgaatctattaagcctaattaattcgttattagcaaatgtttactgtagcaccacattgcattgtcaaatcatagcgtaattaggctcaaaagattcgtctcgcaatttacatataaattgtgcaattgatatttttttcatccacatttaatgctctatacatatatctaaacatctgatgtgataaaaaagttaaaagttcaaaagaaaaaagtttaaatctaaacacggcctatttcttcagcggtggcatgcctgcccttctttcctctgtcaccaccgtacagtacatacagagggaaaggaaagctggtcatgctaccgcacgaaccaattttttaattaagttaatggatcccctttcctttaattaaattttgatttttgaatgatctctgttctgtgtacgtaagaccgtagaggccgtccgtccggccggccatacgtactgatagagcttcttcatctgcggtgcaaaaatattgtctgaagatcgaacttattgcatatctcacgtgtatacttcctcccttccaaaataaatcaacctcattctcattgtaaaatatcacatccggtacaacttggtttaggaggtgtttagatctagaggtgtaaaattttagcgtgtcaaatcgaatattatatagggttcgcatgggtgtttggtcactaataaaaaaaactagttacagaatccgtcagtaaaccgtgagacaattttattaagcctaattaatccatcattagcaaatgtttactgtagcaccacattgtcaaatcatatagcaattaggcttaaaagattcgtcttgtaaattagtcgcaatatatataattagttatttttcagcctatatttaatactttatataggtattcaaatatttgatgtgacatgaagtagaatttttaacagggatctaaacatgcccttatattgggatgaagagagtactagctactactagtcctagaatatatatatcacatcatgtatttttttggacaagtatattatttcctcaatcccataatataagggattttgactttttacttgtactgtttgaccattcgtttgattaaaaaaatttggaattattatttattttatttgtgacttatttattatccaaagtactttaagcacaatttttcgttttctatatttatataaatttttgaataagactagtggtcaaacagtttaagaaaaagtcaagatccttatattatggaaggagggagtatttgtctgtcagtcattaactggcttatgcaggttgattttaattaattccctatcactccactaggactccgaggctgtacagacccatattaagggtgcgtttagttcatactaaaattgaaaattgaaagttagttaaaattaaaacgatgggatgaaaaaattggaagttttgatgtgatgagaaagttgaaagtttgaagaaaaagtttataactaaactcggcctaacttactgtccgactgtatacttaccgtcagatatcagctggttgtgatgacgtctttggttatatagttattggtaagtttgtagaagcctaaagcagctttagtttctcacacaatctccagtttcgctaaatagtttagactatcacctagattctaaaaatatgtagttgtacgattcaaaagatgaaaacgcagtttttttcatattattagaaattggctattaaattcatagaatctctaaggctgcgttcattgctgttggttcccaaactccatccgtcttgttttccacgcatacgcttcctaaactgctaaacgatatgttcttttttaaaaaaaagtttatatacgaaagttgcttaaaaaatcatattaatccatctatctatctattatattattaagacagctcgaaaagaaggcaccacgttcaccgtagaggtctagaaattaccacgttaatcggagaaaaagaaaaaaatttcgaccgcttgatcattgatagcctatattttaatggctgagatttaattaaatttttggaagattagacttggtttcacgtagacggacataccaggcactagaaaccagacattcatatcagacacggattgacatgtgcagtagtaataggacaccaatacgattgacatgtgcaggatttttagaatttgtattatgtgtagtatacggattaacagttttgaaaggaggcaccacgttcgctgtgggggttagaaatttccacattaatcggagaggaaaagaaaagaagagtctaagtagaaatacaatttaaaaatagctgaaattgaaagatgagtccatataagaacccgatacgagattaatcgaaattcagaataaaaacaaaataaaatccgaaattataaaagaaaagaagagtccaagtagaaatacaatttaaaaataattaaaattcggaattaaaaataaggtatattgatagaagaatccatataggaacccaacacgagattaattaatattcaaaataaaaataaaaaaaatccgaaattagcaaaaagaaaagaagagttcaagtaagaatacaatttaaaattaactaaaattcagaattaaaaataagcgatattgaaagaagaatccatataagaaactcaatacgagattaattaaaattttaaataaaaaataaaataatatccaaagttagaaaaattaaaaga

SEQ ID NO: 73289 - DNA, 612 bp, Oryza sativa
ttcaaggataaattattccactgttccagcctccaggaggtcccgacgcatcgttaatagtccttagctcactgcaaatattttgttgtgaggaacatggcgcaaagttcactgcaaaatttaccatatgtattttccttagtctatgattcactccttatgtaattaagtcgccccttccctcctatttctctctcgacggactatgatccattgttaataactttttatctttatttttctcctcctaatataaccggcagtcctcctgccatataccatttcaaaaaattagtatgatggttattgcatgtggatgatctgaatatcaaaagtaaacagcgctgcatcttttagcttttgtatgttattggtctcaagattttgcatgctagatcacaatgtaatcttcatatgtgcttatagccattctaaacttactgtacctttgatgtggtttgtctcttcagttgacaggagatatacatgaagaagtggagaatcataaccgaatgctggacagaatggtactaatatcctgcaagatgctatctttctttgcactactctctaatgcatttctttgctattttaggtaatgatatggatgct

SEQ ID NO: 73290 - DNA, 2092 bp, Oryza sativa
agaggcaaggattatactggttcaggctccttgcaaggtaatagccctaatccagattatatgagatatggcaaggattatactggttcaggcccctcgcaaggtaatagccctaatccaatttatatgagatatggaaatccacagaatacaatagagaacaactgattccgaggttaccggcgagatccttgttgagagagtctcgacgagatctaccggcaagtaggcttcaagtaattcggattgcttttgtagtggcggattggctggtgctatgattcgataccctagattcctcagggggtatgtatttatacagtgaatccccttagtctccaagtagaactcggatacctcggaccctgcacgatatagtatgatcctaaccttctccgagtagaactctgttatgtacttgcctgtggggattatttctataatctcttgttgatttccttatcgtatacagaaatctatcacacatacgaaagtatgtcgtatgcgtatatttcataagtcgtaggatagaaggtatgtcttatccgtaacgatgacaggaaatacctgcctaatagtgatgagagggatgggtggtggtgagatgaactgggtaggggtcactgagggcgggtttagagggaagacccagaagaccagtggtgggcaccgtagacgagcaaacaacgaggcaatgatgtgctaccaaagtcgcatgagtgaatgacggcaatgggggtaaagaataggtcatgaggttaggcgacggtggcaacagtaatagatattggtggcacgaaccatcagagacaggggaggagtggtggagcagggaattccactggacttgacaaagagaggtaatggtagcaagacaagagagtatgatgaggaggaagagagggagggaggagttgcacagagtaggcattgcctcgtcgccaatgagtaggatagaggcaacaagcgcaatatgaaataaggtgaggcccttgtctcgccatcagttcaagcgctataggtaatggactgaatcaggaggagggagaaggggaaatggttatttgttatatagtgtgcacatatcttggcgtactatatgcctttaaaaagtgattgatgtattagaaaattttaggcaactgatgaacaaatagtccaaaaactcatgttcatgctctacccctccaggttgttttttaaggcaataaatagatacagcctcatatcataatcaggttgcttttgtttgatgactttaaattggcgttattcccatccacatccaaattaaattaaaagtcagaaatctaattataagatgatttatagcgttctttttttatttttttgattgagtatatatatttttatataagaaagattaatcacaaccaaattctatgcacgagattagcacattccagtaaaattactagacgaaatttgcctgtgggcatcacattcaaatcgatattttttgacagaacgaagaaaataaaaggagccataagggcactaaaaatgatggcaatggcactcgtcttcattgacgccattttgtagaacaaaatatttgtcagtagtacgtaaaacatagaatttctcagtataaattggtcaattctgcagcagtatcaactccgtcaatcctgtgatcaaagctgcaaactttttagtgcttgggagtattctcatgcacgaattgtgttaggacgtctgttccaacttgcttcaaatttccatcatttgctcgtttccaccacaacttcaaacagtagttcacaggtgatgtacctttcggatagaaatgcaaggtactcccttcgtcccataatatagcaatctaggaccgtacgagacattttataggacaataaatctggacaaatttgtcctatgaaatgttttgtccgatcctaggttaaaatattatgggacgaagggagtaatgtttaggtgtcacactgtcactcggtcagttcttacggaataaaccagagaatattcaagatacctactcaaaagtctcgtcggctttcggtaatggagaatccaaacgatcacatcgagaccgcgacctcttccattt

SEQ ID NO: 73291 - DNA, 1484 bp, Oryza sativa
atatatgtatatatatatatatatatatgtatatatatatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagccctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtccgggattcggataaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttc

SEQ ID NO: 73292 - DNA, 1625 bp, Oryza sativa
ctgggtgtctgaaatttgctgcgtgatgcattgtgggttgtcaaattgtccctcaaacactatgttgttgcgagattttcacagcgtgtaagcgcaagcagcaaaccaaattggttctattccctttgatgagtgattcatgtctatgactgcttgtaggaaggccgagcttgattcggatttgttggccagctgcagtaagttcaatttttcccggaggttattggcattgttgcatcttaggaggatgtgatctgctgattctagtgcaggggcacaaggagctgtggggatcttcattccagtttttgctgaccatattggatttggtgtttagtctgtctttgaatgctagccaaagaaaaatcttacaattttgtggtatggtgtggatccatatataatctgctggtttccaaatggatccatggtatgtcagcaagcgataggcatttgctgctgagactttgggtgcagtatacaagaattctctttgtgtctgttttctctgggatggggcagagattttgcaagatttgcagcagtgcgtgtagttctgattttgcttggtaggaaaggctaggatggagctgtatttgctaggaattttgtctgaattgtgattgaactgtgcaatccttatgcaaagcaaatgagtataaaactgggtaagcaaattccagacgttgatgcagccatttatccttccaaatcagagttgttctgccatttccgagttttacctgtgttgtagagcatagggtctggaattgtgatagaatgagtttccaagtcggtgtatcactggttctgggatgtaattgtaatgtgttttgcatatacctctctctaaaccaattagcgattggatcattcgggcctgcgagcaccttatcttctagctttaaaattaatgctgtgttatgtgtccttaagtccttgatccctaatcctcctttaatggatttttcacctttccaaaagaaagcacgacttattttgtcagttgtctcgatagatttctctgtccaaatacatatagtaagttgggattgctgagataaccgaacttatcattttgatctagttcacctgtctttatcagtttgcgttgtgtcatccgtatttgcagtaactcttttgtggatttgtttccgttctgcatacaacactaggctttgggtgaatcgttaaggtgacccaaaaaagaatgtcaatacaactcattaattaagattgaaactgcggtatttttctgactattaattgccttgggcgacgttagaactagcatatcttgtgtgcaagtttcagcaactaacagcaccacaaaaatcgattgcttttctttttctttaattagttctgtcgaagaataaaagtggagcgagaattaaagaggaagatatttttatgtctcccaccggcaggtgggcccatacagttagtatattatcttttgattgatgatgagaaagaaaaagagagggtccgtggcgccgacaggtggtccccgcatgtcatcgaggtggaaaaacacgaaaccactcaatcgaaacagtagagataaggaggacaattggaaaagagcccctctaagattagaaaattactccactatatat

SEQ ID NO: 73293 - DNA, 37442 bp, Oryza sativa
tatgcccttaaaatttgattttgatcccttccatacccctctcgtcagttgaccgtctaatgtctataaaaatgaccatgttaccctttggatgaacatacaaatttatgaattacattattgaaaatgtaaaagattgacacatgagactataatagttatgagtttgttgtgcgatatattatttatgacaaaattatttttagataatgaaataaaaaaatatgtatttattttatttaggagcattcatacaaagataggactaccaatgctcaccatatatttttatgaatgctcttgataaaaaaaatccattgtcctattgaaatttcaaataaaagttttaatttattaaatttgttttactttcaaaatttatgtcaaatttttttgcactaattatttagtgtcattagtttcataaaatgcacatattgtgcactcaaacaaaattttcaatcgtttttcaagcttatattcaaatctaaatcatcaagggtataaaagatattttcaaccaaacttaaaagtgaaatgaaggaaaatgtaccggcaggggcatggaaaggatcaaattgaaatttcaaaggtacaaaagggatttaaatttcaggaggttgaaagggattggatgagttttcaagagtataaagagaatttactctattgtttatattgatgtataatgaaatatttcagtgccttctatggccttacttagattaaatatgtggatgggaattgggaaatattgggaaaacacactatctttcatccctaaactttttaatcgggtttgttaaaactatgatgccacattttcacataatttcagtcactttttctctatgtgattgcgctctctccgatatgtaactatgcttatatctcttgtatcttctcttccaaatatataataaatcacttttaatcctaatcatgaattctcttaattatacattgtatattagaaaaactctaatgtatatatattataaattacagtgtaaagttttaactttatattgttattataacgtgagtgtaggtaatttaaagtgtaaaaacgatttgattatttttttaaaaaataaaatgtggcaccataaatataagtgctcccattttattagttaggttaatttgttgtcaaagctaatgctgtccctttaacaattaatggaaaagtttacatatcagtcagaatttctcctaacattaataacaagtgtgatccttgtggtatctccgtagtgtccgtaagaaagttattttattatattcaaacatgatacaatataatggtacataagcctcatttgacttgaaatgaaatcagtggaaaagaaagaataaacagacaagatgcagcagttaacgatagaacatagatatgcatgaataaattaattaaacatgcatgctcgtaaatttgtatgagctagtgattgacagcccggcagttcctcctgatctcgccattgccgccggtcttcacctcgatgctggccatcttcaccatggccttcgtgaacctatcctcccaccacccggggatgttggcattgtccaccaccatcttcgccgtcgccggcgacgccaggagcgacgcgtcggaggtgaagagcaccctgtgcgcgagcacgttcttgtagtactggttgtccagcttgttgggcgtcacgacgtcctgcaccaccgtggggtcgttgcctgagctcggcttcgccgggcactgcgtcctcagcatggcggcgagcgggggctccatgtcggaggggacggcgaggcggtcggggacgaaggacgagcagtgggagtcgccgacggtgtgggcgccggagagcaccaccatgtcctccatgccgagccccttggtggcgaagttggcgacgagctggccgaggttgaacttgggcggcgggaggaagtcgagggcgcgcgacgcgttggagtagcgcccgtcgaggcgccccgcgggcatctggaacgcgaccctgctgttgctgaggaagaaggaggcgtcgcgcgcggcgaaggcgacgatgtcggcgcaggagacgacgcccgggcaggccgcctcgacggccgccttggcggcgtcgatcacctcgtaaccgcggaggctgggcatgttgggcgggctgagcttctccggctgcgggttcgccggcgtcgggtcgagcagcacggacgcatcacatccctgcacattttcggcattggcggtgtaaacgtgtcatgcatccacggccacaaagctgagaaactcgtaattatatgtgggttcaatcccgttttcggtccaaaattcgaaacaaaatgtagtcaaatttaaacaaatattatcagaattcaagaaaaaataaaaataaataaaaatttcatgcaaaataatatcatatcagagggtacgaaatgaccgaaatttcgaaaatttcagttcgaaatgtcgaagccttaattgtataccactccgcccgtttcatactattataattcgttttgattttataaattaaatattcttaaaagtttatcaaatttatagaaaaatgtagtactatttttaatataaaacaaatacattattaaaatatattcgatggttagtactttcgtgctttacaaattgtcgaatttttctataaattataatataaaataaaacaagtatagtacacatgcatatatatatatatatatatatatatatatatatatatatatatatatatataggaatgtacctcaacgaagcagtcatggaagagcatgcggatgaggccagcgccgacgccggggttgtggaggatggcggcgccgacgacgttcttgacgatttcctcggcatgcgggcacttggcgtagtagtaaccgaccttgagcccgcacgaagcagggttgggtggcccgtaagctgcttggcacgtcgtcgtcaccgccgccatgagcaccgcgaaggtgacgacgaccacggtggcagcgagcttattaccactacccatggcaattaaccagcttagctagctagcttaattggcttctcttgctcttcttctgatcagtggctactgagagagtgagctgagatagctagctagctagtgagatttgcttgatggattgcgatggttgaggtgatgaagtgatgctgatgtgcacgagtatttataggtgaagatgagctccagcctccaggtaagatgagatcaggggagcgttcggttgatagatagcttctggatcgcaagcttttttaatcttggagcggatgcatgttggcaaagggtaaggtggtggcaggagaccgcgcaatatgcgcgtacgtttgtttgttgcagcacaagtgtgtacaactctgcggtttgacccgcgacgttggttggctcgctaaaccacgtgctattcggaatcgttcctctaatccgagcttataacgggcaattaactggacaaaaagcgtagtgatggacataagcatgctttccagagcgagcgagctagctagctagtcagggaatgcaagtcaaactaagtctctcccaaacaccttttgtgctctgcagttaagatgtgagtttaattattactatttcattgaaatggttaggtagcaaagcttgcgtggcggatcaatcaacctacaaatggccttaaattatctagtatttagctagctccatacacaagattgtatagagtatggttataaaaagtagctagcttgtacagagcaataaccggatgggtcaccgtagttcttcttcctcctccttttcactgatattttttttacctctagctagttgcacatccatgcattttgcacaacggatcaaattaacatctctattaaaaaccaatatatttattgaacgacgaggtcaaacaaaaagatcgataacttccttcgaatataagatagatagcaatcaaggacaagctaacacataatattctagttaaatcctctatgatataattgcatggggttgacaaaatcatcgcacaacgggttgacaattgaagtagtgaatttatctttcactaatatataattaattatatacttacttcagtaaataaaaataattcacaaacttaatcaattattttaggagcatcaaatgtttgatattacagttcaaggggtaaatccttgtatcacgttagttgaggggtaaatcggacttaatcctttatttgaataagacaaataacaaactatcatatctaaatatcaacatcgttgtatatcaaatggacaaataccaaatttaataacgccatataaaaagtatagtccccgaagaaaaaacggagggagtactcagcaagcattattgaaataaagcatatgcgcgtatacttatgcacggcaggtactagctagtgtcagacaatgtctcttaagcagttgattatgcgttgcagctagggatgaacctggttcggataggttccgtccgtccggaccatttttcggattcagatagtttcggtcggaattatccggaaattttcagattcggaaacgaattcggatgttttttctcggaaacgaaaacgaatacattaagagtactatccgtcggaatcggaaaacggtcggaaactatccggatttttttccggatatccgtacacattgagcaaattttagaaagaacatgtatatacgtatatatgtataactttttcatatggaatcagatgaagacaaactttatatcaacattgtagagctcgatgagatctataactttattattgactattttattatttgaggtcatttaagggtctaaatattcattataatataccatattaatttttacaaaatctcagatctacaattcaaacgacatctgatggagatgtgttccatatcaaaattgtagagcacaatgggatctaccactttgtagtttataacatttgtatttaaaagtatttaaagtataatacaaatattacaagtttcgaagacgtgaagtaaaataaataacatctccaatttatacactggtaagtaagttatacatctaataaacggtcttgggaatagaaaatgataatcatatttgcatatggatctcttagaggaacagccatgaaaatcgattttcacatacagttgtgggaccgtctacaaaattgacgatataaatgttagagatgttgaactaaaataataagcgatatctcttcatttatcaagaaactcaatttgaggggttttttatatgccggtaaatattcgctaccgcatttgttccgtctcgtattcgctccgtatctgtattcgataatattcgatttcatttccgtatccgagttttcgattccgattctgattccaaaaaaaatatgaaaacgagtatgataaaactagtttccgtccgtttccgatccgttttcatccctagttgcagctggattaattatgataggtcagggttacgtgatgaaaagttctctcggcaagtgggcagaaattaacaaattcttttcagaatatgtagaaggagtgaaaaccttgactagctcttagtaattaacaaatacagcaggttttattactgattaataacagcactagctcttgttcaagcaactgctaaaaaaaggaaaaatctaccaactagctggtgcgcatatcaaactaaaaagttcattgtattagattgattgaaatagcttcatcatccagtccaccaatatatactccctcttttttttaacatcatatatatactccctccgtttcgttttatttgacaccgttgactttttagcacatatttgactgttcgctttattcaaaaacttttgtgaaatatgtaaaactatacgtatgcataaaagtatatttaacaatgaatcaaatgataggaaaagaattaataattatttaaatttttttaataagacgagtggtcaaacatgtgctaaaaagtcaacggtatcaaataaaacgaaacggagggagtataaaggagggagtacaatggtgttgctactttatttttatatgtaagtcaacatttttttggcagcatatcgagaatctgtgcatggcggaagcttcgttcaagcctgcattttaattcagaattgctatatttgtgtcgccacaaatttgttagttttatagtcacatctcatacgaccatccatgttttgctaatattttgcagtcgattatcttcaagatttgttatagtatttgctttcacttagagattaaactatatcactggtggataaattattcatactaattatattgtacttacactataattacatactgattacatatgtaaatttgggacttacatatgtaattttgagacttacatatgtaaattttggacttacattgtaaatacgctaaaattacatatgtaatttaggaacttacaatataaatacatgcccactattttttgtgaaaaatatgacgccataaatatagttacccttgccacgttaaatgcataattgacaaatgctggataaaaattggtatatatacagatagagatatatcacctaaaagctcattgtactctagtcaaataaaatcacccatcctatcatttgtgaggtttcctcctattcttagaaaactatatataattcctacatttgaaaggtggaaaattaaactaaaccgcttgacatcattagaagataaattcacaattggcaatagagagattttttagtacttaagatactcccttcgtttcaaaatatttgacaccgttggctttttagcacatatttgaccgttcgtcttattaaaaaaatttgtgaaatatgtaaaactatatgtgtacataaaaaatttgtgaatcaaatgatatgaaaagaataaataattacttaaattttttgaataagatgaatgatcaaatacgtactaaaaagtcaacgatgtcaaacattttgaaatggagggagtatatagctatacatacctcacagtgttagttaagttaggaggtgtttatatctgccccagaagggatatacctactcccccacaaaaaggggaaagttaagatcatatataaaagatgagttttcaatattattctaatcggattagattagttttggtaactccctttatttagaggtatcttctgtatgaggaggtatacaaatacaactatcctaagataggagaaaacctcaccactaattaatacatagtttttaagtttaggacttccaacaccgtatgttaacgacgggaagggaaaggtattttttttcataataaaatctatcaaatgtcattgtagaagtataagggagatttcaaggataagattgagaaatacacatagagtgccaaaggaaaaaacaaaaagctacatcagtggctcaggaaggagtaaggggtgcccacaatatgatgggactagaatatctacaatgcttctttccaatcgcgtagtagtacaactacattataaacacctatatatatagtgggaagataaggatatgatacaattggctcatgttctgcaacaaggatagaagactcaaactaacagttcacaatgcaaaaaagaaacacggctctcactagctgcagtttggcaaattggcacatgccaccatcatggacgacaggacgacggtgcacaaaatatagtaatatgaacaactttagacgaaaatgtaagcaccgttaggactggccacaggacaaaagtataagcaactatatatctaattaattaagcagcaacagaaatcttgaaaacgacttttcattagagggatgcatcaaattaaaggctcaaactagtaatgctagagcaattcttttgttatcaaactagctattcgtgcccggtagccaaatacctccaactcaaccaacgaaacaagctagctgccacttggcagcattaacctctcccattacatccattaatacatagagtatgttaactaatttaaaattatttcctattgctatccgctttgagtagttgttttgttggtaacgtggaaaggtgtcttgacatcaaatcgcaccgtcacacttttagtacgtcatgtgcaacccgcggcggtacccggagatgcgttgccgcagggacttcacttggcattttgctactactgtaatccaagatcaatttgatccctcgaggctcaaattgcacaagaacaatgttgaataatgttaccaagcggaacaatgccactgtcattatgacttccacgtgtagatcaagagggagaagtcatcgccatgctgcatctcggtctccttggggttcaccctatccatgacgatcgagccgctggcccacaacaccattgatgaggccacgaatcctaacaaggaggagctcgtgttgtcgtcgtcccttgtcaaccaccgcctagatatggacgtttgctcaagatcgacgtcgtagatgccatcaccgagcgttggttgtcatcgccaccaccatctcagagccacaaacctagttaccatcacaaccaagagtcggggtcgcagagccatcgctgaggacagctggtgtcgtcgaaaagcaacccttgttattgccgccgctagatctggcggtcatgaatcacaccaacagtaaccttccctgtgtcgtcatgtaactccttgtcatcctctcgggcgtcatccgctcgggccaactggattcaccagcgaggaggtcggggtcaccaaatctagcggccttggcctcctcgttggctgatgcggtagcggttcgcgacagtagtgcaacgcatctcggtgacgatggaggaagtgtcagatgaagggagtgagagaggcagaggggcatggaaggaggtagatgaggtgatcgagggagccaagggagcgagggtttggttggcggtgggacttttgaataccgcagaaaagatttcgcgagtggtgctcttagatactgccaataaaaaccaattttcgttgggctctcatgaggttcgcccaaaaaaatagagctattttttttagtgggacctcctaagtgagtttttcgctgacggcttgtgacccagaatccgccaatacatttttacaagcatttatttcattagtccatcaataaaaataatagggtgatgccatgaaaaatcaattttttatagtgctcgagcatttgtttatataaggtaatcaacaaattagtaaagcttagtggagtttttgggtttacagcgtcaaacttaatttcaccgacaccgtaagtttgttagatatgcttgtacgtactccctatggctacaataatactgtgctaaaaaataatttgaagtgttctttagttcttgaagaggcttaaggtattactgctttaattagtgctaacaaattaaacttgctttccttcaagcggtatagatatttcctcaaggaagtgaaaatgaaacggaattgctagattactttcgacggatttttagggaaactttcgacttttagaccgtcatatttgctctaagattcgtgctagcaaggatgagaaaaaataaattggtaagcacaattgttgggatttgacctcgcggccttcagtttgtggagggagtgcactgcaatcgcgccatacatgttttattctagttacatataaattatatatgcatctagttatattgtagttatatatatgagttgtaatgtagttatactatagttatattttaaagttttacaaccaaaaaaactctcgataatttttaagatagtcgcaaaatgaaataactactccctttgttttcaaatatagaatatcattgacttttaatatatatatatatatatatttgaccgtaccattcttttactcaatgtaaatatacaaaactatatgccatacttaaagtacctttactagatgaacatatcacaaaaaagttaaataataatagaagaaataataaccattcatctttatttacatagtaaattaataagatgaatggtcgtatgcttaaaagtaaacagtaacacatttaaaaaatacagtaaaaaatacagagggagtacttgggttgacggtaagtagccagccaattgaccctatatatggtagttctagtaagctgtttttcttttaaaaggatatgatgacatatacccatttcatagatgccaactgcaaagccatcaaaattttgttgaaaaatggtaaaatagatcaaaatatgatatttcactatctacaaatattcaagttaaaattcgacacatataagtagaaacaaaaataacaaatctcaaccgtaaatagtacacaatttcttaattatcatcattttttgttatgtttgtttctgtttgttgtgtaggtcaaatttaaacaagcatgtttgtgaagcgatatatgatatattgatctattttactattttttatgagtatttagttgatatacataaaaagagtgtgtatgcatgatcggctttcccctaacatacaactatatgaattgtgtgttataataatctatctatctattatattattaaaacagctttgaaagaagtcgccacgttcgctgtgagggctagaaatttccacattaatcggagaaaaagaaaaagagagtcgaagtagaaatacaattaaaaatagctgaaattcggaattaaaaataagcaatattgaaagaagtgtccatataagaacccaatacgagattaatcaaaattcaaaataaaaataaaataaaatccaaaattagaaaataaaacgagagagtcctagtaggaatataatttaaaaataactgaaattcggaattagaaaaaggaatattgagagaagagtccatataagaacccaatacgagattagttactattcggaataaaaataaaaataaaatccgaaattagcaaaaagaaaaaaaagagttcaagtaggaatacaatttaaaattaactgaaattcggaattaaaaataagcaatattgaatgaagaatccatataacaatccaatacgaaattaattaaaattcagaataaaaaaataaaaaatatcaaaaattagaaaaactaaaagagagttcaagtagaaatacaattttgaaacgaccaaaattcaaaaataaaaaataaaaatattaaaagaatactatacggtattaaataaaagtttaaaaaattaaattctgaaattagaaaaagaaaaaagatttcaattaggaatacaatttataaacaactaaaattggtgataaaaataaagactattgaaaaaaaaagactatctaaaacacacgatgagataaattaaataacaagcctataaaagagtagagtggtggcggttgatacgacatataaaaactattagtaaaacaacagatagaatcctaatgatgattaaaaggagggacgacaggcaagccgtgaagcaaacgggcaaggcggttgccgggacttctagaaagtaaaaaaaataaaccttattgataatcatatttgatttttaaaatctcaatgacaataaaaaggagaagcagcgggtggggtgtataggagtatagttgcagagctgctgacggttggcgggacttctagaaaataaaaaatgaattccaatgatagttatatttgatttttagaatcccaatggcaataaagagtagacggcggatgggtcgtagaggagtatagtggcattgtttgacgtgacttctaaaaattataagaaataaaagccaataagataataaattctaaaaactacaaggtccaatttttaaaggttcggaacttctaaaaagtaaaaaaaaaaaacccaatgataatcatgttcgattttaaaatctcaatgacaaatgacaataaagaaggtagacagcggacgagtcataaagtacaatggaaaagccgctgacggtttggcgggacttatagaaagtgaaaaatgaactcaaacgataattatattcgatttgtaaaatcccaatgacaaaagagaaaagacagtggacggaccgtagaggagtataatggcagcgtttgacgggacttccagatattataaaaacgaaacccaacgagataatgaactcaaaaaactataagatccaattttgaaacgtttcaagaagaatgaatagaaatagtgatagaccaagcaagcaaataaagaaggatatgatagaagtaaggggtagcagctagtgtgacttttaaaaactacataattaggaatacgggtatagctatttaataaattttaagtaaaatcatactgaaagatatatgattttgtttgggtgctagccgcgcaattgtgcgggccacccatctagtttgaataagagaataaatgaaagtcatgcactcacacatctatatcattacatccatgggtatctcgagccatcctagatttttctcttttcaaatttcagataaacatcaatatatagcgggcacttgttgcaaaaaacttaacttacaattattccaagtacatatgaccttattacacaattaggtcaaaacaaagaaatccatagcatgtaaaccttggggttcacaaatgaggaattaaggaatggtaacaaaagagggagaacataaatgtgaagcaaaagtcacatccaatcataacatcatcaacacgtacgcttgcgacttgatcaaggagggtgtgaaactatcaaaccgtgtacgtcgtcatcgttgagcacgtacttcaccaggtaattgaatcacgcagctaaacttgtagattaatcagtagttgatgaccctgcagttcttcctgatctgcccctggtacccggtcttcacctggatgctcgccaacttcaccatggccgccttgaacctgtcctcccaccacccggggatgacggcgttgtccaccaccatcttcgccgtctccggcgacgtcaggagcgccgcgtcagaggtgaagagcaccttgtggtcgagcacgttcttgtagtactggttgtccagcgtgttgggcgtcacgaagtccagcatcaccgtgggatcgttgccgccgggcgtcgcgtcgagcgggcactgcgacctgaggaaccaggcgaagccgccgtcgatgtcggagaagacggaggcgttgaggcggtcggggacgaaggaggagcagtgggagcggccgacggtgtgggcgcccgagagcaccaccatgtcctccacggagaggcccttgacggcgaagctggagacgaggtcgctgaggttggacgtcggcggcgggaggaagtcgatcgggccggagtcgttggagaaggtcccgtcgcggcggcccgacggcatgtcgaagtagaccttcccgccgctgaggaagtaggtggcgtcgcgcgccgcgaaggcgatgatgtcggcgcacgagacgacgcccgggcacgccgcctccacggcgtgcttgatcgcgtcgatgaggtcgaagccccgcatggacgggttgttcggcgcgctcagcttctctggcgtcgggttgaacggcgtcgggtccaggaggatcgaagcatcacaaccctaacaacaaaacaccatgcacatctaagtacacatagctcaagtcgatcaatcgatctcgccggagaagaggaagaagctaacgtacgcacctcgacaaagcagtcgtggaagagcatgcggatgacggcggcgccattgccggggttctggcggacggcctccccgacgacggccttgacgacggcctcggcctggggcacttgtcgcggtagtacgccaactccagtggccagtaagggtgagcctggcatgccacggccagcagcagcagcagggcacacgtcaccaatggcagacttggtgatgaagccatggctaataagcttgcttagtgtgtagctagcttaagcttactgtaccttttgtgcttaagctaattaaactggttttgcttataaccggaagaaaaaaaagtgcttcaagaacaaggctgataaccttaaggttaaaattggggttaatgaaaccattccccttgggcctgccttgccaattaaaagtttaaccagagtaatttacatggttgtacataaattatgcatagtgtacaacgattccctgttagctgcgatagttttagcgtgttaatagctacatgtttgaacagtagctattttcattttttttatttttatcgtttaccttttagtttggtgttctattgttttccaatgtgaagctgaacgattgggattttttgttagacacaaaatgttgtcacatgttggtgttatctcttttaggtgaatcagtactcttcttcacacgccacacatgtccagcctatttaggccctgtttctttcagcttgggattattataatctagattattgagagtaagctgaaagaaacagacaacttattgaagtagcttattataatctggagtccagcttattataatctgataagctcatttaggtgagcttttttcagattattgggtgaaaaattacccaccatgccaccccactccctttttagacttgcaaacccaataatctaggctctaataatctaggaaagaaacaactaaccgcttagaccctctttgtttaggcttaggcttattggcctagacttttaagtcagcttattggcttatatgatttataagccggtggatttaatgtcctaagtttagtagttgagtcatacatctacctcacataagccaaaaaagcttctctaacctagcttttggcttaatagtgttagagtggcttatggcttcaaaaaagccaaacggaaaagctgcttgtttgtttagacttagacttttcgacttataagttggcttataaacctaaacaaagagggccttattctactacagattataacaatataacttatagtaatctggctcaataatttagattataataatcccaagctgaaagaaacagagccttaatttcatccaaacctttcggtcaaaatatcttcttcttcgataatagaaaattcaggaaaaataaataaggcattaagtgacaaacagaacaacctcaaattaagttttgctaaaatctgaaatccaaacgattgaacagcacctaaatttgaagtagttaaggctgttgttaattatatacattgcaccaatatggacagtgcaggttcactgacccttgacagagatatggggtagcacgttgactatgctggttcggtgcatacatgaagaggtcgtatactcgtatattccagctactagtagttcttaattaagaaaaagagttaattaacaattagaagagatagatgtcccgtgtttcttctctctttacttttctatttgatatgtgcacttcagtctaccggttgcagatggcgatggatcttctcacggtcgttaagatgtcaggatcgttaattagaacgtttcgtctgacagacatcatcagagcacgcgctcaaggaattaacccgcttcatcatatgctggttatattttatatattagttcatctatctatccatttatctattatatactaaaagtttattaaactccctacaaatactctcaagctatcacgtagcactaccagagcttgtgaagctgccgtgtgcctcaccctgttaccgggagtttttgctagtactcggtgacttaccgagagtagcacgttgcacccggtaacattgcaaacataccgtgtgttagcgacgaaaaaaactcgggaagataaaaatacgctatgcaatgccaaaccgcttggtaaccatgggatccaccgtttctaccgtggcttggcgaggattttttttgcttggcgggcggtgatttccgttggcgcaggtggatggcgcgcggtgttttttttttggcacggggtgttttttttgttgacgacgcgtgaaatttctattggcggggccggggtggacggcgcgtgaaatttctttggcgctcgacgatttccgttggcgcaggcggatgacgcgccacgatttttggctgcacagtaaattttcgagtgggctagtaaaaagttggcccaaatagaaccacaaaaccctacccctaaactactcccccttctcttctccagtctccccctccgccgccgcctcgctctcctctcatcgcctcctcacatttcccctctctgccggccttgtcgcaggcagccatcccaaccatgcgaccgcgcgtccctatcctcatcccttcacacggctggcgagcacggccctgcatgtccacgtccatccattgcgatttatacgccattgtctagctgttcaacaaggcgcccaatcatcatcgagctgggtattgaggcctgctgcaactgcttcctcccaatctgtgtggtatgcgtatgttgagtggttcttgcatctttatgcaaatatagttcttgattttggaaaaatacacttcattttctctttggatctagtaatatggtgacatcctaatgggcgctatgctgcatccaggtccacgacgccgtgacgcgccccatccagttggaggctgcagctggtgctgtgcatcccctttcctcccggagggacgcaacatttttcaggttgtactgatttctctatgtgcctgcaattttaatttacatgagagatgctctgagcggcacaactagcagcacaggaatgttgcggcggcagcagtcgcgaggcttgtcgaccggctcagggagttgctatgagcagagcaaagagaaagaatgcacaactctggtttcttaacagcaaagaaggatgtaattcttttcctcttttattttctgttgcttaatctttggttaagtgtttccccggtcgccaagtttagaaattgtggttagaaatttcttgttctgtagtgcacatatgtacttcaattatcacaagtgaagtttctgaattctagctcatcctatttcttagttaatactcaattattatttctctgtcatcaaaagaacacagttgagataatttacaactaaaaaaatattattacagaaaaaagaatagtttatttttcacccatatcagaggcttacattctagatgaaatcttaaatttcacatccatatactttggcctagtttagttcccaactttttcttcaaacttccaacttttccatcacatcaaaactttccttcacacataaacttctaacttttttcttcaaacttccaattttagtcaaacttccaatcctttgttgattgagtgcggacaatgcataatcatgtccctcgatacaaatgtcactacttagcctactggtggctgtagaccatgcatatcctcatatcatattaggaaatctagctagcttcagttctgaaactctagaatagtaatgcaaaccaattaattacttgataactttagttctgaaactcaatattttcataataaacagtgccttggtcaagaacttgacaatgattttgagaaggttgccactagcaggaatactgaagaaatttgcaatgacaaggacttgaagattattctcaatgaatcttctattcaacatgatgacaatgactgcaaaatcctactgttctgattcatccatagaaatatcttgtttgacgaatatttctaaggtacacacttcacgtagttggagatcacactgcaaaattgttgtaacctgcctcccaagtcccaaatgaaaatttattttgtgaactacccacaaatagtgacctctaaataatctagttgtgttgtaatcttatttggcactaaacatgttttttttttataatttcaggcatataacaatcatggcaaaacactaaagagttgatatgtgatgtcaatgaacacatttggttagtcagccactagcatttgtctatatattgcctcattgggagaggttgtaagaattgagaatcatatatttctattgcatcatgtgcagagagtttgtagatccattaatattttgttattgtaccatgatgttcctattaatactgggagaatttgcagctaatgttcacatgacatgttcctgtgatgtatccttgcgctctgcttttcatgtttgcttgttgctgcgtttcagtgttgtacgataatgaatttatgaaatttctagaatcacgtattcaatgttacctagtgttaatagctctcggtaagttatgtaacagtaccgtgtgtttgactacaacacacggtaacattttattccttcccgtgagttcgtacctctcggtaacacccccgttccgtttccgcaacctgtcctgtgctggtcaatacattgttaccgagaaagtgctttcacccggtaatttttcttgtcttaccgagtgtacaagcgtagtctcacgggaaatattgcacggtaaaggtgtgaggccgctgagtgtctgttcccgagagtctgttctcgggaagctctgttcccgtgttttttcgctgtgttaccgagagcttttggcacacagtagcttccctctccctggtagtgtagcattctacaaaacgcttctaagacgccatgtgactatctaataaattagaaaaaaaatcctaaatattcctttaaagaggtggacccactattttcaaccattagatcactcaaaaagaaaaatccggtacccacgcccaccgtgtgtgggtatacacgtatagtacgtactccatgaaccctcctactttccttggggatcctactcccctcttcttttttctagccaacgtttcccttttttctagctaacacataatatataaaaataataatctgatagtttctcaaattatttgatttgttgtgttatttataattaagtacataattcaagatccatatcgtccatatttactatataaaatgtagataatctagccgttctgactacaaatatttaagcaaaatttgcattgtgaaaacatgaatgaattcaaatatgtgagtctaaagtccaaattcaataaccaccaatgagcttggaaccatgatgcatactctgggcctgaacccgatggaggcggagctgcaagatattattaggccatgttcgttagatggggttaggagctaatctcctacgcacgtaaaacgaaacgactcaatacattagcgtatgattaattaagtattagttaattttttaaaaatgaattagtatgttttttaaagcaattttccatagaaaacttttagaaaaatgaccgttcagtagtttgaaaagcgtgcgcacgaaaaacgagggagctaacttgagaagaagggagaagaacacagccttagcgaggcggacaccgacggaagtgccaacatcgactttccatgacttcctgagcctagtagcacgctagatgattagttgaagaatatgattgagagaagaggcaaaagaagatgttccgtgtcttcggcaaggacaaggaaacagcttcatctccgctgccaagccccgccacgtcatgtccaatgcatcaggagatcctcactgatgaggaggtcgatgagatgttccgtgaggctgatggtgataggcagaccaactacaagggatttcgtaattgaatttagaaaaaataaaacaagaaatttaaataaaatacacattcaaaaaaatcattaaaactataaaaaaaggtaacaagattccatgtagaataaaaaatatcaagagtccatataaaagtataaaaagtttaagttataaatatttgaaatttggaataataaaataagtattaaaagatgagtccaaatacaatatgatacgagattaattacaatttaaaatccttcaaaagacaattgagaataaaacaataatttgatttgaatacaaattcgaaattgattcatatggagtatatgcaattcgttatggtaaaagaacatttattaacaataaaagtttattgagatgttttgagaaaaaagagatacaatgaacactcaaatagaaatagaaaacaccttactttaatttcaatttattttgttagaattattttcaaaataaattactccctccattcactttggtcgtcatattttggttgtgcagcgataccaagaaacccattaacgtttcgattactgcgcatgtcgcgtgtgcctgctggccccacctgccctttgcgctgctgaatctataggctttggttggccatagcaattttcatgcacaagtctgttaaatactccttgcatgtggatctatagagtacgttttcaatctgtagagtacgttttcgtgtgaaccaatgacaagcagtctttgcatgtggaggagtaaatgctgcatggaaacaaacgaccactccatcccacccgaaaagaaattgaatgcgacgatcagaatgtttttaattttaaaatatgacgattaaaagtgaatggagcaagtacgtagtatgtatacctgcgcgaatacatgggctatgctgattgaattaatggatcaacatttgcatgattcactgtaaagttagtttggtacgtagatactgctagcccaaaattaaatggtgaaattcgttcttacaagaatatactttggaatataattaagtttttgggcaacttgttattagcagccatccgcaggtgtaacgtactatcagaaagcgtcacaaagctgctactagtatttgcgtcgtctttgacctaatcatttgtcacttttgagttagctgaacatgttaaagttaactaatcaggcgtgtaccggcgctcgtaaactatatgcactaacaacgcatgtgatgatgatgatataaagtagctggtgttgcgttcattcttatcgcttccttcgagaacaaacgtacgaatgatccaaactatgctatctggaacaatataatacgtgtgtttttaaaccttaattatgtgcgtaaacatgcactaggcagctaattactttttttcagaaaaaaaaattaaaacccggcctctacgggctactagctagaaggttggtcagggttaaataagaaaagaactgatgtggggtactaacaattatatgttttcgataatgtaggcggccaatcaatatcatgtgttcttgttcttgttttatttacttttgatcgattcagatacttgaacatggttgctgcatgggcgttgaagacgtagcaggctatataatttgacggatttctcctatgaatatttggcccatctttcatttcggcctgaaacgtcagttagcgtagatgggccgtgctttgtagcaggctgtacagtattcacacgcaacgcagagctgggtcgcattggaggccttctgggtcgtgggttttgccgcggcggaggcctgctcgctgtcagcctttgaggcaaagggtcgagatactctctagtcgaagtcaagtgacaaaacatgtggatccgatcttaatcattggaactatatgtcagtgacaaatgtacatttaactgcaaaggatctcaatctgagacaaagatgctggacagaagcaagcagcaatggcggcttcgttatcccctctgatctgcaacaacattggctggagatgaggctacgacagcagcttgggccttaaggaagaagagagcccaagtcaaagatagcttagcttgagaaatgcagagttcatcgggctacagaggagtgatggcgacaattaatctacacgtttgctggtagccggcgactgggagcacccgcgatcacactctaaggcactgttgccaatccggcaagtttcagaagggagtggaggaattagcaatgttcagaggaacttgagatgaagggcatccccaacagcatcaccatttgagttctcagggggcaaaaaaaataaattaatgtaagtttgcagcatcggagatgaatgaagacaataataatgtggctttcaggctggcttagctagcttgttattagcctctctattccgtttacaggcatgcattgtatacttgtgcgaactatttgtgcgtgtttgatcgatgaattgtgtggttgtgtttggttttgaaggttatcaagtattggaatataagtgaaaattgttcgtctttgctcttctgcttaaactttcgggttgatatagttagtgtgcacaactcaattagtatatataagagagagagaggtttcatgattgaatcctagttgacatataattaaataactattatctccaatttaatattatataagttgttttgattttttttctaagtcaacttctttataattgactaaatttataaaaaatatacaatatcttcaacacaaaataaagaaactatcaaaacatattgaatgttagatgtgatgaaactaacatgatgttataagtgttgctataattttaatgaacttagttaaaagaagtttaactaaaagaagaaggtcagaacaacttataatatagggggagtagtagggtggcccacgtagttacgtggctagcaccgaagttaaactgtatcatgatgtaaaattatctacctcctctatttcacaatataagtcattttagcatttctcatgttcatattgatgttaatgaatctagatagatatatatgtctagatttattaatatcaataagaatttggaaaatgttagaatgacttacgttttgaaacggagggagtacattgttttaacttgatttttttaaaaaaaacacaaattagaatattcgagtcgttggctatatatagacatttttctatataccccatatcatcaatcatactccgtatcatactgcatatatatagacatatttctataggacaaagtgagcttatattgattaaataaatgatatgcttgctatgaaaaataataaataaagtgttagaataggtgttgaatatactagtcctatttgattacagttggacctagagttgtaacagatgttagtgggtagagttagaatcggactctgtaacccggtaactctcttaaataaagagggaggcgccacaatgtaaccatggcgactacaatgtaacgtagacacgcagggagatgatggcggcgtggccatggactcgaagcgcctaggagctatattggttggggatgagcgcccataatcagagccccaaggatgtaagcttcggctgaacatcgttaacaaatatcgtgtgttcctgtgtcgtcatctggcatgtcttgggtgatcaatgactgaagcgatcgggaaggttagtcgtcgttccgctatatcgactaacttttataacatgtggtatcagagcagaaggtttcagcattggattacgaagacatgtggtagaggaaacacgaggtggggatcgtgcatcgataggagatcgtcaatcgtggcgatgagatcgatggcagaacgtgactggaagacgaggccgagcgtggccgaaggcgttcggtgagatcggaggggtagcgccacggacagtgcgcccgacgcacgcggcgatcgcggatctgcggcaacagggaggccagtgacggaagggtgaagctaacgagcgtggcacggcacggcggatgtggaaggccgagacgatgaagtcgaggacggtgaatacgaaggctgcgactgcggtgcgtgcgagggcacgaaacagcatgtatggagtacgtgctatacacgcacatatgcacacgtacgacgagcaagaaaataaccacagggagcacgattggtgttcagatgcagagacgaaggcagaagcagggagatggccaggttggactcgactcggacacgggttttaggagcggggcaattgatctcggccagtatggcgtgtccattatggattggactcatctagcactggttactggttgaatcggcaacggtaatcggcacggcaagactcaagcttcagtgaagtctcggtgaacaagcgattcgtgacagtaaggcttgatccatgccgcttggtttggatgggcccacgtggttgagttcgtaggcatgcatgaaggttgtacgttgagtggacacatgcatgcacagtcagcatgtagtacatgtgaggccattaaacaagtactccctccgtaaatgtacgaagccgttaacttttcgaccaacgtttgaacattcgttttattcaaaatttttgtgtaaatatgaaaatatttatgtcatacttaaagaacatttgatgatgaatcaagtcataataaaataaatgataattacataaattttttgaataagactaatggtcaaacgttggaaaaaaagtcaacggcgtcatacattaaaatatggaggtagtacatcaatgtatgtagcaaacagcaacaaaggtgcggctcagtttgagaatgcagcaaggcgtgtgtatgacggttaaactgggccggtagggtggtcagaccgatgaactggttagactgcggagcttgtacggttagaccgggttcaacggatagtggttcgttgctggaacttgttaacagatctagaaaaaggacaagaaggttctacagatggatagtttacaggtgtgaagggcgagtagactagcgacaacaggctagtcaggtcgcatatgaaattatctggtgaaaacatgatatatgtggaacttgatgaggagttgagatatatggagttagtccagaactgaagaaaagtcccgggcaacagcgggtgaaaatcgttaagggcgtcaacgggctgtttggcagtacaggatatatccaggatctgccgggattgcatgatagggatatatggaatctgcgtcactgaagagtaagagcaagcgctatggtggtaatttcttcggatgattcaaagcaacagtgattttctcaaattatcggatattcagtctacggatgcgggaaagcgaggatgttgaattcgttagctcggttcataagacaacaaggaagaaaaggttcttttcatgtctagcgagtttttgatttatctatttggtgatgacatcggttatctggccatggattagatcaagtcaaatcaaagacggaagatgaaggtgaacatggtcttcgaggagtctgtgatgtgacagctaaggaggagttcaatttcgcttggcaagacgactgtaatgatatgagagaaagtggagcactattgtagctggagtccagaggaataaattacagggatagcaaagtctcttaaaggtggcgggtttggtgcaggctcgtcgggcggcttacggtgaagctgcaaaagaagacaacccaaatctggaggataggtggatcggcatggtgattctacaacttctaggtggcgtatattcgccaaggtggagtttgttaaaataggtgtcaaatatacttgtcctatttggttacaattggacttgaagttgtaataggtgttagggggtagagttagagtcgggactttgtaacccgataacactcttatatagagagggaggcaccacaatgtaatcatagcgactacaatgtagcgtagacaggcagggagatgatagcggcgtggccatggactcgtagcggctaggagctatattggttggggaggagcgcccataaccagagccccggagatgtaggcttcggctgaacctcattaataaatatcgtgtatttctgtgtcatcatatgtcatatcttgggtgatcaatgagtgaagcgatcagaaaagttagtcgtcgttccgctatatcgactaacttttataccataaagtgactaacaattttcctgttttgcctctataatgatcgagtatctccgacagactcattatgctacaccactaaattacgattttataaaaaaaaatcattcctatatgtgtatagtttttagaaatcctgaccggccgccaccatctttctactcacctgtaccatgtcctccatctttatttctattgttgcctctcaaatcgccttgcaataccgttgtacttccctacccctttaccacccctcaactcgattgttcaccgttactcttctttaggcacattataaaatcaaatcttaccattatatcgtggctttgcttatatatagttttagaagctgtcaagggaaatgggttccgaacccttagtttcaaacacagccaattcacttatggctggtttggtttgtcgtctaaattggccttacaaattttatcaatgtcaaattttgacatggttaattttagcaaggcaaagttatgtttggattgaagtcaaaatagtctaagttaactattgaaatggcctattttcttaggcatgctaaaatttggctccaaactaaatagacactaaacactattgaaattatcaaatattggtaagatcaatttagacctcaaaccaaaccaacccttatattctacgtttgagatgggagtgttggtatatgtgtgattttctgatgtccagagtgactggagttagctttgtctggttagaacttaggagcaggaccaagatcaggaagaaattaatttttacggaatttgaagttcgcaaagagattattatggaaggacagaataatgaaattgcaaaaaataaaaaaaatagaaaaaagatgaaggggcaggccttcaccccatggttgggcgcgatagaagaagtggcccagaagagagacggtccacggcccatccgggggagcaacctggatcaaggagcagacagcccagcccaggccgggacagctcggagtcagagcagagtgcgcgcgaattcactcgtaaatctgattttttttttctttttatttttttttgagaaaacttgtagtaaatctgaattgctttgcacgctagcgatcatattcatacgcagatacgccggtcatcactcatcaccatcaacattttgaaatagatgcacaacgtaaaatcaacaaacaaaatatagtagtactgctcacagttttattcatcagaaacatgaaatgatcgtacaagccacacgtagaaccacagcaaaataaatcaacaaatcgaaacaacaaaacggtaagaaattattccaccgcataatcaatccccactaaccacaccatttctagaagataaaacccaagtcccataaatcaaaacaagcaataatgtggatggttgcatccgattgaacaaaaagttaaagttgttctgaattctgatacttctgaatcatcattttaattagttgaccaccctgcagttcttcctgatctcgccctggtagccgtttttgacgtcgacggcggccatcttgacgaacgccttcttgaacctgtcctcccaccacccggggatgttggcgttgtccgacaccatcttcgccgtcgccggcgaggtcagcagcgccgcgtccgacgtgaagagcaccttgtgggcaatgacgttcttgtagtactggttgtcgaacgcgttgggggtgacgacatcctggttcacggtggggtcgtgcgccgtggtcgggttggcggggcacctcctcctgaggagcccggcgaagccgccgtcgatgtcggaggcgacggcgaggcggtcggggacgaaggaggagcagtgggagcggccgacggtgtgggcgccggagagcaccaccatgtcctcggcgtcgaggcccttggtggcgaagatgtcgacgagctcggtgacgttgaagaagggcggggggaggttgtcgagggcgtcggaggagttggagtggcggccgtcgaagcggcccgccggcatgttgatcttgaccctcatcctgctgaggaagtaggcggcgtcgcgggcggcgaaggcgacgatgtcggcgcaggagacgacgcccgggcaggccttctcgacggcgtccttggcggcgtcgatcacctcgaagccgcggaggctggggaagttgggcgggctcagcttctccggggctgggttcgccggagttgggtccaggagcaccgagccatcacatccctgtaaaatatacatgcagatgtggcgcgtcaagctcactgatatgcaaatatgtacaatttttctttggtttgttaatacattttgtagtgcaaaatttagtactccctccgtattttaatgtatgacaccgttgacttttcgaacaacgtttaaccactcgtattattcaaaatttttatgcaaatataaaaatacttatgtcatgcttaaagaacatttgatgataaatcaagtcacaataaaataaattataattacataaatttttttaataagacgaaaggtcaaacgtctatcaaaaagttaacggcgtcatatattaaaatacggagggagtaacttttcagtgtttaggtactaagttaattaccaaaactaatttaaataaaatttgtttaaatttcaattggtcctacattaccgaaagcttaagtctaccgctgcttaaattttttttttcaaggggttttccaaaatagaaaagttggccagaggtatctcaaattaattaaccaaatattatatctttcagtacctcctcaacaatcataaaattatttttactcaaaaagatacgagtatttttaatgaaccgtaagaaaattttgggaattatcacattaatataaaaaaattgtcatttcataataactcgggtaccagaggggcggcatgacaattcacatttatagaacaaaaatatttctggtactcgaaccgtaaatttcaaaaaaatataaatgcagctgcccatatatcttgctataggttcagccatgtatgtacctcgacgaagcagtcatggaagagcaagcggatgaggccggcgccgatgccggcgttcttgtagacgaacttcttcacctcctccctcacgatggtctcaacgcgggggcacgacttcttgtagtagccaacctccaagccactgcacgcggctgcaaggagcagcgtgcaagtcaccgcgacggcgagcttaattgtgtgtgcagccattagcgcgcagctcttggtaatcagttcttgctgctgctgcttaatctgctaattaaagagctagctcgctaagatgagggtgatggtgtgttagtatgtagtaatgatgggtatttataggtgtgatgcatgtgcatgatggttatatgcattatccggactaagtcttggggcattcatagttacttaattgaactcatcaatgaatgatggagtataattattatatgggagataatagctgtgtttatgaacatggaagccataatccaactacaaactgggtaaagcattgagcagagtatatatgctttggagtaaagtgtacctagctagatattgctctcccctactgttttattttctttttcttctggaggtccgtcactacataaatatgtggaggagtagaaccttttttttaagacagtttaaaagaaatcaacagactaattaagccagctactccattttaattgtgtcctgctttgaacagtgattgtgcagctagatactacaatattctttatgggcataaatactccagtaaaacaatcaacaaaactgctgatgaattctttaatactccttctgtccctaaatataaaagatttttggtgtatgtgacacttcctacttcctagcgcaatgaatctggagagggagtctgtctagatttattgtattaggatatgtcatatccactcaaaatcccttatattttggacgaagtgagtacttcactcgagatatttagctgaaaatactctaccaggctttgtgcgggaatactctacaattaacccttcacatatatacatacctcccacaatgcacattctcatctagttaactaaatggttataaagtttcattgcatgagttttttttgttttttttttcggtggtcattgcatgagttgctgggctgatatgaggttcaattaatcgatctgtacgcagagcaggtcagtttattgttcttagctgaatgttagggcatgttcaacaatatatacatagctaggctgtcactttgcaaattgccatatcatataagatcctagatggcatatagagggtaaagagagaatgtaccatcaattatacaagagacgacccgggcaaaaaaaagtcaacatacagcaatgaggattgtgaggggtggatgtgatagataaaataatactgaattataattaatggcaacgggatgataaagaataactactggaaataataatgttacaatgtagctaagatttttcactccgatccctttcatcacttataattgttggttttgataagaggtagacaaactttgagcgctactttttaagtcatatgaaagtgaatagatttcaacataatatgcattagtaagttagtttcaattatagtttgaggctaaatagttagattattttaaaaatagttggtcaaattaagcaagataactcaaaatcaaaagcgatctatttgtaaatggagcgagtatattcctataagctaagaacgttgtctcttggtacttggtagtatctagtagtgagaaataaaagtaataaggccgcattcgggaggtagagtttggaactctatatccccgcacgaaaaacatgatggtttattaatattcgaaaatggattaatatgatttttaaagcaactttcgtataaaaatttttttaaaaaaaatatcgtttagtagtttgaaaagcatgcgcgtggaaaaggagggaagtgatgagaaagtagacaaaagaaactcaacctaagttgtggcaacttgcatataattaatagtagaagcatattatacacattgttaatttgatctcttgcaagtcaatttgcggcaggtcgtggttgtcaccaacattccctagcttagctttctgacttggcaacattcatgttccgatattaattagctaatgccaaagcttgtggcgtatagtactcccttctcgattcgtcctgtctttttatcttaaaattttctctcacgaactctgtattttagattcgtagccatcaaacgagtagggctccgtcctctctcattttctctccacataacgaagattatgaaagtcttttaatcgcttgcttaattagatgcctttgacactttatgagacaatagctttttaggaacggagggagtagggtgctatagaaaattgggtgctttagttttcacgtagtggccccttcacttttgaataatgacatgatacccatttcgtccttcctaaccttcgctaagatgtttggtctcaaaatcaataactcattgttccaatatggcataaacgaaggaaaacagatgagaatcactttatatatttagaatgataagaaaagtagtttgcatgtcaagagtcaagacacaattaacataaaactagatgataaccccatgtaccgaaatgctaaatatgtggaaaaatatattttttaatccataagaaaaataacaagtctactttaaatatggcaagacatatatcatctgcctggatgttacaatgcaaggacaagcacatataaataatcagtgaatagaagttataatccagttgactttgaagagtttctctcagtgagcataagaagcagctccattttttttctcttttttgaaagaacaagtggctccaaattgcagtagaacaacggtacaagatcaggtcaatgaaatgcctgcggctgttggcattgtgtatgagctcaaaatgggtctagaactcagcccgctttctcatcttctctggaaaaggaaggccttcttgggtaggggagtctattttgccttctctcatatctttctcctgattgaatcacctctctcacccacaaaactagctataacacctctcatcttcgaaaaccggtgtaaatcgacttctttaatagtttgggaagtggtttctgttgacgtgataggttgactgatgttgacttgctgagttagcgggaggaaccaacttatcatcgacttctcatcaaatcttcttcctcacccctcttccttctctctatctctttcctctctttgctcttcctcctctttcaccttccagcagtagtagaggcagggagggtggtggcggtggccagtcggacctgaggagggcggcttggcgagtcggacctgaggctgaggacccaggcggcgctccgcgtcgtggaaggcggtggtttcatacggcttgcactaccgtcgctacggtggaacttgggctccaccaccagctgctgctgctgaccaccatgattccatcgccgccgcccatgggagctcatccatctcgtgtctcattgcttgacaagaaaaagagggaaagaagagggagagctaagccttgccacggacggtaggagtgacgaagatgttgctgttgttgtcactcaccccgctaccaccaccactccatcaaacgccgaccgaagatcttctagccacattgcaatgggagacatcccggccgaagctctcttcttcccgaagctctgccaatgccctcaccagctgcgggcaccaccttgctcctcccatgggataccctccgcacgtgttccaccgttgccaactaacggggtgacgaggtcttgccagtggctgatttagtcatgcagagggaggggaaaaggaagggaggagagggatggcgtggttgccgtcggcgtcttgttgcttggggcctcggccttgctgagctcccatcattgcctagcgagagagatatggagaaggagagatagggagggggtggtgaggaagaaaatgaaatgaggaggaagtcattgatatatgggccccacctgttgaatgagcgagtcaaccagtaatatccgtagaaaccacttcctaaaccaccggaagagtcaatttgcactggtttttaaagataggggtgatgttatacctagttttatggttaagggaggtaagggtgggtagaataagactgaaccaaagaaccgaaccgaaaagaccgagaccgagaaattcagttagtaattcggtctcagcctgtcaaagaccgaaatttgttcgggtaattcggtcattgggctcgattaaccgaattaactgagaaaaccgaattgtgccccaataggtacaggaggctcaataagtccaatacaccactgaaccttagaggtcacccgctccaacccacatccccatccatcctcatcgcgccgccctccacatccccatccatcccgcgccgcctccgcctctgcctccgcctccatcgcgccacgctgctgcctccacctccatcgcgctgcgccgctgcctccgccctccgccctccaccctccacatccccatccatcccgcggcgcctccacctccgtctccattgcgccgcgccgccgcctccgccccggccaccggcctccgcccttcgcctccatctcaccggcgccgtctccaccttccgcctccatcgtgccacacagcctcgccggtcgcaccggccaccggatccatcctccacctccaccatgacgcgtcggcaccaccgtactcccaccgaccaccgccgcatcagcgtgtgccgcttccagccgaccccaccttggcgcctccgtctccagccagcgcacctccacctcggctcatccaaattcggtcagaccaagaccgagaacgaaaaagccaagaccgaatttaccggtcctgactttttttggatgaaattcgatcctgacttttcaaaaactgaaatgaccgaaagaccaaaaaccgagaccgaaattttcggttagaccgaacgcccacccctaaagggaggcaattcaatctggagcaagatatgagggacgcaaaatagacttattccaaatagaaaagcagaatgactaatgtactgggctggttcacaatgctgggctatactgtacggactatggtggatgcagactgagcttggaaaaaaaaaacgcaccaatttagccatttaaggcaattccaggatcgagcctgccctgcagccactttgtttcagaagcaggggaaaaacagaggctcttctgcaacagatgaaaggaccaaccatggggcaggttaaatcagttggttcagtttcaaataattgtctgcttattaatcgatgaaatccaagtgttcaatcagaaatcacccacgcgcatcattgcgtgaaaaaaactccaacttatcgagccttcttgtgtcgcccctcccccacgggtgaccgggaggcgacgacctcgccggcgctcgtctcccccttccctcctcctctgcctcgccgccgcccagcatgggaggaggacctgctcggacgaagacctgcgaggacgaggagggaagggggacggcggcggggcttcgtcctcgcgctcgggcatgggaggaggacctgctcgggggcgttggaaccggccagatccgtgccgcccagccggatctggcggtggaccagccgacggcggggctgagcggtgtggcggcgatgtctggtggtggtggcagcggcgtcgaggcgttggcggcggcgaaggaaaccaccggatctgcgcctggacggcggctggcgggacggtggccggcggcggcgtctggtggcagggatggcgatgacggcaagggcagcgaggggatggcgtcggtgaggtgaacctggccgcgccggcggcagatctagcgcccggaggtctggcggtcgcgacggtggtggcgacgagttcacggcgacggcggcgcgggctaccacggcgggccgtctgtgccgtgtgtcgtcggagctcgacgacggcgacaaggtgcgggaggatggcgagatggcggcagggatggaagggcagcagtggctgtggttgtggcggtggaggtggcgaggggatggtgtcggtgaggcgaacctggccacgccggtggcggatccagcgctggaggagtctggtggtcgcgatgatggtggcgacgagttcgcggcgacggtggctcgggctaccatggtgggtggtctgcgtcgtgtgctgtcgaagctcgacgacggcgagaaagggcgagaggatggtgagatggcggcggggatggaagggcagcagcggctgtggtggtggcgaccgtcacaacggtagggggggcatggcaatctcagacggctagccaggggcgtggcagacttccgcatccggccggcgcagtagtgtttggaggaggggttggaggccggcttggcgcagagaggcgcagccgatggcagcggaggccggctcgacgcgagaggcgcgagcggtggagatggaggctggcttggcgcgagagacgtggccgatggagggaggccggattgacgcgagaggtgcgtcgggtggaggaggccggcttgacgcgagaggcgcgaccggcggtggaggaggcgacctctgcgcgaggagctgccggtggatgtgggtggtctttggcgcacgaaggctggcccgcggggagcgccggtgtagtggttccacatggcggcagaggttgaggggtggtggattgctggtctagcggcggctggtccggtgctagtcttctcccgggcttgtgtgttggcgctgtcagcgtgtgggtggtggtttattttttcttttttcttggttacgaccctccaggttgtaatattataattttttcctgctctatcaatagattttcgtaccgtcttgtgcgagttgttcaaaaaaaatcagaaatcactgaagcagaagccctgtgcatcatctgacatgttacagctaaaatgtttggaagtcactgtctctgttagcctgtaagcctgtgttttaggacgaagatgaactgatgtaacaacgattccagcagatatttctctcaatggagtagtaatgatttacaagactaatcccccacaaagagaagattcaaacaaaatttacaagagagacaaagttcctacaacacactgactctgcgtagcaactgaaaaatcttgccaatcagtgccctgcccatgcacggtggtggcgaggatgtcggcgtgcggcggcgcgccgccctttgttcagcaggacggctgcatcggcggcggaggaggacaccacagcttcctgaggaacgcgtcgctgtcgcggagctccccccaccgccgcctcatgccgcgcgacgtgcggcagtaggccgccctgctgatgtccttccacgaccgctcgccgtcgccgtcgcgcttgaggaggaggcgggcgagctcggcgtcgtcgtcggcggtgaaggggcggtggtacacgtcgcgggcgaggtggtcgcgccacctgtcgcggcactgcccgggcgagcggcgggggcggcgccccgagcgcgccgccgccatgccctcggcgacgcggcgccagtggcggaagccgttctccgcggcgaggcgcgccaggcacgcgtcctcctcgggcatccacgccggcgggatcctgatgcggaggacgatgcgcttcccgccgctcgtcgggctcgccgccgccgccgccgcctccgcggaagacgggaaagcggccgaggcgggaggttgccctgctgcttcttgctccatgccttgcaacgccatcgcgacgatgatgacgtcgatcttcttctccgttgctggttgctgatcgatcgatgggtggaaatgacagaattcggagcgcacgcacgctgctacttatggtgatggttacatgatccgactcggagtcttccttcgtttcattcttcacccaaaaaaagaacgccactctgcgcgccaaattcaaatgtccgactccgactagtattccaattactcaaggcattgcaaacacacacaaatctaacactaggtttaccaataaaaaagagatgaggcttgtattaattattatgagagatgaatttattcaagtacagttcattgtcatggtggttttagagggataatgcaagccgtaccaacggccaaaagaaccaagaaatgtagtacgtcatgtcgaatcgatcagaagaacaaagtcctggaaaacaaacgaatgaacgtatagatcgatgggtttgcattagtcggattgacccgatgatgattagttgacgaccctgcagtgcctcctgatctcgccggggtagccggtcttgacaccgacggatgccatcttgacgaacgccttggcgaacttgtcctcccaccaccccgggatgttggcgttgtccgacaccatcttcgccgtcgccggcgacgtcagcagcgccgcgtccgacgcgaagagcaccttgtgcgccaccacgttcttgtagtactggttgtcgaacgcgttgggcgtgacggcgtcctggttcaccgtcgggtcgttgctggaggtcgggttggccgggcacctctgcttgaggaagttggcgaagccgccgttgatgtcggagggcgcggcgacgcggtccgagacgaaggaggagcagtgggagcggccgacggtgtgggcgccggagagcaccaccatgtc

SEQ ID NO: 73294 - DNA, 1492 bp, Oryza sativa
ccatccatccaacaacgcaagttgcagattctacttggtcggagtttcagcctccggcgaactgctccgatcgatcgatcgctcgctcgcggggacgcgacgaggtaacgacgcccatccctccctgctctttcttctcttcgatccttcttcgcggtcgtgtagggatccatccatcaaatctgaatatctaatcgaatcaatctatatggcgttgcgtttgcgtttgatttgaaccaccatgatgatgatgatgattttgctgctctgagagatgatgctgctgctgatgctagggtctgcttgcttcatctgtcgtagggtgggtgaatcgcttaggatttgggaatggctcgccgtttgattagcccctgccaaggctctggtttgcttaacgccggatttctcggcgtcttctcctcccaccatgtgattccactatccccctctccctcctcccttccccatcctccacttaaccaggcacctcactcacattccatgctcaaacccttgccctcctctcctctgcaatttctttatacattattcatacacacataggtttcgatatagattctcctagtgcgctggaatattgtttgtactagtattattaaagtttatatatgtgtcgatgcctctaacacaaatgatacatctacttgtcttctcctcactgtttcttccccccaattctattccctgtttataccagtatcatcgcgctgccattgtcatcatcacataggagttccccaactgaagaattgctaccttcctaatttaaggaaggaggtgtgtgcctcccccttgctctcagatgataatctcatgccacccacccagttatagcttttgttgcatggcattgctgctgttgcttatagattctagtttgtattgttgtaggtctcgcattggacaagaccagccacgccttccttgtcgctatatgtctgtatcatctcgcttatatgttacttttcttcattaactccatgtttttacttctgtagagtacatcttgatcggacaatttcccgatatttcagagtgcaaggcttgccagcaagaggacaacttgttccgttgcaaccgagccgccgccttccacaaccgaagaaccagagatggatcttccaaaggagatattcctgaaagaatacaaaaagcctgattacttatttgactcggtaactacatacctctctttttttgcaaccatccaaaattttcaatatctgaactccggcttgcaggctttctaacaccatatctatggatacttagctgtttgcaatctgaaatttaactagatatatatgctagcctgtatgggcatcttggcatttaatgaacataatgggctcctttctgtttgttgtctttactaccttcctgactttatgctgggacttaattttgggcaggtcaatttggaatttcaacttggcgaagacaaaacaatagttaccatctaaaatagctg

SEQ ID NO: 73295 - DNA, 3409 bp, Oryza sativa
ctatcccagcgtagcatcccattataatatcggtattgaagatgacaaatgtgaggatcatactgacaacaacatagaggaggcatcaagtatcgcatctacaaattgtggttctgctgataagcatcagactatacaggtgttgcctgtttgtttagcaaatggagataacattgatgatgttgcttcattggggagttcaatttgtgaagacgttgaagataaagacaacaaaagtaatgctaattgtatttcagaggtgagtacaaaaggaagtttcgcttaatttctgaaaattgtggctgttagcttgttatatatttctgaattttactgctattgtatgtttcaaatgaatttgaaagggagctccacatggaaacggaatgccacttgttaggtccccagcatcatggtggaatttatgtggagttattgatgtgtttgctggatgtaaagattgaattgaggtgagaagatagttcattccaattttcacaccgtgacatcgtttgaattttgaactgagggtactccttttaaaacaaaacaaaaggaatccagctgcatggccaattattttgttgatcatcatctgctgcaccgtgggttcgcacaattgttacttatttattttcttgtcaatattgtctaacacaagagagatttttcttcggtggtttttactaagtatgatactacagtaaaaaaactaaattgttgatttattggggtataatggtattttttttcctctctatatgatttgggttttttatttccctttttttccccaagagactggcgttactcgtgtggaccaccagcctatctcacttaaaacgaaatataccaattttactggaattttgccatcctgcaagtatcatttccttttctcacccaaccccgacatagttcttagatgattgcttgattacaaagaatgatctgtaattttattatcgtcaactctcttcgcagtatttggacatgacacattttctgttgtatgcagatgttggcaggtcatgggtggaactttgggacaacagaaaactttagatgctcatcctaatcctgtgttgacaatgaagaagtatttgacagtttggattgaagtattgaattgtttatagtgaggctgtttgtcttggtggatgtatatatttttttggtagattgcctgattaatttttgacatgttgtggttcattggctttttctttaaaagctgagtgctattctttctcaagaaagaaagcttcaacttactgtaattgattttgaaagggaaatggaactggaaatgcttgttgacttgttgtatagtgtatactatatgctttgagaaatatgtcttctacagttgtctggatgtacagaaatctgcctgctacattaaagcctacgtatttttaacaagaaaaaataaggcattttctatcccaaaactaatttactggatcacttaacccccctgaattatttaaaaaacaagaagaatttaaaaaaatgttgagatgtaagttacaatgcatataccattctacccaaaaaaaagagagagaaatagcgtcagggagtaaagtaaaatttttttagtagttgggagtgtaaaattagcaaaaacaactaatttaggggttgatgtgtctgaaatagttcctggcgagtaaaatgaactttgtttttctttttaacaagaactaggaaacctgccagatcaatattaatcgacggctgtttcgctgtaagaaaatgattattctatcttagtctaacaacataggcaacttgttctggagatgaataatttaataaccacagtaaaacttcacttatcgtttattggcatgtggtaaagtcaaaagaataaaatgagaaaaactgtagaatgcaagtatgcaacaattaatagtagcattgcatcgtatgtgtcagtagaaatattccccgaagtgattaatcctaaccctatatctgtaaagcaaattaacaacaacaatcatatctctactacttaaaataaaaaataagaggtgcttccatcatccataaaaaaaactggacgataaaaaccaaatataccaaatatgtccgtaaaaaaaaccgcgtggaaaaaaaaaggaaaaaaaccaaacctgtccaataaaaaagggcgaaaaaacgaaaaaccgggcgaaaaagccaaatatatccgatctagaaaaaatatctgtaaaacaaattaacaccaccaattatatccctactacttaaaaaataagaggtgcttccatcgtccgtcaaaaaaactggcccgaaaaaccaaatatgtccgtaaaaaaaaccaggcggaaaaaaaaggaaaaaaaaccaaacctgtccgattaaaagggcgaaaaaacgaaaaaccgggcgaaaaaaccaaatctatcggatccagaaaaaaccgggtgaaaaaaaaacctaaacctatccgatcccaaaaaaaaaaggggtgaaagaaaagggaaaaaaaaaccggatctgtccatcaagaaaaacgaatccgactctgggtaaaaagaaggacggaaaaaaattaaaaaaaaaaagaatcaatccgattctctatctctaaacgaaaaaaatccaactctatatccgattcctccttaaaaacgaaaaataaaaggcacctctcctctagaaggattggagatctgtttgcaaaaacataacttacatgttaagagcataatatttttatatgttttaatttttgggtatgtacttttgcatttgagtccctgtaatttttatatttatatttaagtccctataatcttgcaataaggtatttgaggtcgttttttaaaaaaaataataaaagggagataacaaaggcagaaaggtgcatcaaaagaaaaagaaaagccgcaaaaaaaataaaggaaaaaagaaaaccaacaacaacaacaaaagtctgtttccctaagtggcaaaaaaaccatagatccgaaccaaaaaaatcctattcctataaaggcaaacaaaaagtggtgaaaaaaagctagatccaattcctttcaaaacgaaaaaaaaagtctgattcctataaaggcgaaaaaaatctgaaaaaaacatctaaaaaagttcgtccgactctctaagaaagtggcaaaaaaaatggtttgtaaaaaataaaaagctggttcgtataaattaaaaaatgaacgcgagaaaaaaatagaatgggtgaaacaaagtctcagtatatatctcttctctatttctaatctaatctaactatttaaaaagagaaaatgcatgagaaaataaaaacggttcaaaaaaacgcgtgagaaaaaagtgagaaaaaagcgaaaaaaacactctaaaaaggttttccatcttccataaaaaataaaaaaacatgtgagaa

SEQ ID NO: 73296 - DNA, 7670 bp, Oryza sativa
ttccaaattttgccccaacaattatttggcaactttaattttttttagataatggaatataacatcccggtttttactcaaaagagttacagccaattattacatagaagcgtttgacgaacatagtgtaaatctaattgaatagaacacaccgcaaggaacaataaagaatctagcctaacataaggagattacaattattgaagtctatttgtaaatctccaaccataattggcaaaaagttgtataaccatagtctccaactttcgatatgcaactttcagaaactcttcatcatcttcacacatttgtagttgtgcccaaaaccgaagccaatgggttgctccgaaaattattttggcaactttaatagtgtatataaaagtcatttggattgataccaatttttgccaagatcaatatagttgataacttgatattactcttccctacccaaaaaagccaaaacttgtccaaggtttggcacgaaccaaacatgccctgaaaaactgagcaacgtttgattagacatctgccctgctatcttcgggccgtattgaattgaagtctaccaaattctgcccgtactaaaacccaatgaaatgttaccctaccaaaattttgttattgcttggcatttgtcttgtgggcacattttggtttcagaccagaccatttttgatagtgctaaatattttggtaggggctcaaatcaaaatgatactagcttcaaaccaagatgatagcgcttaccagcaccacaaaactggagtactgaagatgatggcgttttgtacctgtcccattcaaatcacttgcacagcaattgattggaaaggggctaaggctactcttgatttctgttagtaacaagtataactaacaaccgaaagtaatgatggcatcgtacaagttgattggtcagaaatgaatagttgaaatatacaggcaggaactcgacatcagtagttcagtactactaccaccaaattggctaataccttctacagttctactcacgaaatctaggacaatggttgatgaaatgttaagtaaacatgcctctaaaaataatggaaactatcaactacaccctatcgtgtcattacttcatacacaggcttgtcccgcttcacctgattttttcatggacctactcaactgaaaaacagggtgtctgcacagcctccctactcctttccgaaatttaaatctgtcaaataaaccttccacattgtcattactgaatttgcttgcagaattgctggcttggctacttgaatcactatctatgggagaaaattccctgctgctgttgtcatggtccttattgtcgcgtttcttgggtcgtccagcactaccttgtgcgtcattatgacgcaatggttctgctctaaagaggaagtgatcaagagtagccccactaatcattggaaaatcattattttgctgagttgaacaaatggtgggcttgtccaaatgctctaatgcctgaggttcatctttgtcacttggggaaccagagcttgatgggaatgcacttgatggcatagctgtttcttcccgtcccttcacagtcttcaagataagtgtcttgagaaaattcatcacttgaactgcatgtatcaaagcagtcaagggatcggccatctataaaagagatggtatgttacatgattagtctgtgaaatagcaaattctgtagatagcaagaaaaaataaataaagccaaatagattttgagaataacctgagtcatgtttggtgcaaaaaccatagcaatgttgcgagcgttcatcttattgtagttttcatgttccacaacatctgccatcagattgatggcccaatcaagtagtgctgcttccactggaggtagagtactcgcaaggagagcgcattcttcttcagtgttgcagtgcatcacttgttctggagtcaatgagtccaatactccacttggaagttcacgaaaccatgcctaccatcagcatcacaccggtcatggaatggtgtagaagagaacaaacagataaaaagtaacaatacaaaaactcatttttctgtagacttcttaaaaatataatttagtctatgtatgcgctagatactctagagtctagtctatctattgattactgtctgaaatcttatatctaaatctctgtactgcataaacaatgtctgcattatcatatttgaaggctttgtacatgttcaatttccatagagaaagatttccataaggttgggttttatgcatttaaaacatatggtaaataaatcaaaggttaattaaaagcacaagaaataattgtcaccacacctttatgaggcccgtcagacagtgcatgtcaacaccatccggaacaacacccatgtttagttgctccctgacatgtagttcctgactattgtctgcatttattctgaagattccttcagcctgggaaaacaagaagcagaatttcagaacttttttccattttttgctgagtagtgtaaatgctagtattattaaggttccaaaatttgttggccatttggccttacctgaagccccccaagttgatataacttcttttgcatggtcaatagtattgttggcacactgtttcctctgttatcgtatgagcattgcatggacgttggtgaaactccaaatacactcacactgtgtaaggaaatagattaaacataaactaagttagggtctgagctttgctagaaattcactaataaaggtaggctgcaaagttcttttaaggaaaagaacttataacaattgaacttaagaaacagaaatgatccttagttcccctctacaactgaaaggttatgtatcatacatacaacaataccaggataggaatcagtaaggggtaacaactaactacaaaagatgaaacatatggagcgcccttgcctgttcggaaaaaagactttggtgccccaacggatggttgagagtaagatagtaaaattaaaacagtgatagatgggacaagcagtattctaaatagtgctaaaattaattatattttggcataaatttcaaatgctaaaagtgcttatattttgggactgaggaatatatcacaacatcccaatgcctgacaaggacaaagagagtcatctccacaaaaggaatgtgctttacaagattccccagtagtcgaacttggcagtgccatccttggaaatggcaacagttctggcttcctgtaagagtttgcaaacgtaacagtcctattggctcgtcgctcgtgggtaaccaattccgaatcggtaataagggctcggcgaggcaactattctgtgtgcacttttgcttagttacgcggcaatgtggcactatatttagcatcatgccatgaacttaattcggaaacgaacagcagtgcagggtgaaaatgggcttaatccacacaggtagtagcaccgcagatgctgatctccggagcggaactccaattccagagcccccgcctcaaatccacggagcatggagaaggcgaagcaaggcaatggcgcggcactgacctggcgctaggcgcggggcggggcacgtcgggctcgaggtcggcggggaggccgaggaaccccacgaagcggtcgaaggtgacgtgcgagacgtgccgcacgtcggtgggccggccaatctgcatccccgcagcagccgccgccgccgccgcggccccttcgtcctccgcggcgcgcacgctgctgcacagcagcagcgacctccgcagcgccgccgccaccgtctccacgacggacacccctcctcctcctcctcccctcgccgccggcagcatcagcggcgatgacaccggcacctcgccctccatctcctcctcctccccttcgtactcctcttcctcctcctcctcctcctcctcctccacctcctcgtcctcgtcgtcctcctcttcctcctcgtcggagtcggggcgggagaaggggatctggtggccgaagcggatctgggacggcgccatggaaggagtatgtatctaggatgccaacttcctcgcgagaagcaaagaccggagagagggaggaaggaaagaataggcggcggtctcggtggtgggagagaagtgggtttggaggcgtgacgagaggtggcttaagcttaagcccgcttcgctgcctcgctggtttgcttgactgcctctttaaacttcgctgtcttcggctctaaaaaaacaagcccaccgtttaatccccatctgccggcgtcctaatcatgcgatcgatcatttttgggccctctcgtctgccttaggtgaccaatcgaagatacatttgaaaaaaaaaacagagtaatggaataaacaacagaagccactgtagtaagatggagaagaaaatgaactcttttttttcatgaaatggtgcagttgttacagccaatggcaggtgtgaatacattccgtaatgctcgtaccatcggggtgacaataattgcacggcttatgattagatgcaaaccagtttttcaatcaatcggatgatggtgctcgtcgaattttcgtgaggaacactgcacatcgtcctggaaggtcggacttgcagattagtacatgtcgatatttttctgttcttgcaagtcaataatacacgttgattcttggtgccgtgatgaactaccggttaaaagtgtattggttaaccagctttttaaatccgttggtccgtagacgccaaacggacagccccttaaacttttgacttgagtgtgtgcattagccattgtacatgtacgtacaggcgtacactcgcgcgtgaagctgtcttgagctcatactcaaaccatcaaatttgatgtagcaaatcttcctttacttgacaaatgtttcctgagagtctgaaactagtactaatactacttcaaagatcgtcaggaatgagctccagacaaatttccgaacctgataagcatggatactgatttgctgttggacccgtgcagcgagcttccaatccctggtctgttctcttgatcaagcaagcaatttctttatctaaagaaagaaaccaaattctgtctgtttattcctagttattactagcattcaggtacgggcattcacaccagtagctggtttccccggaacaaacctgctctcggtttttcattcgtctaatctttacatcagatgtacctctcatcacccacatgcttgtactcgctcatgtttctactttggcactttgccatggaattattgggtgtcaattggtgtcagtgaccgtgaggatgtgaccacccgcgaggacgagatccttgcgcttagagccggtacaataaaataactcaacaggcttcaaaaagttacatatcatcgtatttctacgtggaggaaagataaaccagaaaaaggaagggaacggacgactaatctagcgccgacgatagcacggctccatatgcgcatgcaactagtactagcgattaaaaatacattttttgggccccacaccaccccatccgatcccgtgtggtttgctctccttctccttccgcccaagtagtatttcccattgccgagcagtgcaactgcgcaacacaggttcagatcaagcacgcggaatcgctctcctcttcctcctccatatcttctccgatgcagcgacgcttcttcctagcatcgccgtcggtgccaccgttcgccgcggcgtgcagatgaaggccatctgaaagcgtcggcactctcttccgttcattaaaagactgatcccagtttccagcctccgggcgacaccactgtgtgctagatctgcgccggtcgcttgatcgacgcccaccgcatgaagctggcgttgtctccatgctaagaccctgtttctttcaacttgagattattataatccagattatgagagtaaactgaaagaaacagacaacttattgaagtagcttattataatctggaacccagcttattataatctgataagctcatttaggtgagctttttccaaattattgggtaaaaaattacccatcatgccaccccacttcctctttagacttgcaaacccaataatctaggaaataaacaactaaccgcttattttactacagattataacaatctagcttatagtaatctgactcaataatctagattataataatcctaagctgaaagaaacagagcctaaatcttgctgtcttgtgggtgatttcgttgattaaaacaaacaatcggctagggagtggttcagtagttctgatgtcctccgtaccagtggatttggttttcttttcttggttttttctctatttctgcctgatctcagatgtatgcgtatcttgtttacaaaaagcggattttgtttccgtgtattttttcgccgctgagtgtattcttttttacctcgctccatctgattttcgatagcttccattcaattctattcatgtagacataagaactcatgtttcagaacatgaatggccacaaacatgaagttcacttttgatcatacactgtaagtactcataaagtatgtgcatgtataattaaatatttctttcatgagatgtagtaagcacaatagctagtctattgtattagttaactgtaatattagctataaaatgatatggagataatggagccagcagcagactatactattgaccttgctcttaaagcacactactactagaatctacggagtatatataagatccagacatttttctgtcctttccgtgggacacacttgatgttctttttcatgtcttgtggcctgaggtcctcttgattggataacggacacattgctttagtcaaaagactttattctgaaacctgtagacatgatgagtactagtatatatctaaacctggttcgttagtgcatgcaaatgtcattatcgaattttggtatgcttgcttcaaaaatagattttggagcatggatgcaatggaccataatcatccagcatcgctcgtcagtcatcacagattcgcagttcactggaaaaagtgcaccggaggtccctgaacttgtcaccgagatccgaaaacgtcctcaaaccgcaaaaccagatacatgaggtccctcaactatagaaaaccgatcacccgagatccttcggtggttttaactctggttttggtctatgtggcagctgagtcaccatggactcacctgtcagcatgccacgtcgtcactccctctctctctttcccttcctctccctttctcctctttctctctcttcacttttctccagcgggcatgggcggcgggggcggccgcagcggcgacgctctgggagcagcggggaaggtggaaggggaggaggggtctacccggaggtgctgcggtcgctgctggtcacggtgtacagccacagcatggcggcggcggcggcggcggtgaagaagaaggacgacagcatcgagtgcgcggtgtgcctcgcggagctcgaggagggcgacgaggccaggttcctcccccggtgcggccacggcttccacgccgagtgcgtcgacatgtggctcggttcccactccacctgcccgcgttgccgcctcaccgtcatcgtgtcgtcgccgcttcttctttctcccgtcccgcagacgccgccgtgatgcgcgacgacgacgtacgggcccgcccgccatggccgcgctcacctccca

SEQ ID NO: 73297 - DNA, 741 bp, Oryza sativa
tactgtgctaccatattagtatagatattaaaaagttacaatatttagttctctctctgagctcaatgaaattaacatgcctatcactttgcgattttggccattatcattatgaccttaccctctaggttagtcccagatttatattgttatattcatgcaatatattctgttggtcacaggtttaccgcatccacctcgatgtgttgctgccaagtcgcgtaaaaaacgcaaggtagctatgatttgcaggagagaagaaagtaagaaaagacattctacactaataaccttatagacaaatttgttttgttagatttgtgatcatttggctgttgttccagggttatatgctgatactctctccctttcatctcggtctgttcggcggcgcaaaatcccaaatgataatattgtacaccaaccacaccatacacaactacgtcaacataacccaacctcagctgctcagccaggtggcgatggtacctaatttatttcttttcaattttcaataatgtattgtgatgacaagaaatccttaattcttctggtctatctttttcttgcaccagatcataggcagccattccccggtcgacaccgccgtaagttctattactttttttcaatcttactgttggcatattcattaactatttcttagcatatgagaaacatgcacgctatgtgtgtttcgaatatgcctaggagatatatctcctcatattgcctcagact

SEQ ID NO: 73298 - DNA, 2033 bp, Oryza sativa
tggatgaagaaattaacgcctcgggaatagcagagatttttccaaccagtttttcttgctcaaccaacacggtctcctcatccaacccgtcaaaatcttcgtcagacgcagtcaaaccttctgactccggtatcaaactcaactgagaagaggtaaaagaaggaccacccctctcagtaagattactatcagtagccatactcacatcagagacacccggtccagacttctttcccatgtccttgtcattttccccatcgtcatttctcttcccatcacccatccccaaaattatccatatccaaaggaacaggatccccagcaccaatatctgactccactttaaaagacagctcatacaaatgatcaccaatggccacatcaacaacatcagggattagagatgggtcaaggaccaaaacttgtaaacgagctatctcataccttctagtaaataacatatcaacagctttagtaatcccaagaatagaaccaactgcccaaataattaaatattccctcaactcagaaggaagccccttacactgaacccaaacttttggaatgacatatttcacctcattcccaacacctctttctatgatctccatctgagcctcaccaactttagtgtgcacctttccccattccaccatgcgattcagctcagcagcagaaggaaagatggtatgaaaagtgttatcaccattgtcatgtaccacccacctccatttaccaggaattaacctctccaattcagatacaacagcggggggccctcagctttaactgtcatctgaccattagatattttaaccaaggccgccctggggtcatgcctaatcctttgtccagctgggagggggatatgaaaaaaacccaaaccatcacccccataaccacataattgagcagtaggtttcacagctgatctaaaaacaggacaccgggtagcaatgtgatccacactttcacaaatttcacaataaaattttgatgaacactcctgaagagtatgccccttagtcaaacacctatagcagtaaggtttacccaatcccttagtgtctgcctttgatttacctttctctgaatcagtggcgcaaacaagcaacccttgttgtgcgggttcagcacccaccgccggggtaacagatgtgatgacatcacccattttagcagcagcaacaagagtaccacccacagcaaccgatccactaactgacccagaggtatttgcagttaaacctgcagaaccactagccgaagttcttccaaaactcggtatcacaccaactgaattaactgcagaagtcccaacaatcttacccacatgtccactcggcgccaaacctgcaggtagcactagcgatgctgacacagaggtagcagcggctccctgaccaccaccacccagcggaagaccagctgcaggaactccacccgggtataaaccacccggcggcccaaaagcacctgccggcggcgccataccacctgccggcacaccactagatccacccgtcgctgcaaattgaccaccagacgacggcacaccgaagaactgtgacccagatgcatcacttgccggccggccaaaagagcccaaagggaaccctaaaccggaattgaagccagttggcccagcattctgtccaaacccaccgttccaaccttgtcctcctccaaaggtgccatgccatctaccactgttgccgtgagagaagtcatggcgattgttgtgaccgccaaactttccacgaccccgggcccttactcctctaccatctctggcttggtatggaaaaccacctccggaacccggatgaaaaccccgagcaaagccaccggcatgcccggcagcaccgaaaccctggcgattgtttctctccattgggcattggcgaaaaactaacgacagcggcgtacgagcgagcgccagaaagagattgatctcccaccaaacacctgcgcctcacgggaccaaattttctaaaaagagcaactaaacccggttatgggcctatacggga

SEQ ID NO: 73299 - DNA, 3339 bp, Oryza sativa
agaccaataagaccatcgtcactgccgctctagctcccggcggcggttgctgcaaccacacatggtccttggccgtgcgcaccgccgtcatgttcgagcccgtcctctctgcagcttggtgtgttgccgacgccctcctcctctcccgcactcgccccgccggctgccctacccagggaagagagagagagagaccggaggcgcatgcgcggccggtggccggcagtggagaagagcggcggcttgctcgctccgtcggaccacctcacccgcctcgcccggcgacctcctccccacccgccggccagcctgcccaagaggagagaagtgagagagagagaggaggaagggagaggggaaagagggagggtgatgacgtggcatcctaacatgtggggcccacgtgggtcccacgctgatttggttcagataaaaccacggtcaaaaccaccaagggacataatgtgaacggttttgtaagttgagggatttcatatatctggttttgtgattgggggacatttttgtaagtcgatgacaaattgaggggccttcggtgtactttttccttccaatcccagtgggcctttcttcactcattccgctgggccctgcatcaaaatctctctatctctctctcctctccttttctttaattttggcttaacgtacgtgccactacaaacaagtactccatatttttctcttcaaaattcaaaatcattggttacttcaattgcatctctcctcattacattgctaatcacgaaattaaatcaagctcagtgtgcggcctccaaaatggattcaaaagaaatcgtaaaatggaggcgcctcgatcgctagctatccaagatggacggcgtcgacagggacacagcggcgcggctcacaatccggcagcgccaacgtgtgctgcagagggccatggtgatggtacacaagctacccttacggcggccgcggcttgtaattaatttccttattcattagttagctacgtacgaaattgcatgcactaatcaatttcatcaaactagtgtgattgtccacacacagattgtatggtttgtatcattgttttttctcaaataatagcatacatattttcacatttttataattaaaatatattaaaataataatatactttaaattatgtgctaacctgatcaactaactgatgtgtgatattatgatgaatatagataattccttactgttctattaatcatacaataaatcaaagatatgtttttaataaaaaaatgtatttcaatactaattatttttaatttaaaatttcaattatttttaaattgtattcctatatgaactataactctcattctaatatttctttttaaaatttctaatttccattatttaaaattatatttatatatgaactatagactcttcttctaatatttcttattatttttaaaatttagaatttccattatctttaaattatttgtttttatttcctaatttcatctattcctaaattatattgctatatggactctagaaacttatactaatatttctttttttttattttcaaaattttattatttctaaattatattttttatatggactctaaactattctttcgatatttttattttttttatatttctaattttacatattccaaaattgtattgctatataaactctagactcttcatccagtattacttaattttaaatttgagttttagatatgtacaggttatatttatgtatatactctaaactctactttttgttttattatatgtttaattctgaattttagttagttctaaattgtatacctacatggattctagtccccgcttccaataatccttattttttaatttcgaatttcaattatatgtagaatgtacttctatatggactctatgttctttttatattccaaatttcagctattcctaaattgtattgctatatgggctatagactcttcttccaatattacttatttttagttttgaactttagatatttacaaattgtttttctatatggactctaaactgtacttttaattctaaattttaattagttctaaattgtatacctacatgaactctagtcttctgttccaatattcttatttttttaattctgaatttttattatttctaattgtattttgttgacgaaaaaaatcgaacacaccggcttgggagatctgcttagctcctgtgcaggtacaaagattgatgagatgcgggcttgccagtcagtttgatcctgcaactgacaagatatgcaaatagcagatcaaaacagccgatcggctgacaagccgatggagtagttccagccgatagccgataacagccgatgccgataccagccgatagcgatagggtttaagcaatcggctatatatccaatgtagataatgatataaaggcaatcgactgatgatgatataataaaataacaatatagtcctgtataaaccaatcggctagcaatgatatgataaataagcatcgatccgagggttaaaacacacatcggctggaggtccgatatcatgaaatccacaagattagattaaacagtgaaacctttgttgtcatcggttaaatccaacttatatgtatatgcaatcattatgagccgatgcaacatccagataactcaccggctgaaaccctgatgaaacccttattggcaatcaagaagcaggctagagattatggttttaagcacgacttagtagatcaaacttaactgatgcagcactaagtatgaaaagaaacataatatctagacaatcaagccgttgactgagttttcagggtggtagatgtctaagctaatctaatctagtaacgcgatttagccgataccggcagaaaccctaaaacgagaagcagccgatagagctaaattgacatgctaagactagattaacagaaacatatgataaataggtaggcaaatatatcatccaaaccagagcaatccaaaaggtcaaatgtaccgatgcagccttgaacgacgccgacgtagacgatacaattgcctggaccggcggaacattggacttatcccttcgccggagatcaaagacgatgtagccccgcgtcgggtgccaagtcccaccgaaaaagggtagcgatgcgccgaattgtattgatcgtgaagatagattacaatgaccccgggtgtacatatttatacccatgggttgatacaagtccttgtcggacaagaaagaaaccttcgtaaagataaaatgaaaagataaagtccttataggacactaaacacactttcctaaagataaaagaaaactaa

SEQ ID NO: 73300 - DNA, 1356 bp, Oryza sativa
gaaaagcacgatggcccatcgtgcttcgggccggcccggcacggcccgaggcgtggtgggccgtgcctgggctgtgagtgcggcacgtgggctggcacggcacggcccggtgcgtcggtcgggccgtgccggcccgacaagcctcggcccaggcacggccgggcctgggccgtgccgtgccgggcggcccacatggccatctatagctggaattcagatagaagagatcaatagattagcaaacaattgcaagatgtgttttcaccctggaggagaaaacataaaacatactttttttaaaaacattactgcataatttcacatgagaatgcttggaagccatgccctcttatgcaccaatgcctgaacattagaagcattgatgtcctgcggatgagaaaaggttcaatgcttgaaacctcaagtatgctaaatcaggaaagtactggccacagtgtcaagaaaatctcaatctaccgccactgcaccatgcctggccattagcctgaaggtcggtgtatttggagtgcgagtattgcaaggccacagagctccagtagtcattgatttggccaagtcaatattgatattcccaggagccgatcatgttgatgcgctgctaaagaagacagatagggcatctgagcatctctacatctgcacaggtagagggacgataaaagaaatccaacaatctgcaaagtttgcaactgcaaatgatcaaactggctaggtatgctgatcttagcctaatgtggtgggattttttttattttttaattttattaatagaccattccaaaaatattgcgttgtttagccacgccaaccatggtggcgtggccaaaaggttcagatttggaaatactttttggaatggtctattcataaaatttaaaaataaaagtctaaaaaataattaaaaaaatcatgtgctagtgagttgttagtttccaataatagggtatagatggcaaacccaattcctcaaacaaagcaaaaagaaaaagaaaagatgtccatcattatattatggaggttgcatattggcatatgtatcttgctttttgctagtagagactgttggttttaatgactgagtttttttttttggtgtgtgtgttgggggggggggggggtgatcaataactgctttttcctgtgattttgtggtgtactgaagtcgtctcttttcttggtatggttttctttgtataaggagctgagtgttggtttttgttaagcatatcattggttttgattaaaagaaacatgtgattggttgcaaacggcgaatgggaacacaaatgctgccagggacattggcaggttcattctaaggtttgcagggtaatt

SEQ ID NO: 73301 - DNA, 1354 bp, Oryza sativa
agaatagtcaaaggctgggtgggctcgagcctggagcggctggatccgcctaccaatgaagtcggcagcgacttcatacctcgacaaacctcatactcggaggtcatcgatggcatcgatgaaggattgaagagaaggggtcaagggaggttttgcggtccaagacgaaaatcttgtctggttgttcctcaggaacaatgaagactggatcagaattttctatctgaagatagaaccacctcacccgccatttgctacgagaagaagggcgctggaaggggatatagcgtgacttcaggccatcccggagtcggaaaccgaccaagaaacggctgtaccccaatgtagtcatcacaacgatgcgaaaaaatactgaggaaggcgatggaattggggttcaaatggagcaaggaaaggccgtagaaattcaagaccaagagaagaaattcagaaggcggagaagaaaaccacagagaatatagtcctcgatcgcaaccatgtgacccaggacaggctggggttcagtacctcctacttctctctccatggtcccgcgaccgggaagggcgccatccttctgtagcttcttcagcgacgcgctggtggaggtagacttgtcgagatccattgccgctggagatcgccggagaagggaccgaaatgagctagctagggtttttgcgggagcggagaagacgaggaatgcttggaggttggagagttttttcacaacaggcggacttcaaaagggatccccaaaactcccttttatagtcacacttccgatggtgcgaattccaaggaaaagaagagatggccgccggaaatttctgggtccgttacgtgcggcagtttgtcggactttaatttaaattcactcatgaccgttgagcttcacttggcgttgtcgattactcttcgtttctcagtcctcacaccgagaacgacaacaacctcgacatcagaagtcatgatcggttacacaagttcatttaagcagaagtcggggggctactgtcagggttatgggtaaggtataccctctacccttcgatatacgtcacatatcgatattgtatgcctgcgcgaatacggacggtttcggcatacgttaaggaaattcatcacgaggttcacagatggaaagactcctactcggacagaactaggtcgtcattgtatcgtgccgagtccgatgtcttcgagtcctacttggagaccggttgacctgcgatataaaaaggaccccttggaaggacctaaagcatcgaatctcgtagccagcacattcaccacagcctacggagttgaagcctacagaagccaagtcgccgggagatctaattgaacctgt

SEQ ID NO: 73302 - DNA, 1760 bp, Oryza sativa
tttgccttcacattggaagatatttttttggtacgttttggagttttggtgaaaacaaagaagtagtaaaatactcctacatgttactacatccgtttcaggttacaagactttttagcattgcctacattcatatagatgttaatgaatccagacatgtgtagattcattaatatatatataaatatggataatactagaaagtcttataatatgaaacgggaagtatttaacagaaggaacatatcgtgcataagaacacattcagccctgtcattatacttcgacggcgttatacaccattttgccccaaaacaaaggtgatgaagaaaatggcccacagtttagtccacttgccttttcgccaatgctccaaaatctccaatgtggcaacagtgaaggctatgaggcatactggacatcagttaggttacctgatgattgtccaccgtaacatgaacataccgagtcagcagtttgccctgacatgaacgtgccgcataatccgaccatcagcggccccggcgattggcaggtcaaaggagctttgacgcgtagcctgcagcggtcaatactatgcgactgtgcgataacaagatctgcatgctaggactaggtatctggtaggggcaagcaacagcaaccgccatatgtagtgtaatcttaaggtgggctctatgaattgtgaatcattgttagggtatcaccaatgtatattgcaaagtgatccatatagatgtgacccacgtaaatagtttttacctataacaatctccacaatgtatatgtatacaaggtatcattaggagaagagagaggagtagagatagataatataatttattccatatgggtagtccatatgcatatggataccttttgttattttttctatatggactagttgcacaatggtaatagatggctgaatggaatattctattgcttatggactacttttgcaccacattgtggatgtccttaaagccaatacccacaatgctatggttagaatttagtcacaagatgaacccacatagaatggaaaaataattgtttcatctcttgatcatgaagtgaatgagagagaaaatattttctttttgcttgtggtagaccttaaatataaggtgcactctaagctaatgctactttacacaatgtatatggctcactttacaagtgtaatcattgccttaaggtcacttttttcatacattgtggttgccctaacacttaacagctactactagtagtggtacaagtatattcggacacgatccaactgagatccagagacccttagagcaagtttaatagtatagcccattactagcttcaattcatctatagtcgttctaatagccaattcatacaatagttgcttactatactactccctctgtcccagaatatagagagttttcgagttgggcacgactattaaaaaggtagatataattaaggaaaaagtacgaattacccccctgaactatcgcggtcgtctgaattacccccctgaacccaaacaccggacattgctcaccctgaacttttaatactggacgaattacccccctcgacccaatccagagcggttttgtcctatgtggcgtacgcgtggcaatccggtcagcattttttttaaaaaaattgtgggacccatatgtcatacatacccttcccctcttcctctctctctcttcactcattctctctctctcggggtgcgcatgagcggcagcacgagcggcggtggg

SEQ ID NO: 73303 - DNA, 691 bp, Oryza sativa
actttatcattggtgtaagcttcaatatgttagtgcgcttggcgaattcgcatgccctatcttgtggtatgaactgagcacacgataatttatggtgcgtattgggggcttacaataagataatgccgtgaatttgctaagcgttcaaacccactgaagtgttgtgtgaaggtaaatatttgtaagtgttcgtgaaggaaagacatgcaaatattttgaatttatttatttagaaatgtagctgacatattagaaagttttaacacacaacattacatattaattagaataagaaaaatataaaatcgttctactcattagcctcatcatcgaaatttcaggatgtgctagtgtcctttttctttccctttcttctagcaccagctggaggtctgcgtcttgacaaaaataatctttcaggtgaatgtcgctcgcgaacagacctacgtgccacctaaataccgttgaaatcaacgtgcctgtagtcttgggtcagctgagttattggaggcggttcatcaatctgcgacggtcctatctcgtgttgtgctgttgacgaccccccaccgtagctacatggttctctgtaggactgtgtgctgccggcatatcccattatttattgggggtgtacattcctacaaaacattgaatccaaagttgtagcgcacacacatactggaactaaaat

SEQ ID NO: 73304 - DNA, 1924 bp, Oryza sativa
tcatcactggcctggcaaaacaacgcctggatttctaacatccgcggcaccctcactgtcccggtcatctcccaatttctccttgtttgggattgggtgctccacattcagcttacaccgggtgtcggggatcgtcttgtctggcattggacgagtgaccagcgctactcggcgcgttcggcgtaccaagcgttcttctttgaccagcactcctttgcttgtgccgatcttctctggcacgcgaagggccctgctaagtgcaaattcttcctctggtttgcatttcagcagcgctgttggacagctgatctcctccagaagcgcggcattgatagccactcggcctgccccttttgcgctcaagagcttgagacggcgaaccacatcctccttgactgcatgtttgctcgtcaggtctagttacgggtgttgtcttctcctggctgggctgccctctctcccctccgtggcagctggctgcaggattggtggccatcttctagggcatgtttacctgatcatctgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcaggataaatgcaagggagtacaagggggttataatataaaagggtagggtttacagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattctacattttagttgtcgagcaggttttaagaattaaaacactaacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagctcccaacccatcctagccataaacaagagtaccgacccaatccccctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaccattttgggggttttgaaaagagggggaggtgtgtgtccaattccaacataagccaaccattccatggtgtccaaatgatatgagaattcccaaagtctaaagttataaaaccacctaatgttgcctaattaatcagcgaagcatctacctaaatttatactagtggaaccatgaatataatgtccactagttagggttttgtttattctagggtgaacaaggtattaatatcaatagcaataat

SEQ ID NO: 73305 - DNA, 28371 bp, Oryza sativa
tacatgcatatgatgatctgtcacgctcacattgatctcatctcactgccgccatggattgcaaatgtgtgattcagaaatgcaatgcgacatacctcgacgaagcagtcgtggaagacgaggcggatgagtccggcgccgatgccggcgtccttgtagacgaacttcttcacctcgtccctcacgatggcctccacgcgggggcacgactgcttgtagtagcccagctgcaggccgtggcacgccgacgcgagcgccagcgcgcacgccaccgccacggcgagcttcatgcccgatgctgccattgctcgtttcagctcctgctgcttttgctctgagatgatgatgtgattgttggcgtgagatggatgaagttgacacgctaaatcgaatggatatttatagatggagagatcgatttaattatatggcgtagctaaggaacgatggcggattcgatgttgctactgcgattcgttagattggcacacggcgtatggagagaaatcgatcaatcattggtgatgagaaatcttagctggcatgaacatggctgtgcccacagttaacgaactagctagctagctgcgcgcgcgcggcttcttgatttgatattctgcatggatggagcctattctctctttgtgaactgtactgattttcctttgcctcttccagagaaagtgccatcgcatgatttgttgcagggaagtccacttgcttgttgttttcttagaattgagctgtgtagcattgctcattatttgatttgattataaattgagtcaaaatagtcatatactctttaatttttttttagaatggagctgtagcattgctcaatgttggattcataaagtcaaaatatccatatgatcaatagttttcttttgccacctctcagtcaatattcgggaggagaggttccctatgcaagtaaaacggggttattttttagcacatgattaattaagtattagcttaaaaaaaactttaaaaatagattaatatgattttttacaacaactttctaatagaattgtttttaaaccacattgtttactagttcgaaaagtgtgcatgcgagaaacgaagaagcgaaggttgggagcctcgagttgagaacaaaaccttatagtagcactagtacagaattcatttttgtggacgagcccctcgttaaatttcagacggtccataactgacccgtctggaaaaaattgtcctcccatttttccgtgcggacccttaataggatcgcacacgaaaatcgatttcgcatgcgggcatgttaagactaccgcatgcgtaaataccctccctcccttttccctctcaacatttcaaaaaattccatccatcccctccaactctctcacctcttatccttatccttaccctcatcctttttcctcaccccatcaccccacctctctctcctctcctctcatgcggtggcaggcgggcgcgatggctcagtgacggtgcccgacgggaggagcggggccctaatcgcccccaccaccgccgacgaggtggccgggagtggcgctgttggccccgcgcgaatccgcgccgcccccgccgacaaggaggaggtggccggagcggaggcggacggcggctgtccccgcgacctctccgctgcccggatccggcggcggcgcccgtctcccgccctcccccgcctggatctagcggcggcacccctctcccgccctcccccgcgtgacggcggcaacgagacgagcggcggtggcgacggctacgaagacgacgagctgcggcggcagccagccccaccgatgaggacgaggaggaggaggtggccaggagcgccgccgccgccagatttagggttttcattttttttttggatttttgtttttccgtgcgggccacataaagcacccgcacacgaaaatataattttcacgtcaaaaataacgatttttgcatacacctaggtgggtgcggttcgcctacccgcatgcgaaaatccttttggaccgcacgggaaaaccgttttcgtagtagtgtaattagaattctatatttttctctaaaatataagcaaactgattcatctaactatcaactatgcaatcacatgtccagatctctaggaatttttagagttaagaatactcagtttaaaagaatcttggatgtgaatttgtttcaaacaaaccagtccaaaagaatcttggatgtgaagttgtttcaaacagaccagtctgcaggcagtgagctgaattgctaaaaggcttatttctcgggaaaagtcataaaaataaaatgactaataaaatttagtttcaaaaataaaaaaattgaaaccaatttaactagttccccgtttgagttaacatttgtttggtccaaaaccgctaaattagatctacgacgaccccagtttctggaatgtttcatttattatggtcagatagggattaattattagctaatgccgagtacgattaagataagggcagatttcactatctaaaaaaagaggaaaagacgagagagcaggtcgtcgaagcttgtgtgctctattctagtttatacctggcattgcaaccaacattcattccaagctgggattcgatcattcatttcttgggccgtacgaagggcagtcgcctgcctacccctccttcgcatgtggtcttgtaaatcaggagatagatcgttagctaatccctgcttaaaataattctgcatgtacctagggaacgtgtcctccacaagctatttttttaaagagaatttagtccttcacgtttggttattaccttgttaattcatccgtccatcttatttaaagtgtagttatggttttccatgttcaacgtttgaccgcttatattatttaaaatttttctgtgattagcatttttctctattagataataaaataaaaatattattttatacgtaatttatttttaaattttttaataagacgaacagttaaatttagacatgaatacccacagtaggtcgaaatcttcatcgtattcaccaaaccaccacgtggacaagctgaggctaagcacatgcacgccaggacaacattgaatcaaggattcaatcaatgcaaagatatggagtacttgtcacattttgcagtctcttttggaaacgggccggatacagcaggggtgcttttttctcacttgaaccgtaatccggcaaaatataaaaagatttgctgggaaaaaataataataaagattagatttcataaaaatcattcgagttaagaaaaccatggaaaatttgacgtgtgccacagatccgacaggtggatatgtagcgtaactacgcaaaatctcactctgtacagattttagtttatgctaacatgcatgttggaccactttgcaatatgacgtggcctaattaggccctgtttagttccaaagtttttttttccaaacttctaactttctatcgcatcaaaccttttatacacacacaatttttctatcacatcgtaccaatttcaaccaaacttctaaactttagtgtgaactaaacacacagccttagcttgtcatccaagctgcgtaggccagcaagcggtctctcagcatagctaagatctgtatagggtggggtttggtgaaactgcgatcgtaatatacatatggttgtgtgacttaaaatactcgtagctttctgtaactcggataataaaatccggggttttgcagaagggagtgtctagcaaacattcgaataatttttttttcatccatgtcactcagattttttcaacatctatccggacagcacgttgtcgagtgaacgactttactagttaatcgttgtacatccccatgggccgattgcttagtgaagaaaaaaaagaggggttttacagtgcttgggaggtatctggggtacctcctaagccaattaataccaaccgttgattctgaaaggataatttaggaataagaaatattgttaactagggtagattagtaattcctcaacccctgtacccatccgctggccagcggcatcctgtgccgatgctaagtgccggtgcatagggcgtacggcggttgatctgattgttgttgaatgttgcgtaatgttgctgctgctgctgctgctggactctggccattgttgatgattacagaacgctgaagcattgattcattgttgtgaagctgttaaatggaattgaaaagtttagagtaattgattccttgcgaaattgatgcgcttaatttctaagttgctagcatatgatcaaagaagatatttcgtggctaattattgagcatttaattaagcagatcagccacgttgagaaactaattaagcaccatgccggtgcatgctaatctcatccgattaatcgggtgattaatcagttgcagcctctactaaactcaaccagagatcgaaggatcaggaaacggacgtgaacggttaggtaaaagctgtttgtatgtatttgcccttaattgtacaactaaaccatgaaagtcaattactattttaacattccaccttctatacctggtccaccttttacgtaccttttccatagtactcctaccttttatcctgatgcattggattagcggcgatcaacggtgctaatcaattccaagcacggaagaacctctcgaaaaaaaaaatccaacacatcccttcatttatattgtccagaaaacccaagatgattaaataaatattactaatacacctagttaaagagtcagatgcagttagattgtagtcatattaactacagtatatataattacagtatagttacactgtaatttcataatagttacactataatgatataaagttacactgtaatttctgcaattaaatgatagtgtaagtttatcttttggagctgtaactactaatcaatatttattgtatatttattctttttagggaactactctccagcgttgcatgcttgctcggttctgtttttcattttcccacctgtacagcacgaatcttgacacaaattctacggccaagcgattgcgagagctcctaccacactttgtaacttgtatagtgtatagctttgtatcttttcccttttctgtgtacagcatgaatcttaacacaaattctatggccaagcgattgcgagagctcctaccgcactttgtaactttgtatagtgtacagctgtatatcttttcccttttctacccctagggttgtattttttttctgctatattcaatgaaattttctgctatattcaatgaaaaggcataatctcgtgctgttttcccttcaattttttttctaattgctatattctagtatacatggcaagaattatctacttagtaccgttgcattcgcgactgtctacttttgtagtagtgtgtgtgatccaaaactgcttttttttacatgcagtttataaggaagatcacatgtgaaaatagatcgattttagtagacatacatcttagaccaacaatctcaaaattgttgtttttggatgcaaactgcgtggggcatgcacctcttaaaatacagggctggcccacctgaccacgagcaataaattaatataagtatagtacttacactcctctcctttatcctgtcctaccccctcccccctcccccgagctctctcttgctgttccctacttgaggcacagattcaatactcaccaaaataaccacacatcgactacagacggctcgttttagagctctgcatgtgaaaaatgattttctcaaaggaccttctaatttttaaagagccatctataaaaattgattttcgttggctggtgtatattatcaaccaaatgataccacactaaaagattcattaaaattgccaacatattttatgttttaggagtgtttagattttaggtgggtgtcacttttctaatctcttgaattctcttggatacactatagaacaacgattttgtggatgcttctccttttattttacaagtgaaatataagaaattatgataatgttgagagggccttatatagtttaaaacaacctatgaaaattaattttcactagcgatcaataaaaccgcctgtgaaaataggatgggttttacggacgcttctattaagaaaacacataatagaaccgtccttggaaatacgagcaatacttttgtgtttaaaaaatcgtaactctttcatatggagttgaatgatgataaatttataacaacaaaactgtagttttaataactaaaaaaatacacattgcatatatggcactataattttagaatcagcgatgtgcaattttaggtgactggaacttagaaaatatgtctaaaaatgaaatgtagaaaatatccttttcttttaagggtgacgctccggtactctttacttgcagtattctactacaagtagaattaatctcaaccgtttattttaaagggcaggtaagtaatctcctaatatagtttaggagtaattttagcatgggatgttttgttcggttcgcatcgcatcaggttcagtggacggccacggcaggcaccaccggcgattgctgcagcacggcatcgtcgtctctcgccggcaagggccacagcgcggagtacaccgccgacggggcgcggtttgaggtgccattggtgtaccttggcacgatggtcctcggcgagctcctcgtcatgtctcaagaggagtttggctttgccggcgacgatggcaggatcatgttgacgtgcgatgcgtcggtgatggagcaagtcatgtgcttgattagcagagatgcctctgaagaggttgagaggatgttcttgagctgcatggcaagttcttgccacagtgtcagaggaatcagccatcagttttacagtgtcggagaacggcgggctattcgggatcggctgccacggccggccgaggtaggtctccatgctgctgccggcgggggcgccgcggaggaggtcgtcgtcggcgtagatgttgcagtcctggaacgagaagccggtggtgcgggattgggtggtgatggtgttctgctggccgcggagggaaggcgcgtgacaatgtcgcagtgttggaagacggcggtgatgcgcgtcgccgaagatgagttagatactgataaattacaataataccttacgcgaattattatccctggacgaatatacccttccacatttctactaccactaattttggtgggagtagaaataaatcataaccctacaattaaatatgatcaacggctcagattactttctactccaagtagaaagcaccggagcgggactcttcttttaattatcgcagaagtatatttcactgcaaagaacccgtcaattgaaagatcgcattgctctagaggaacatggcaacgtgccaaagtagttgattaggcaaccgcctggattaagatgctaaaaccatttgcgcgacggcgcaacaagaagcaaaacagcatcaccaagcccaagaatcccagccagtaatgttatcgttggagtctttgccagctaaatacagtgtttctagcacttacagcctttcacgacttattgatcatacatatatgttaatccattatgtaaaagaaatatatgttaatcccaacttggtactaataatcccaattggaccatacctaggaggaaacagcaatgcagctgcctgtagagacaatagttttccattgtcccataacaaataaataataaatatagttaattaaaggaacagagtgaagtcagaaaatcagaatatgaggcgaatgttggctggcgatagccgttaccgggtttggttattagcaatttggcagccgtcaaacactgatgtgtcacacacatggttttcttatagattagtaccgtgtggtttactcagtaaaatttggtcctatacaacttttttttggctgtgtgcccacggggcagaggcagtagatgtaatcaattttcattattaaaaaaaaaacaattttcgtttgcagcggtcgacatttttcttcagtaatcaaaaccggggagcatggttcagtttttgtttgtttcagcatgagcagactgaagctaagttgatcactttacgaatccaatagagatggcagatggtcagcaagcacagcagctgaactgattggtcaggaggtagttaccaacgactgaaatcatggaagcttctgcagaggagagataagaactgagcaaagtcaaatgctaggacacacataattgcgtcgtcgaccatgttccatcttccatgacagctagattaatttctgagcccctgattagttgctccttctccatgatcgttagttgttcgaatccaccatggatcatcccatgcatcaacataatctcaatctataaatagccatctctgtatacgatcagcagacagcagaagcagaagcaggcagtccatcgatcatctcttctcttccagcaaggaagcagcagagaagacaatggcagcatcggccatgaagctcgccatggcggtggcgtgcgcgctggcgctcgcgtcggcgtgccacggcctgcagctgggctactacaagcagtcgtgcccccgcgtggaggccatcgtgagggacgaggtgaagaagttcgtctacaaggacgccggcatcggcgccggactcatccgcctcgtcttccacgactgcttcgtcgaggtatgtcgcattgcatttctgaatcacaaatttgcaatccatggcggcagtgagatgagatcaatgtgagcgtgacagatcatcatatgcatgtatgtgtttgttgatagggatgtgatggctcggtgctcctggacccaactccggcgaacccgaagccggagaagctcagcccgcccaacatgcccagcctccgcggcttcgaggtgatcgacgccgccaaggacgccgtcgagaaggtctgccccggcgtggtctcgtgcgccgacatcgtcgccttcgccgcccgcgacgccgcctacttcctcagcagattcagggtcaagatcaacgtcccaggtggacgcctcgatggccgccgctccctcgactccgacgccctcaacaacctgccgccgcccaacttcaacgtgaaccagctcatcggcgcgttcgccgccaagggcctcgacgccgaggacatggtggtgctctccggcgcccacaccgtcggccgctcccactgctcctccttcgtctcggaccgcgtcgccgcgccctccgacatcaacggcggcttcgccaacttcctcaagcagaggtgcccggccaacccgacctccagcaacgacccgacggtgaaccaggacgccgtcacgcccaacgcgttcgacaaccagtactacaagaacgtggtggcgcacaaggtgctcttcgcgtcggacgcggcgctgctgacgtcgccggcgacggcgaagatggtgtcggacaacgccaacatcccggggtggtgggaggacaagttcgccaaggcgttcgtcaagatggcatccgtcggtgtcaagaccggctaccccggcgagatcaggaggcactgcagggtcgtcaactaatcatctatatattgaattcaacgtgtgttccatcaaattttctcattgctacgttttgtttttgtatttattcgttcattcttttgtgtagtgtattttgtgttgattattatatatgtcctctcctattatgtaattgtgtaatatgacactttatcatgtaataacattggaatatatttttggagtaaatttcacaaaactacaggtttaaggcatccgtaacctaaaacctcctcatgtgtttgcaagctgtttcaagaaacctcaggtattaaggcaaaaatgtttcataacaaccctaaattcatacataaatctttcgtttggctattatacttatacataacacacatttgtcactttctcaacaaaacatcgggttacaaattatattaagtttggcttcatgtaattcgtttgtgtgatgcactgatgctgccactaaggtttgtatttttcatctttttccatcatgaatggtagaagcgggaaggaaatagagtagatatatcaatgtgtattttcagcctctaatgtagagttttgtgaaaaaaaaattctcaaaatccaggattccttaaaataaattgtaaaacctggatcttgtgaaaatttctctaatatgaaagatatgctagacgttcttttatcaaagtttaggagttattcgttgatatgctagacgttcttttatcaaagtttaggagttattcgttaattcagatgaaatcccgtgtactcggtcggcttaagacatactccactttacaggaaattgtcggaagaactttagtgcaaactactcctacttaacaaaagaaggtacaggagagtgttgacaagaatcacaacttacagaactgacatgcagcaaatttttcatgttaaaagaaattcatttctgtaaagagccaactcctagcagctgtatgtagtgatattgagaattattcctgttccttgtgattctagaactgacatgcatttaaacataagcaaaagaatttcatttcacaagtggaaagagccaactaaggtagcagctgtattcagtgatccagattagtattatccatgttctaagtgcaacatccaccaccaaataaagcagcaatgagtatttggacaagcggaccacatcaccacaagaacagctctaaccagcctttttttatacacaatttggagcacaggcaatgtcatgaatgattttacaatcttattcactccacttcatcttcacagcaaaaggcgacgacggcctacagtcggacagcaaacagagcactagagaggttttgtcacttggcaacttcctaataaaattggaagaagaaaccttaggaagtagaccctgccccccatcaggttactgtgcatagttctgggaagcaagaacttcgaggagggttgcgacgaagttcatctgaacttcctcactaatcgtcgtgaagagggggaaatggacgaacaaagacttgataccgcgctgttctgcgaacctaagagattggtaatagacatagttgcatacgaatcgaccagcgtcatccgaaggcgccacatcgaagcccatctgttgtagggacttgttcacttcattcacaggcacagtggtctgcttgatcatacaaaaataaggacaagttgtggttaaggacttaagatggtaaagactacccaaaaaaatagtacgaaacaaaaggagtttagacaagaaacaattgtgaccatcacagcatagcgtggactgatgaggtgctgttaatacatgtcacatacttacagaagccacccacaattagcaattctttccacatactttgtgtgcaatagactttgccactgaactcttcagttcaagttaaaaagattttaaccgaccaccaaatttgtttgaaaataaacacctaaaacaatttggcatggcaacgatgaactatgaaccaaacctaacctacgatgacacagtaattgaaaatcctcgaatgcaaatgttgtggcatggcaaggcgtaacctaacaacagaggcactggcgcactgctctatcccactataaaagttcatctaggatccatgtgcatgtaaaaatgttgatcattaatacatgcttaaagtatataaattgactaattgaaatgggatttttcttgcagaatattttcatgctatataattttatttttttagtaatatatcatgacacaaaatcagtcaaatgttaagttaataaaagccaaaacagacttatattatgggttgagggagtatttgaaggtagattgaagttatatttcaggacgggtacattaactcaatgatgaaatactttcaggaaacaacagcaaaattctacctttcttaaatttgagatgcttccatcagatgacacaataggggccctctgcaaagttgaaaaagggaaaaggaacagataagaatggaagggctttttatgtatgcacatgaaaccataaaggtaaaaaggacaattaaggtaacctgtggtttccatcccagctcatcagggcaacggaaggtagcttcattaatagcttgattctcaagggcaaaccttgttgtgccactgttgactccaaaatggagctgaaaaaaaatccataaaagtaattggtttcaatcaaaaaataaaaggtaaagagaaacaattctttccaacacacaaatgttagacaaatagaaccttgacggacctttaaaactagaatataaaagcgtttcatattttcttatcaaacagtaaatttggctgcaaaataagtttcactatagcatccaattacatttaagggcaaatgaaacttgtcaagtcattactgtggacttctcaggataacatcatgaactttctaataatgtacaattgagtaaatctgtaaagatgagaactgaccagaatcacttgcccctgatcattcaacccatactctttgtctacgatggctgattcaaacacttcatacaacggaccaagcccaccctgcccagcagtctcaagaacagtgcaacttccaagtgttaaacctttaggcaaccctctcttttccataaatgactcaagattgcgcacaatcttctccgtcggattctcagcgactccatggaacttcttgaatccagtaacgtgaacggtaacaccagaaggtccttcagaacccatctatccggttatgaaacaaagttgaccaaggaaaatatgcagtcacacaatctgcatagagatagaggaagcatcagattatcagtaaaaaagcaagcagttccctgaaaattcagcaatgcataaggagtcaaggacaataaatatagccttaaaaccagctatgggagaatgttgccattaaacaaaaatgtactgctgattgctgacagtgccgacctcccaagaatgagatatcgacacatacaacatgcaagtagtactacttttgagcagttagtaacgctgacgatttagcaaatgtcattgtctaaaaataaacaggtgctttcgagtagttgtttaattgtgtgatcagcagaacgccgcgaagcagcagagccacgtttttagaccgtctgaaaccgattgaagcagagacgtcgccctcagcatttagcaggaaaagcaaaacttgggcaagcaaacgatcaatcgcatctacaggataatcaaactcttgattaaatcagtgtaaaaaaaaacactagcacgcaagcagtaggttcgaacaggaacaccgatataataaaattctgaaaggaaaggcatgtctgtcttgttacagacagctcccaagtacagaaaatatatttgagggaaaatggtttgccagtaaaggaaaacaaccgaaatattcgttcttcggcgttctagaatctaacgacctaacaagatttctgtcgagaaataagctgagaagtgattaagagaatcataagctatgaaatgacttgcagacatgacacgagcatacaacgaatgcagcacaatcaaaagttagttgggatgagctctatcctccacagtagacacaacaacactagccaaattcgtagcaggagcagcatcaagaagaaagccttcatcgcgcaagattaggcgctcgattattgtaggcttgtagcagcagccacggaatcgccacagtaagaacaatatccccccaacaaaaaaaaaaaaaaatcggcacctttgtgcctcaaaaagtcaaaatcccctcatagcccctccaaatcgttccaagaatcaaccaaaccgagcaagaacccctcgtcccccggagcttggccccctgagctctctcaccttggcgcggcaaccacggcgacggcggaagcaaagcaagctcctttgcgcgctccagcagaagaagaaagtggatggaacggaagagaagagaagaccggagaaatcgaaagcgaggtgaggtgaggttagcaactgtccatcctcctccttcttaaaggcgcaatctgaaatgggatcgatcgccgcggcgaggcggcttacctcatcggccgagagagacgattagagcggggaggggaggtgggccccgcttgacagcgaccccggggcgtgggcccacctgtaggcgcctcgtggctcgcgaggagataagccggaggaggggaagggggaaggggaaacggctgcgctgcgttgcgttgcgtcgccaaaccgaagtctgagtcttttttatctttaacgtttgaggggttgcgttgcgcggcgcctccggctttgggcttttggtttggtttggttggttggttttgttgcaggttttttgggtgaagtctctctggaaccggatgctctgcggtttcggtctctctgttttggtgatgcaccgccgccgcgtctttctctccttcgaagtgttgtgctgatagagggcaagttttgttccatttctcatgttataatggtgaaagatttgtccctcattatgtgtagtagatggtgatattatactgatccaattaataaacgtcgacacatatagtggtatttcttgtgagatagatgtatcaatttgcaatggatctaaccaattaaactaattatttttttaaaaaaacttcattgtagagctaaattaattgattgcaatgtagaaaagttgccatacatagaagcaagtaaaaataaaataaaatggttatgggtccgttatactcgagaggaatcctttgttgtacgacatgcagtaggtatcactgacatgtgggcccggagcaggtgagacccacatatcagtgacacctactgcaggtgcactaaagtagaggatttgcatccgttgtatcccttttatcgtggcttgtattagttgctaactattagggactatatatgaagcaattatttctatcggtatctaggtatgcgtttcatccttatttttatggagtaacattatattagggactatatatgaagagacagtttctaccggtatctaggtatgcgtttcatccttatttttatggagtaacattatattatggactatatatgaaaagacagtttctaccggtatctacgtatgcgttacgtccttatttttatggattaatgttatattagcgactatatatataaagcaattgtttctatcggtatccaagtatgcatttcatccttatttttatggagtaacatcctattagggactatatatgaagagacagtttctaccggtatctagttatgcgttacgtccttatttttatggagtaatgttatattagggactatatatgaagaggttgtttctaccggtatttaggtatgcgtttggtccttaattttatggagtaacgttatattaggaacttatatgaagagaccgtttctaccgatatccagcatgcgtttcgtccttaattttatgaagtaacaatagcgttttttagagtttagacatattagggaactctcatgttcatctcttttaaaaatttccctaagtaatgagaataatcaaggatgttgtcccatttcttggttcttttaaattagaggattaaggtaggaaaattggaggattctaattatatatatggaaacattcgtatgaaagctttctttaaaaaaaataaaggattaaatattatcgtttcctttaaaatttctatggaatggataattctacgatggttttggcggaagacaataaaaaggtcatagctgatgtttttaatcatttgtctcttacaatcctatgtttttactgcttacaatcctatgtttttactgcattgcaatcaaacatctcttttcaagttttgtttaatgtgggtagcaagcaagcaaggaacccaacctgattgtgatgcagggtttacaacaccagtggaaactagtctggatttcacggattttttggaccgagtaaaaaaaaaacacaaaccaatcgtttttttgtcaagttaaaaaatcaaactgaattttaatttttttacaaggattgcaaatttcattaattttttgtcggtttatcaatggattctgtgaaatccaaagatactgcttgtgagtagttttagatttggtgtcggcataatgaacttggtcttgggtcggcctactatgaattaggccaaaatttgaattgcatgataaagaaaaatgaatggtttaatagacttttggttctagacctcgggccatattctagataggccgaggcttgcgactgcccctaatgacatgtatcattgttttctgtccttaacataaggtacatttttctccgtccttgactacataaggtacatgtagtactagttaggatcagcatcttgtagcgtctagtgagcctgtgttgtccatgtctattttgacaattgacaattcatttaacaatgaaatcacgttcgggttctatgtgtagggattgtagccataaaagaagaaaaagaaagaactaaatcaacataacatgtcatgttattgtacaacaatttgctctcgtattttaaaatttaattaagtgttcctttcaaacgcaggattccgaaaacacaggggcggatgaatcacaagaataaagatatcatgccacaacgaatcgtacaagaaatataaatccttaggattttgcaaaaagaaaaaaaatagtagcaccttaggaaaagcaaggaaattttgagtcaagagaaaacatgaagtataccctcatgttaatttgcctccaaaattcctataaaataagcaattgcatagtgatttcgaaggattttggaagagtcattcctatgttctaaaagaccatgcaggaaaaatttctgatggatttgaatacttcaaaatcccttcactcttcctttgtttcaaaatagccctaaatgggaatccggacaaatagcttatatatttctcaaggctcccagactaatggttaaaagtttgtgctgattgcttctgagcattgtccggtcaacccaggcgagttcatcgccctggtcgcgttgcaagtgaattgacatgagctccttccatagacacacatatcctagttaactagtatgtggtgattggttaactgttacatccatatttaacacaaaaataatgtcctgtagagacccctaccattatttgagcattgctaccgtccagcaggttgtaccgggcggtactgggtaccaaaacaaatctaaccgttgaatcaggatgggtaggatcgggacagaaaagatgagcgtcaggagagaaatctaaccggcgttcaagtcatcgttcccggtggtggcagcgtcgaagtcgtcgttcccggcgacggtggcagcgtcaagtcgttgtcgttcccggcggcggcggcggcggcgtcgagggtccaggaggcggcgacggtcgatcccggcaatggcggagttgacgtccaggcggcggcggcgttgatggcgtcgatccaggcgtcagcgacccagatcgaactcgcggcgccggaggaggaagacgcggcgacggcgggagtgaggaagcacagcgtcgacagggcgaaagcacgtcggcggcgggggtgaggaagcacgtcggcgggggtgagaggcacggaagaagacggcggcggcgggggcaggaagcacggcgggtaggggcgggacggcacggcccgattcaatctagggttcccatagcgaagttacatttttgcctacgggcgggccaacggttagtagaattgggtaccgttcggtaccagtaccgctggacggtaaaaaggctcccattatttagagtttgttggattgtccacccttttcctctcactttgtttgtatgggcctcatcctatcctaacccaatccacatggataatccaggattaatcaatatccaaatacatggatggaccaggattagggcccattcaaacaagcctgagcggtttgccattctccagcagaataacttcacctgcaacaatcttcagacaagcccgtttcccattcctcctacacgatatatgtacagcaagcatctccatctttgaccagcaaagactgtagatttgtagtcagccatcacaagcagaagcagtatttcactgaacatagctacagctacacgagtacacatgcatatggagatgcaagcagatcgatcaggccacgaatttcaggcagcgggtatcgttgtgaatgacctggcagcggcacgagcagaacctcgtcccgcacctgacgcacgtgtagttcgccgtgctgccgcagaccgagcagtaatggcgccgggacgaggtgctcgggggaccaacggcggccctggagtacgttgggacatggggaggcagcgactccaggtttgcctggcgaacacagttcaggagtaagagatctcttgatcttggtcatcctactgacgcgaggtgcacggtggatgagaaatttgcgaaataggatcatgaatcttggttgagaatatgagctataatgagctgttccgcgtacctcctgtaacacgtccatgaaagatctcgccgccttcttctccaatgccttcccttgcctcgtcttgcgcttcatattctttgactgcttcctctgcatgagaactgtagaaaggcagatgacaagagaaaagaagattttcacattaacactagatcaatacatcatcatttttttctggggaaacttaaactctctagacaacggtgcattctaattgcacacacaaccacagtccaaacagcctaacacttctgcaaccttccaatttgtcgatattatcctaaataggaaaatgagtgcattgtttgacgaaatggtgaaaccttgactgctataggctacatgagaccacaaaaagtaaatccttgaccaaaaccaaaaaaatggtgggaatattatagcagcacatgcgaaagactaagatgttttagcgctatggctaaaaagttgtgctgtaatagcttgcctttgctaaatctcaagtgcttttccattgttttgcatttctgtgagacagaatcctgtttgaaatgaatcactttccattcaaacagtgtagagttgattggctatccaatatttgcatataagaaatctatggacttctatatatttatatcattgagttgtagcttattatagaacttattttattctgtaatctatcaagttaaatgatcttttgtcatacttggtcaaaatggtgcttattttttggtatgtgattctttaccaaattaaattatcactctaatgttgttatacttatatccaatttttaagctttaagagtaactgcagctgtagtcatttgaagttttatgtaacaccgaactttcttattaaaaacttttaaaacaataaaatatctatgtatggtagcttttctgacaattaagacagttgctaatctgcaataattttttaggacttcactacaaaggcaagaaaaaatgactacagatgctcacaccacattacctcacctagaatttgtcttaagtaatagatatgaacaaattgctttcaaaagactgctatatgaaatatcagctagacctcattcattaatttgtttgcaataaacaaaagagataatgatggctgtttctgcaatattagtacttgaaggagcaataccaccttaggcatttgccattttatgttaaagtattctgcaagataaactgattcagctgaaagttgttaacagtatatatctagacattgtattgtctaatcattctcacattgtgatgacaaataatgtcttcaagatcaatatgacattcataggttccctgaaataaccaaaataaaatgtgttacatgaaaataaggacatgagaaaggaactgaccatggtcttcctcatctgcagatccatattcatcatcatcgttaagatctacgacctcagggccagcattatcactctcaagcgcttcaagacgagctagtgcagcctacatgccatcacataaatgtagacagaaattagagaaactaaataactgggaatcagtaaatttcaaatatccatggataaccaagaaggcaaaattcttttgtactgaaaactctgaatcctaaacagaagacgagtaaaaatgaaattaagagtacatggaaagaattaaagctctatatcctgtagagttccttctttgacaaagggtcataagcaaaacattagtgctggtataattaaggcagagcatattcgccacatatatgagcagtagaaattctacacaaaactcttcatgcaaacatctgcagaggtcatttactaaaactaccggtcaagatggcccaatcctttcaattgctctattttaacacaaacaaaacctgcaatgtgtggcccttaacattggagcaataatcaagcaaagtctggagcaggcgtttgttaccatgaaggttcagtacacaagcccaatttgcaactataattcagaacaataatcaagtgtatttggagggatttcacaaaaaaggaaaataatatggagaaattagcggtggccactggcctggatattattaacacgtctctacctctctaaaaaaaaaagtccattacaagctttcattgcaataagagaaccacaatgttcagagaacgccccaataaagggttgacacaaaaccacattaggtacatttcaaactgtaaaaactaatttctttccttttcttaatctccatctaatactggtactacaccttctgaacggccgtgagaagtgacaagacaagtcgactactcaagtgctaaatcaagagatagtattgaatacagcaagacataggatgaaatggatgtaataatatctttggattccaaagtcgactaaatcaagtgcaagtaaggaagagataaactagggcaagagctttaatccggagacaataacaattactactactaagcagctgttaatgccggaagccaagctcagccagcaaatcgagcttgtcgaatcgaaggaaggaggggaggaagcaagcaaggcatcgaccgaccggaaacgaacctgcgcgcggttgtcggagctggcgagcgcggaggccatgcgcgtggccatccgccgcgtccgcgcgctggtgcggcggaacggccccacgttctcctcctcctccccctccatcccggcaacggcgagcggagagcggcggcggcacgggtaacggcggcggcggcggcggatggcgagagaggtggagatcctcgagcggagagggcggagaggccgtggggagcttcgcgtgcggacttgggctggtctgctgcttcggcccattaactaccagcccaagactcctccctaggccgcctgctcatgtgaaggaattgggctggtctgctggttcggctcggcccatcaaccagtccaagtttcgatctccataaatctcgcatcgcaactacggctacctgcgctgcgcacaacacaagatcgtgacttcgtgagtcgtgaccgtcgtctccacacctatggacaacgcggcggcgccgccgtcatctggagcggcggggaaggagatggccacggcgggggcgctaccggacgacctgctcgacgagatcctcctccgcatgccggcgcgttccatcctccggtgccgcgccgtctgcaaggcttggcgctcgcgcacctcccatccctacttcctccgagcccacgccgcccgttcccggataatcgccgccgccgtggttgacacaactgcaattcccgacggcgaattccgcaccaccatcagcatcagacctctcggcgacggcgacggcgaccgctcgggggcggccgtgtcgtcgtcgtcgtcgttcgcctcggtgcggttcggatcacggccttttgtcctcggctcctgggatggcgtcgtgtgcctggtgcccgccggtgtcgttcgccctctcagccgcatcgaccgatacgtgctcgtcaatccgctcaccaaggcctgcaccagcgtgccaccgccggcaacccgcggcatcgtcatctgcggttacgcccacccgaccacgtcgcgctaccacctcctccacgccgacgacgcctatccctacaaccatatggcggcggcgaccatccggattctgcgagtcggggagaagaacaacgtgtggcgcaagatcgcccgccaccctgcgcctgcgtgcgtggagtcgaggacctacattcgattcggcggcgctccacccgtcagcctccacggctgcctgcattggctggtcgccccgttgtcggcggcgtcggcacggcctctcctatcggtgttcgacatggaacgggaggagttccggcagatggacgcccccgaacaatgggctcgccatgggaacctgccgcacatgatgggtgtacagatcgctcggctctccggcaagctgtgcgcgttcgtcaacgagccgagcgccagcgcgttggggatgtggacgctcgaggactactccgacccgagcagctggcggatggagcggagtatcgactactcgcgccacggcgccggcagccggaacatcgcgcgcacgttccgcaaccggttctcggcggccaccaccgcggtggaggtgctacccgatggcgtcagcggcaacggcgatgtcggtggcggtggcgaggaggagatcatgttcctgttcaaccagttcgacacgagggaggctgtgtacaacgttgggcgcgcggcgtggcggtggcgaaggattttgccaccgccgacgaggcgcgtgatggcgcacaaggagtgcatgttgccgcgtgaggtgagcttcggtggggcggcgcattttgtggaggagagtgacatcggcggccaccgttgcatttgcatatgatagtagcattgctcgttgggtttgggcttccttgttttaagccgggtcctaagatgtgcttgattctaattgtttaggtttggtagaaatgagatttaaagagttgaaagtattaccgctctatttccttctttgacaaagggcaaaaaaaataagtaccgtgagatggattctaatatctcgagtagacgtccatccgtttattgcatatcaactagatggttacgaaaaattttcaaaaaaattaacaagatagatcaatatgtaatatatcactacacaaacatgcaagttaaaattaacttcaaaagttaacactttgcaactataattcgaaacaataatcaagtgtatttggagggattcattccacatcaaagaacaatagtttggacggaatcgatggtggccaatgaaccagatatatcaacaggtttcagcctctttcattaaaacagaagcacagtgttcagcaaatgtgccaataaaaagtagactgacaagtagacaaccatacgggtacacttcaaactctacgatgaactacttttttttcttcttaatctctagctaatattagtatagtacttgtatagtacttttttaaaaggctttgataataagttatagaagacaataagaggaaaattgaatatacaagagatagattaacatggaatccgatcccctgataagaataaaatgccaagagaaatttagtttctttgcactccatagtcgaccactaaattgctattaagtgttaaacaaaacatgagcaagtaaggagcaaaaacgaggttcagagtgttaatcagggttcaggagataattaagtactaattagtagtttagtgctactactaagaagcggcagttgccgccagatgcgaagctcgatcagcgagcgaatcgaatcgaaggaaggaaggaacctgcgcgcggttgtcggagctggcgaggggcggaggccatgcgtgtgcggcttcaacttcaggaactgaagatattgagtcttggtttttcctcatgaatcatgagggaaaaaaccagttgtgattgtgtttgcttatggtattactgtgttaaaaaacaccatgagcattccaattttggatcctatatgaggtctcgagatgttgagatgcatggtcatcaatcaatttcgcagttctgaaaagtttgacgatattcggcttggcggcggcgatgccactgtccagcacagtggccggaggcaacatggacgggcaagggctagcaggattgatcatggtcatgcattggcctcgtgaggacatggaactggaagagacgggggcattggagaggaagaagagactatttgcattgagattcgtactggatcagcctcgcagccgacgcgggatgtgattctattaatctattccattatcttaaaaaaatattttcgtgtcgtgtccctagcttcaactttggcggtgccctggcaaccaaagggagcatatatagtccctgtttagttcgcgaaaagaaaatttttaattgttacatcgaacgtttgactggatgtcgggagtggttttcggacacgaatgaaaaaaactaattttataacttgcctgtaaaccacgagacgaatttattaagcctaattaatttgtcattagtatatgtgggttactgtagcacttactgctaattatggactaaatagactcaaaagattcgtctcgtgatttccatgcaaattgtacaattaggttttcaatttacctatatttaatgttctatgcatgtgtctaaatactcgatgtgatgtttttgagaaaattttttttggaactaaacaatagtagtagcatgtgggctaagtacatatatacggagagaattaatgccaaagtcatatgcaaattaatttcagtacactataaattaattaatacttcaaaaattatttcacccggacacaactaagctgaggaagaacaagaaaattccactcctcattaacaatattgggtgcttggcaatggcatgcatgagcttttgaggttgttttcgaaggatcaatccacctttgagtctaaaatattgttttcgaaggataaaatcatgtacatgtattagttagtttgaagcaaatctcataaaaaaaagtcaaataatttcaaacagatctctctcaaatatttctttttcaacaaaacctaattgattagacacacaaggccatcttaggactagggttaaagtacagcacgcccgcccaactagtactggtatatgggataaggattttctacacccatggttcacctaggtgccatggcacccaacattcgcatgcgacttaaatagttataaaaaaaattagtaacatcgattgtgattatataagtctatacacaaacatgcagtactaaatttgatctacaacaagagaaacaaaaataataaaattagacagtaaatagtaccagtacagatatcttcatatgtcgatcgaatttagacttacatgtttacatagtatcttatatattatcatagtctatgttatcaggttttataaaatttttatataattgtttaaattacatgcatataactaagtataggaaaaactttcccctagtatatgcggtagaaacagtggccgccgatgtccttctcccaaggaacctgagacgcgtcaccgaagctcacctcgcgcggcaatatgcactgcctatgcatcatcaggcagcgtgtagtcagcggcaatatcccccgcctgcgccacgccgcgcgcccaacattgtacacgacctcctcgtcaccaagctggagcaggatctcctcgccctcgtcatcgtcatcgacaccattgggcagaacctccaccacatcggctgtcgagaagcgggcacgaaaagtttgagcagcggcggcgtgtggatcgtcgtcgagagcagcaccggcggcgctgccgcacgagtagtagtagtcgatcttccgctgaagccgccagcttgttgggtcggagtagtcctcgagcacccacaaccccaatgcattggcgcccggctcgtcggcaagggcgcacagcttgccgtggcaatgggtgatgtgtattcccatcatcgtgtgcgagtgcgacaggttgccgtcccgcactccttgccccccgggggcctccatcagccggaattcctcccgttccatgttgaactgttgaagacggccacgagaaactgcgccgatgatgacgaggccagccagtgaagacagccgtgcagtctgacaggcggagcacagaggaacttaatacagaccctcgtcgttgcgagggcagggcggcggacctcgcgccacacgctgttctccccgagccgcaggatccaaaaggtctccatcgttgtgaagaagttggtgtgcatgatgtggaagcgcgacgtggtcgggtgggcgtaaccgccgacgaggaagccgtcggtagccggagccggcacgatggtgcaggcctcggtgagcgggttgcagagcacgtaccgctcaacgcctcttccggggccaaacagaatgtgcgctgcgcacaggatgccgtcccacaagccgatgacggctgtcatggatcgcaccggctccgacgccgagacgaacgacacggcgagggaagccgccaccgcccccgagcatttgcggccaagccgtctgatgcggacggtggtgcacgaccttccgcagggagtcgtcgttctagtttccacggtggccgcggcggtgacgacggtggccgtgcaggaacgggcggcgtgggcgcggaggaaatcgggctgagaggtgcgggagagccaggccttacacacggcgtggcaccgcccgatcgacggcgccggcaggcggaggaggatctcctcgaccaggtcgtccggcagcgcctccccgggggcccttctcccgcgtcgccgttcccgatcgtcgtattccatgggcgccgggaggaaaaaacgctggttagcttaattaggttacaaatctcgtactcctatattgtagtacgaacttgtgtggggggacttggggcttgggctgtcatcagttgatgggccgaagcagcactgcagcagcaaggtatagtacgtcgattcgattagagttagactgataaacgacgggactgcctgcacatttgtcgacaaatttttccccaaaaatttgacagatgtaataacagtacaattgtagtgtaattacactgtaacttatatgtaattacactataacttacatgtaactacagtgtaacttatatgtaagtttcacataattttaaatcgttagatctattacaatatttgttttggtgaagaagaaaacaaatcatagcacacacatatatgaaagaatttgttcccacaatctccattttaccgaaataacatgttaccgagagatttttgaaagttacatacaagttacactatagttacagtgtaattatatgcaacttacagtataattacactacgattgtactgtaattatatctgtcaaatttttggggaaaaatttgtcgacaaatatatagcgaaatcgataaacgacaacaccgagctatttaaactgcaaaacaccaaacctatcagcaaacgagctaattaaaaccggacctcccgctattgctgcactatcctccactgtaactgtttgagaagagttctagctacttgctccgatataactttaacccctgctatagctgtttgagaagctaaccgttaaatgtattagcccgctatttaaaatattgctaaacacatatcgagatcaaagcccttcaggaagcgaattcccgggcttcagacttcagcaggactttctccgaccaatcttcaatcagcttttgatcctttggtgcagacaggtctccgatccgcatgcggaaatctagttttggctgtttgaaaaaaatatttctgtacaagtggtatatttgattatgtatcttatgtcaatatatctcttggtatattcggtttttctgttattgtcttcccacttctcaccagccgttcagaatatgcaaatattagctagtgattaagggcaaaagaaatactccctccgtccctaaatatttgacactgttgacttttttaaatatgtttggtcgttcgtcttacttaaacatttttgtgaaatatgtaaaactatatgtatacatgcataaaaatgtatttaacaaagaatcaaatgatatgaaaagaattaataattacttaattttttgaataagatgaaagatcaaacatatttaaaaaagtcaatggcgacaaatatctaagaatggagggagtacaatacctgtgtagttttgtctactcatactcctctttactcaggtgttctcttaacagtactgcgcctctcttctggtctgtcagcatggaaaagcaaaggcagaaagcgcagcatgtgagcgcgtgtatactactccctccgtattttaatgta

SEQ ID NO: 73306 - DNA, 4958 bp, Oryza sativa
atgcatatataatatatgcatatatatatatatatatatatatatatatatatatatatatattatatttatatatgtttcaatacatatgtacatgcataatatatatgtatttatacatatatatgttttgcaaatgcatatgtatgtatgtgtgtgtgtgtctatatatatatatatatatatatatatatatatatatatatagccactcatatagggcaccatggtgcccggcaccatggtatcaaatgcacaaaatcactcaaatttttcaaaattttcaaattgtgagtatatacctagttataataattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtggttaatgttaatacctaagtgctttgaactgcttttgctttgcgcactacaaataaatgacaaacgacgagagatctaattaatatacacttgtatgtatttgaatcggagaaatataaatgtagagcatgtgtactcacagaaaatttgaacttccgcctaagtctttctctccagttgccgcggaccaaatgacggaaccgataccaagccctacatggagtttaaagctatgattcgtagtagcaattaacataacaagattttcttaattaacagaggaacttatgacagtacctgtctataagttcgaaaaccttgtcaaacgtagactcttttttatccattgagtcatatacattgacggtgcaggccgacaggtcgaagagtaaaagcacccagtggaatctacaatgtgcgtgggatgcattacatatgaaacacttagcaagttcatacgggaatgaaatttggtataggaagacagtaaaattaaactaactctgtgttgtacggcaacagtatgaacgtcttgtaatgctgcgcctttaggagatggacgagattgtcctctgtggcttgcggatattggtcgagcattgcgacgtttactttccgagggtcgatgaatccagtatcgaaaaccccccgccgtcgggccctttgaatctccattctacaatgataaaagggagtatattattttctatagtctacttatatacaaggacctaattaattaaaggagacgtagtaagaaatctaactgaacgatatacttacaaaatccagcaactcataatagagacgtcgagggcatccagctggtatagttcgtagattcccttgaaattgatccagagaatgtcatcctttaattaattaggtctttgttcttggcggcgtcaactttcgccttcttcgttgcccttgtgtgggcaagcggtggagcttggggggcccttgactttgaaggtgccggaagaggagcttgcggaggagtcggtgcaggagcctaaggtggagacggtgctggagcatgaggaggagtcggtgcaagagcctaaggtggagacggtgcaggagcctgaggaggagtcggtgtaggagcctgaggtggagacggtgctgaagcctgaggaggagatggcagagcccgaagagatggtgcatgagacgccgcttgtcgcccagggaggatgatgtaccgcctgcgccatagaataatggcatggcttgtgtctcgtagatgcgtctcaccgtctcctccagggtaatccagcgcgaggtcctcgtacgcgccttcgaccaactcaacttcgaccttggagtatcctgctggaatcggcctgcagtggtaagtacctgaaaggtccattgggatggccatgcccgacgccaccttcatgtggtgagaggttatttattagtaatcaacatatataagcagcaactagcggaatggccaaatctaaaatatataaactacgagcttacctttattgataagttcttgaaaggaatatgcagctcacatggtgtccactgaatgatgtcatcaacggggcaagtggattcgtcctgggtttgtatggcgtccatactctgtgatcctacctgccccattgaggcgcagctgctacggtttcctgacgggctcaccattgcaggaggaatggtcggctggggatcatgggaccgatgtgcggccatgcgttcatcaaccttccttgccacctcctcttgcatgctgcgctcgtagctcgataccctgaactctagatctgcaatcttcaccttggtatctctcttgctcctcatccgactcctgtacgtgtggatgtcctccttgaacctaatcttccaaggaatcacccctttcgctcgtgttcgtcctggatgctctggagtctgcagggcgagtgacagctcgtccctctctctgtccggtcggaacgtgccctaagaagaggcttccactgcgtctgctagtcaacgcgcagcctcttgtatctgatcgccgaagaccagtgggccatcagctgggttgagcgttccaccgtgagcatagtaccagaacttcgatcgttccggctaattagcggtggccggttcgatacccctctcaagcaagcttgcctccatctcctcccacttcggcatcgcaacgctatagccgcctgaccccaagtggtgatggtacttcttcttggcggcattttctttgtttctttccattatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcctctctacccgcgggaagggtgaatgtctcgagcattgtggtccacagcatctctttcttcgaatctgggacaaagctctcatgatctctgcgtgcccttgttctttgccagtacaccgtactgacaggcacgttatcccgcacaacccaaccactgtgacatacatagttcttggcggcttctgccggggcactaggtcgtccatcttcttccacttccgttatgatgtgccgaccctcaagcttcttcgtggtacctcgttacccgcgtgccctcttctgtccaacggagggttgacttccactagccttctcctcctggttcccctccacatccctttccacgtgcccctcctggttcccctctgcatccctctccacgttcccttcctcgttcaaatactggtttggatcctcgttcccctcttcttcgttccagtactggctacttccctccgcgattgtatcgtacaatatttgttcctcatcgcgattagccatctgttcatacaggaaacatctgctaagtcatgagacatttatgttttaacaatcttatattaaaactcaaataatcttatatgctaagactaaaatagtcatgtatgctaagtgtaactgtcgtatattagaaccctacacaatcttacatgctaagtctaattacaaatctaataatcttatactaaaactcaaatagtgatatatgctaagtctagatgacgtatattataggaccctagctagtcaataattatatactaagtctaattacaaatataataatcttatatcaaaactcaaataattttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacatatattataggaccctagctagtcaataattatatactaagtctaattacaaatataataatcttgtattaaaacttaaataatcttatactaaaactcaaatagtcatgtatgctaagtgtaactgtcgtatattagaacactacacaatcttatatgctaagtctaattacaaatctaataatcttaattgcattacaaatataacaatcatatatataattacgtcacttgcctgcgcgaattccttcgagggctagctctaccactccggcttgagagatgactctgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattcatctgcctataattgcatttcacgttcacgttcgttcgctcgttcacgttatcgttcacgttcgttcgctcgttctcattcacgttcgttggctcgttcacgttagttcgctcgttctcgttcacgttcattcaccttgttctcgttcatgttcgttcgctcgttcacgttctcggtgtggcggcagtgggacggcggtgtgccggcaacggaacggcggcgcggcggcggcgtggcgccgcgcgcggcatcgggccgacgcatggcgcggcggcgtggcgccgcgcgcagcatcggcgtggtacgacggcggcgtgctgcgcgcggcgcggtgccgtcggggcggtacgcccggtggcggcgttgcacgccggcggcgttgcgcgccggcggtgtgcggcgcgaggatcggagagagagatcgagggaggcggcgtgtcacgccccgaactagccccgagcgggactagaccgtgacgctccaaattaacctgttaatcgataccagtcccaggaaacagtgctggtatcacaggaagacagaatatcacagcaacagaggtctctttattatagagtaggagtacagtcatattgggctgcggacagatcccgagctcacaactgcattacaaaagggaag

SEQ ID NO: 73307 - DNA, 634 bp, Oryza sativa
ttgatcctcttattcggtttattagtgagacatggaagaacaaactgaatgttgtgttccctataaggcctgaactctgaagtcaggtgaattggctttgggtggtggtggggctggattcaaattcctgatattgttagttggagtgataacatacatatttgggtttggttgggttgatttctggtaaacttgggtattcaaggtcccacaaaaaaaggttgaacatactccaatgcctgtttttggtttaattaacgattggtatggactcaggcaagaaataagtgccataatatggttattcttgtgctaaaatatattggtggagattttaacttttagattgattgaatgttgacattttttctgttcttttgcaggatactctctgtttcttgggttaattattgaccggctacatcactatatcagggagttacggaccatgaagaaaaacatggaggctgtaacaaagcagagcaggaccttagaagaagcaaaacatgggagtgtagaggagattcaacaatatcagaaagagatttccaggttgaatgagcaagtgcaagaattcaagcgtctgtcagaaacgaaaactgaggaactaaaaacagctgaagcgaataccttg

SEQ ID NO: 73308 - DNA, 40466 bp, Oryza sativa
  unsure (1)..(40466): unsure at all n locations
tttcaaacggccacccaggcctggctgatcccatcatctgtcaagtgttgcttaatgttgtatctgacggcggcggcgactggccggtcggccaccatggcgcgtgcgcgcgggaagcaacggcgcgcggcgacgatttggcggcgtcggcgggaacggcagcgagagtggagagggagggctcggcgcggctcacgggcagagcggggagaaagagagagagagggagagagagatggggagggagggaaatatgggcctaaagggaattcggcccatcgaacccgagggaggcaaaatagacttttgcagagggaattgatttgggaaggatttggattcgggattgaacttgacgatagatcggggattcgagatctgagatggcacagacactagacaacaagcaaagaaacagatttcgcaattagggtttttaagagatagttttcccgctaggcgccatgacggaacgggcgctgcacggcggcggctctcaccccagagatgcggcggcggcggaggaggcggaggcggcggcgacgacgacgagcgcgagacgacggcgagatacggcggcggcgtcggcgcggggatgccctaggcagtggcggcgaaggagaagccgagagagattgatcgggcaaaaacttctaagtgttagtggagaagacgagggcgcgcatcgggaatatatatacccctagatctttagtcccggttgatgagaacaaccggnactatagatttagtcccggttgtttagtcccggttgttctcatcaaccgagactaaagatcttttcccgctattttcaaattctttttaaacccggttagggttaagaaccgggactactgataagcgcactgaatattattttccattacatatgtgtttctaaaatagaagataatgcattacaattatttaaagtacaaagattaatgacaattacttcgaaaaattactgttgtctgtaataaattaagtggataaatcgtaataagcaaatatatgatttagaattaataaaaattgtaataatcatatatacttagcatatgaatgatattattaaattcgtaaaaactctaattaacatatgtatatacatacggcatgatttacaattaataaaaattgtaatcatcatatatacttagcataggaattatattaaattaattgttaaaaactctaattaacatatgtaaataccacatgcatgatttaaaaattttaaaaattcgaatagtcatatataattagcatatgaatgatagtaaattaaattgtgaaaaactctaattaacatatgtaaatgccacatgcaggatttgaaacttttaaaaattctctagtcaattataattagcatatgtaaatgccacatgcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataattacggcaatacatcggcggtgacggttgaccgcacgtactttctcctcactattgttcccttcttgtgatcgctacgtgagtaaggggtgtcttcatttgataggaggatgctagggtcaatcgtcaccgtgaaagggggttgcccatccaactgatcgtaatcctcgtcagtcttgtcctcaactccgacgatttttcttttgcttgggagaaccacatgacacttaggctcgttaggccatctgcccttctttcctttgctagacatgtccttcacgaaaaagacttgcgttacatcattggcaaggacaaaaggttcgtccgagtatccaaccttgttaaggtcaaccgttgtcatcccactgtcatcaatcattacgcctccaccagtcaacctaacccattggtaccggaacagagggaccttgagaggaccatagtcaagttcccatatgtcctcgatggcaccgtaatacgtgccagttgttccatcgtgtcccatggcatcgacacgaacagcgctgttttggttcgtgctcttcatgtcttgggctctcgtgtagaatgtatacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccatgtaatccatgcatcggacttaccgatgttcctggcgcgaactagagccaagtgctcctcgacataaggagctaccaatgaagattgttgcagaaccgtgaaatgggctttacggaataaatcgttgtctaccgtcattattgctttccttccgagagttccctttccccgtagtcttccttcatggcgtgattcaggtaccccgattgagcgaagatcttcgataaattctacgcaaaattcgatgacctcctctgttccataacccttggcgatgcttgcctctggacgagcacggttacgaacatacttcttcagaatgcccatgtacctctcgaaaggacatgttgtgtaggtacacaggcccgagaatactgatctctttcacaaggtgacaaagcagatgcgtcattatattgaaaaatgaaggtggaaatatcaactcaaaactgacgagacattgcaccacattattctgaagggcttctaatctattcggatcgatgaccttctgcgaaattgcgttcatgaatgcacatatctttgntatcggtgcccggacattgtctggaaggataccccttattacaactggtagcagttgtgtcatcaacacgtgacagtcatgagactttaggtttgtgaacttcttttccttcgtgcttattattcgcttgatattcgtggggtatccagacggtacctttatgctctccaagcattcaaacatactttccttctctgccatactaagagtgtagctggctggactcaagtaatggcttcctttctcctttggttccggctgaaggtcgccgcgttcttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaattgggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggttagccttatgttcgaagtgcttgcctttcttccgtaccggatggtttgctacaaggaatcgacgatgacccatgtaaacaaccttcctacagtgcttaagatacgtactttctgtttcatccatacagtgagtgcaagccttgtaccccttgttggactgtccggataggttgctaagtgcaggccaatcgttgctggttacgaacagcagcgctcgtaggttaaactcctcctgtttgtcgttgtcccacacggggacaccttccttcttccacaacagtttaagatcttcgaccagtggtcttaggtacacatggatgtcgttaccaggttgcttgggcccttgaataataatcggcatcattatgtacttcctcttcatgcatagccaaggggggaagggtatagatacacatcgtaacggggccaagtgctatggccgctgctcatctctccaaaaggattcatgccatccgtactcaaatcaaacggtatgtttcgtgcgttctttccaaattctttaaattttctgtcgatgtttcgccactgcgaaccatcggcggggtgtctcagcatcccgtcctgttgacgctcttcagcgtgccatcgcatcattctagcattccccttattcctgaacaaacaccttagccgtggtattatagggaaataccacatcaccttagcaggaattctcttctttgttagctgcccgtcaacttctcctggatcgtctcgtctaatcttgtatcgtagtgctttgcaaacagggcatgcttctaggttctcatactcctcaccgcgatataggatacaatcattcggacatgcgtgaatcttctgaacttccagtcctagcgggcagactatcttcttagcctcgtacgttgtctggggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtataacgaagttctgtggtcctctaacatcttgtccaatttatgggcccccttttcactttcgcagtcctccttggcatcctgcaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaataccttgctctccgtgggatgtccaacaattatagcttggcataaaccccgactcaaacaagtggaaatgaatagtcctggatgcagaatactccttctgattcttacacttattgcatggacaacaaataaaacccctttgcctattagcttcggccactctcaaaaaatagtgcacgccgtcaataaactctttggaccgccggtcagcgtacatccattgccgatccatctacatgagtcgaaaaaaatcgtacacaaataattattcttacaataatgacagtcatacaataattataagataattacaaactgtttcaacagtcatacaataatgacacatctttattcatacaaaaatcataaaatattacaccaaataattcttatttactatttctaaagttttaaactaattttaatgtgttttacttcttttaattttcattttagtttgtttctagtattcaagattaactttcactatagttttccttctcaactattttataaaaccttctttatcaaatcaactaaatttgtatatattctttctaacccacacaaattttctctctcatcaacttacaactaaattttagagacaaaaaagtgtgcaaaacatactgcaaatgtaatatgacaaaaaaaacattggaggatgaagttgcaaactttttaggcacctccgatttgtatgtaattaccaaaataaattcactagaaattttggcatgacctaccctcttttttgaagaaattttgaagcttgctcgggcagctggaggaggaagaagacatatatatataggggtgggactttaattccggttggtgttaccaaccggggctaaagatccccgagatctaccaaccgggactaaagttacgatcactaaagatcccgggggcctgacaggccctgacagcatttgaaccgggactaaagatggtgaccaaccgggactaaagatcaaatatgcccattacccttttgaaccgggactaaaaatcatctttagcctcggtttttattgcatccgggactattgtggaatttggccgaccgacgaaagatggtttctccaccagtggatcaaagactccaagtagcctagtataatatttagcctgtcaatcaggacaatgacatgtcagcaatgaattcaggatcaaaatgtaggggttttcttgagaggtgaattatgctaacggacaacttaacaatgacagtgacagaccagtgcagctacttttcatggaaacaatggcatctattgcttaattaatgacaatgaaaatattgcttgattctgttcagacctactggattgccatgaggccatccacactgcaagagttgcactcccaagctcttgaacatgtcacatgtaccgtgtagaacagcgtaaaccattcaaggcacaacttttacaatgcataacccctctgttctttttcggtgttgtattagaatacatgcaaacctcaaaaatctttaccagctaaaatatcgaaaaaaataataagatttgatatgtggaaatgagtttgttaaatttggcattttagttatatttctactaattcttatagatatatgattagacaaagagaatggtaacaacatgtgcatttgatactctctcagttgtactagacaagtaaaaaagacacaagggagtacaaatcagtcagcacatatttcattttggcacttgatatttagtgccatctcaccactcatattatagttttattattgatttagggtccgtgcggctgccctcctttggaatcactacgaagcagggtttaatctttcggtttggtcatttgtatcggggtggccgaaataccgaatttttggtctgaaattatatgaattattgaataaaatttgatcaaaatattactaaattcacgaaaaaatgaaaaaaaataaaaatttcggccgaaataatatcacatcgggaggtccgatagaacaaatccaaaattttgaaccctgctgtggagcaaggttccagcttaaaaaaggaaagaagaagaagaagaagacaaacagcggaatttcaccgaatttgaatgaaaattcaaaattcagtttgaataattctaccaaaaatagatcgatgatcataaagataagtaaaatccaggagaatcctgtcctccgggctgatcgagcctatgtgaggggatagggtttggcttctcgagttttggtcttcgtggaccgtctacaaattcaacctcaacaaacgacaaaaatttggggaccgacaaatctcgccagcttaactgattaatgctaattatacgtgaaaaagactttttaaaaaaaaagggggggggggggagggagatacaatagtcgtcagatactacggctgaataactcgtacatagatgaatccatatgcgaggggaaaacatacgtatatatggtttctctcaactacttgaaatcttgaattaacctgaacgccttatccgaacaaaataataaaattgttaatctcattcaacttcagcgactaagggcacccacaatggttatctataggctctctataagagatccatgtcagcatattttcctacttgaaagagattaaataaaaagagagagcaaagctatctactaacctggagatagtctatagagaaaaacgaggcaatgtattagagagctatagatacccatatagacatactactgagatggttaatattaatctagtctattgctgagatgtacatattttatagatagcaccttactttaccattgcgggtgctctaattgttataattgaattcagagagaggcacagacagtgatagatcctatcattaattaattcattatgatagatgttcttcatgaatgcatgcattcgaacgtacgtacctctggttagtagtggatttgaaaacagccaatacaataccaacaagagcagccagtatgtttacgtttcgaagaacttggatgatgaacttgacctccattgggagccgtcttacttgctcgtccaagacgtaggttgcagcttcccagtatttcttacatgaactagccaagtcccctattatctttagacccggttgatattatcaactgggactaaaaattaacgcgtcgtatataatccctcacacttatcctctcctcctcgatcgcaaactcctcctcatctttaacttcctcctcctccctttcctcctgtctctctctctctcttatcctctccttttcttgaagcagcagcgaggagcgagcgaaagcggcacgcgcgcgggggcgggggcggggttggggggcacgtgctgggctggggaggcggcgggcggtggtggagcgatggcggatgggcggatttacaatttgtttttgtatatttttgttgaatttgtttttgggaatttttgatgtgaatatgtgatgtatgtgtgatgtttcttttagaatttgtgatgcatttgatctatgattcggaggtgatttggggttttcgtgatttggggatggagtgaaatcaatatgcaagcagttaaaattaatgaaaaaaaggaaaaaaaaaatatctactcccgattagtggtaacactaagcgggactaaagatccatctttagttcccgttatttcactcgggactaaagaaatgcatctttagtctcggattagtagtcccggttacaaaacaggactactaggggttgtgaaccgtggtttaaaaccacttctccaccagtgatgggtttgtcagaaatgaaatttaatcaatacaaataatggaattgactaaaaataataataaaagtaattaactcagagcattatgtatgtatatgagataatttagttaaatcaaaaagtaatttatatatacgataaaagtatatgtcgacgagtgatactcgtggaccggatgagttgagcattggaggacatggtagtcgaggtcggagaggtggacgatactcatggtgggcagggccgtcgacgggggagtgcgaaaacgacgaccgcacagggcccccaacttttgggggccccacaccaccatctagggtgggccacatgcctggcgatcagctaatgagagctagggtagaagcaaagccaaggcatcgcaagcgtcaaacgattggagatcgcatgcgtcagttagatcgaggtgtcgcaggtcaatgaaggagcagtccatcctataattcccaggtattgtgcgtgcgtgcatcgagacggcgagggcgcgaggcgccgcgcagctggcagagcgtcgatcgagcgggcggcggtggtggtgcaaatcgtggcaaccatcagcgaggaggacagccggaggcgagcgtggaggccgagcctaaagcaacttctagcgggcgcttgccggcttcactaatcacttcatcaggtaatttactaatttgacgaactactgttacagtattgtgagtgaacaaacaattgaatggattcctgattgaatcaaacacatgtctttgcttttgttgataaaaaaataatagatttgtttcgtcaatcacctcatcatgccttctagaaagataaagtatgattcgggtgctgaaaatatgtcttcaacattattaattatgaacaattaaagattttatttaaacaacactatacagatgatgattttcggtagaacagcagtgatacctactcttttagcattaatatttgatatatttttaaacattgcacgaaataatacatactaaaactgaaattatgccctctatattaaattagatatatgaatttttttaaaatttagagctttgatttgtatttcgctccgaggccttaaatttctgtagacggccctcacggtgaggtgcaagatggacaaggggttggcgacgttgcccaccagccagaccgccaagtcgcgcagctccggcgtgacccggccgctccggcgcgccaccgcgtagccgagcagcagctcggcgtagagcggaacgagcgccataacagcctcccctaccaccatattttttgcaatgaaaaatggttccccccaactaggtaatgctagtagtattttttccaaggaaaatcctgttcgtttccactgcaagaagtggatgaaattttggatatttgtggcacgctttttaaactgctaaactgtatgtttcataaaaaactttctatatgaaagttgctctaaaatatcagattaatctattttctaagtttgtaataattaaaactcaattaatcacacgttattatcaccttattttacgtaaaatacataatttttatcttcaggagattcaaacaccatctagacattgaaaatgacacggtgcttggtagcagtcgtcgtatgtttgacacgcaaatccccttccgtagctgcatcgatctgcttggtggtagtagtatgtttttgcatcggtctgcttggtatagtagtagacagtagtacctggtctgcttgatttttaatagctctttatataatttttaatagatcattttggaatgggatatgcatatcctattctggatcaaatacactttcgtcctcgcttcgtgtaaaagggttaacccggaagtgatatgtttgaaaggaagagcacttataagttgattttacccttactaaactaataaggtggtactaaacatatgcacacaccttcatgagctatactgaccttatcctaagggcaagtgttatggtagatgtgactaccacatctaaatttatccacatcatttactcataaattaagaggcaatctatacactatgtcacctctagtacacaaataccaatgtctcttatactctcacacccctcttaaaatttgtgtggaggttgcctcttcatttaggggtggtttaccatttctctcctcacttatctcctctacctcatcactcaatccaatatggcacatttaggggcagcatatgaaacattataatacttgccctaattggccaggctatcacactggaccgcaccagaaacttcatcaaaaaggtagagaggaacaagcgctagaagagctacccctactgccatattatttgatctctctctaggcgtggaaccctgccctttttttccccatttaaacgatgattttttgtgcgtccaaaggttggggaacgctgattttttgcacgatttttgcatggtaccgtatcaatgtagaagcgttgatttttttttctcacgggattttccatcggaagtgcgcgcgattttcgttcgctatgaattgaacgaaagttaaaatatatagtgcccacacttaacaaatttgagaatttgcatgcctgaatgcccaatgtgattaggtttcagatgattacttctaatcaaatgttaatcggaacataatcttgacacaccattgcaatattgcatcgctccttaaaacagatttcttttcatgaatgcacaaaaatactatgcgtcagtatattagaagaaaatagagttttagtttcacaacgcaataaatcagatagacccttgccgcatgcaaggtaaaggaccgcgaagggaggaaaaacaagctgaaaatgctgctcctataaagagggagagaggtggtggagtaactgctgccctatgttcccaacaggtccccaaatgaagcggcactagcaagagaccaaagacgattcttctaaaggatggactccagaaccaccgagaccggcgaaagggacgaatcaaaaacactggctttccgctccttccacagctgccaggataccaggaggaccagagtgtcaaagcccttgcgaagacactttggtagacaggccctagaagacggccaccagacctaaagagagcagccatgggaaggggcgagccaacgccaaccagaagacaggacgaggcgccagacttgacgtatgaacacacagtgtaggaggatatggttcgtcgtttcaagctcctgggcgcaaaaaggatgaaccgagtgactatcgatcacgcccttttgcaggagatcggcaagcagcaagataaaacagaaaacataattagatgaacgatagccgatcggccgatagagccgatgacgtatcgtcaggacccagccgatgcagttaaaccaaatcggttgtggcttttagatgaatagataaagtgcaaaccctaaatatgccctaacggttgtaataccatctctttggtttttgtcaatcattttaagacagtattataaaaaatagtcaatagaccagtacttagagcaaaaacaaataatgtattgactaatactctaatacagacttatataaagaaatcaatctatataaacgtaccaaataacaatcgatcaccagatataaagtttaagagagatcaatctaacttgatgcatttatataaatcaatctatctatataagtggcaaatattcataaacagatcatgaaacatgcattgtcatgtatattaggtaagatcggctgaaactccgatactatccttaattatgattaactccggattagtttctatgattctaagcacggctagggatgatgcatcacaaaatacgcagagaaacataaagtcaaaacaatcaaggagttaacaacttttcgggatggtagaaccttagctaatctaatctagtaagacgatttaagccaataccgacaaaaaccctaaaacgagaatcaactgatatgactaaattgagatactaagactatattaactaagatatgtgataaaaatgaccacaataaaatgattgatacattaaaatgatataatagccccgatagcgcaagccttcaagacaagttaccacttgtcgagagatcgcagccgataccccgacttgaagcaagaactcgttggaaagtaaaagaaaagagttatctcaattgaggcccaaaccaagataaatatcctaattaatagatacaattgccttagatgagatctatctctaaacggcaatgatagttatctcaattgaggcccaaaccgagcccaagttaggctgtatcggcttcccaccagatcggctcaaccagattccgactctgtttcaagtcgatgcgtagtctgttttggcaaaaatcaatctcctttgattccgtttcgatatccaactccaaatccgagtctatcttgccaaatttcactgttaacacatgctcccccaattccgatgtgttatataacacagtggaattatctctttcagtccgcaacttgctagtgttatcctttcgactattaagcacatgtttacaaataacaaccaccaccctaaaaaatttcacaccgttacttccattttcaccgctcaagccacgcaatcttcttcaagaagctccgacgatttctccagtgttccattgatctactacgaattactttgtaccgttcaattgttttctccttttttttaatgacaggtcattgtggaggttcaaaaggaataggatacaagaaactttggtaagtttgcggtttcatgtgcaaggcaagaaattgtgcaagtttgtggctttaatgtggtatgaatgtgttgtgcaaatatgtggcatttgaactgcatatgtgaatgatgtaaattttaagatgcatatgtgctaaaatggggaatatgtgatatttggggtgcctggcatatatttgtgatgtttctgtttttcagagggcgtggctagtaaatcctgaggctagctaatattctgaatttgttttttttttcgaatttcacctcatcactgatgggtcataacaaaatccatcacaggtgacctcatctgtgacagctttgatactataccccgtcaaagatgatatacctatgacaggccgaatataatgcacccgtcacagcctcaaagataagtcacctgtggggttgcaaccacggactgcggtgtggtcatcatcacctgtgacgggctcggaaatacatgcccatcagaggtgactgatacctctaacgggcatgaaatacatgcccatcagaggtgattgatacctctaacgggcaccatcaaaggtgactgagactcaacagtgaccattagtctctgactaggcccaaaccggcccttcaaaggtgatggttaggacccatcacaggtgacctaatccggtgtagtgaggcttaccctcgtttctgtactatgttctatccggccggaaagctaatcccatgactaatttggctccaaattagttacgccgtgcattcatgcagctcgtgttgtatcagtcgttgagccattccggcggctctctttatttacttgcggtgctgatcgctgaagcaacacagaccggcccatcagcgaaccacgcgatgttttgtagccagagtttttagataaaaggtatggcaaagtataacattgcaatgcttttttttttcatttttctgttctggtccttcccttctctgttactataaaagaagccaaatgtgatggagcgccagatgcaacaagagaaacaagaagcagtcaactgaagatcccatttttatcatcaatccacttttggaagctgagaattccgttaaaaattaaaatcctctagtggtatttaacaaaggataacctagcaaaacggagatggaatggcgacgatgttgggtgctcttttgtaatcaagatgaaacgatacaacatcttttcattgattgccatatatgtggttagatgtgtttcaaatgtgtcattttcattacctttctggttcaaaccgcctcataaggttgctaacttgtttggagtttagttcaaaggtttggattaatctaggctaaaatactaaatctctttatttggattgcagctatatgttgggcgatgtggatctctagaaatggcattgtctcaatggcataaaaatcaacttcgttaattaaatgtcattttcaggaaaatatattgaatgagacagtagtctgttttattaaaagagggagaaagcatcttgatgaaagaaggttgcaaactgttggagactaccgttgtgcacttctttgctaagggttggaacatgaggaaaataattgaggggtatagtttgctggcttttcttgtttgcagccgtgtatgtcctttggtcgatgcacttcgttgttgttttgtttcgggttagagccttagtgttccctttcagttgtgatcttgggtaaagttcaaacttgtactgaaggacctcctgtgtttgtgtacagccttgttggtgtagaggccggatttgagaagaaaataaagttagtacatatagataaaaaaaaacaatttgagaagaaaataaacgtgaacgtgggctgtgaggcccatctccctgaatttggcttcgaccagaaaagagagaggaggcctacaaaacccgacataaaagtgtaaaaagtatacataaggtccctcatcttgtttccaaattacaaaattatccagaaccgaaaaaatatgtgtcatccctcaacttacaaaactgaggcactttgtggcaaaaccagatatgtgtcatccctctccgcctaaaaaggagacgaccaccttaggacttgttcggttacatgatgattcaatcctggctaggagtgacaagaatagtaagaaatttattatagatacaacgagagatcgggatttattccggaccgcatgatatggacaataatagaccgagaatcaatccactagttaagagttgtggaactaatccggatgttttattataccagtaaattggttaccgatccggaataaatcctccggcatgaggaggaggcggcggcgccgcacgcagcacgccaacagcaagacgaacaacagcacggcgtagggcggagcaatatcctccgccacacgccgacgccgggcggccatttcccagctcaccctcgccgccatgttttgcaggcttagcttttgtttcttctacctcaaaaccgggacacgttcttcttcaaggagcttccaagttccaacaatgggacctgacgcttcacgacacacgaccaccgagaactctcggaactgaaaaagagcacaaccaagatgaacttaactcttaacgacctcaagaagaccagcaccgaacctggcaatgaagttgaagggcagcaccgagacaccaagatgaccggaaaagagcagagaaccaccaagacgaacttgaacttccactaagacacacttgacggcctgaagaagagaaacacgtaccacaaagatgaacttgacgacctgaagaaaaccagcaccgaactatctctatctgagcaagttggagagcagcacgagacaccgacacgaatttgacgacatgaagagagcgcagggaaccacctgacgatgaagaagagaagcaccgcgcgccaaggcgaacttgacgacctgaagaaggccagcaccaaaacggactctttcaagcaccaccgacgggagctgaggaagaacggaatggaggacggcggcgaatggaacagagcggacgatgaaaagaaaagcctcaaaatgtaaataaaaaaaattgatgcatcccagcggcagcacgccacctatgcagcaccgctctcgatggacgacgcgtgtattacgtacggatccgacggggtgctccgctcgggtgtggcaaattggcgcggcaacgcgtgcgccagctggccccctccccccaagtgatttttttccttttctttcttttcacgatttttttttcttttctttcctttcacgatttttttaatcttcaacacatggttttcaaatgttttgtgttgaaaatttttaaatcttgacttgaaaattttcaaatctcgagttaaaagttttcaattctcggattgaaagttttcaaatatcaagttgaaacttttcaaatatgagttgaaaattttcaaaatttatctttcatatttaaatttcaagttaataaattttaaagtttaagctgaaagttttcaaatcatgagttgaatattttaaatcttagttgaaagttttcaaatcttgatcaaaagttttaaattttcagttaagagtttcaaatttctaattgaaagttttcaattttgtgttagaagtttttaaattttgagtcaaaaattttcaaaataaaatgaggttgaaacttacctagctatcttgcgaaaaaaagagaaaaaatcgcgtgagaaaaaggaaaaatcacatgagaaaaaaaattgcacgcaaaaacgaaggacggagagggagataagcacgtgtgaaaaaaaatcacgcgaaagaaaggaaaaaaagaaatgtgctactgcagtgtagagctgtaggctagagtggggcctagtggatccaaatcacgtgcgagttagtttgctcgtgcgtctgtgtgagataggattcctcgctccgcttgacttgacgcagttgcgaatataatggccaaaaggtccagggcccgacatcccgtcccatggcacgaccttttggtccggccaggcacgacatggcctaattggtgtcaagcctatgccggcccggcctgacagttgggctgagcctgggggcgctaccttggcacagtgggctggcttcgcatggcacgacacacgagggaggcgaatagacttattcagatgtgtataaggcagtccaaagaggagggaggcaatctagacttattcaagccatatatagggcacaacccaaagaggaggaatgcaaaataaacctattctaaggacgagcacagtgtgttggtcgtgcctacgtgccggcccagcatggtccgattcttataggactgtgcctaggccgtaggttgtgcccgtgggcgggcacaacctgacccggtcattaagcgggttgtgcttgcccaacttatatcgggcctaggcctggtcgtgcacgggccgggtggctcatttggtcatctgtagttgcgaatcagcatcgctcctctcgatcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagtttcttataaaatgagggttaaaattatgtctagtttgttcagccccacgtgttacttcttctatcctccattgtcagtgcttacaactgctccttttgcatcatgggcatcttcccgtccccggtcgtgtgggcagcattacagcaacacgagtttgtcctggaactggtactcgcccaacatagtcgccggtgatgtacgagtactacactataccgcctgctgacgctggtcgtcgtggtgttattcttggtgctggcacacgcgctctctctctctctctctctctctctctctctctctctctctctctctctctctctctctctcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaataaccaactcaaatacggacaacgtacaaagtattggcggaaacattttcaatttttataataatagagaagagatgaacaattgattttgaagataattggttttgaagattttctgatgatgaattgacctgacgatgaacaatgagttttgttagtttgggtctggtcagaccgacgtgtgttgtgcagtcaaatcggccagcccgatggtctgatcggacggctctgtgtcggttctggtttcggattgtttttttatacttgtgattaatttatgtttatgaattctagatgaatattatgcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgcttacttcgagtataaatagagagggggttgagacttcccggcatcgattttgtgcaagttgagtttagaaaaaagttagtattttgagtttagtcgagatttgtgagaggagtgttgttgttgcactttgtaaacatgagtagaagtaagttcaatctacttttgaaatatcttcaatttgtatatgcttgggttcggcggtcacaccgacagcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgcttacttcgagtataaatagagagggggttgagacttcccggcatcgattttgtgcaagttgagtttagaaaaaagttagtattttgagtttagtcgagatttgtgagaggagtgttgttgttgcactttgtaaacatgagtagaagtaagttcaatctacttttgaaatatcttcaatttgtatatgcttgggttcggcggtcacaccgacagcattgcggcagtcagaccggtggctttaaggcggttagaatggcggcaacgacaagcgacatcagcgcgatgtgcgggtagaccgaagctacttcgccaatcagaccggaggtctccgtgcggtcaaaccggtgcatctactttggtcagaccgaccttcatcgtttcgagagtaacttttaattccgctaaaagttttgatttgtgagtacctcaaccattcactcccctttggtggcttagttcttgctggcgatcttacaaacctgtgatctcctgagtgtaaccaaggatccttgatcccggtgccctggagtgaaatttccctagcgaatacacaatcgcacgaaagtagaacgaagagcacacagatgaatttggcgcaagaacttgcattctacttttcaggttttctctccttttatgagtactaaaaagaagtggctttgaggccgacgattgcgcacccacgaacgaggaattccacagcgggtccgacggaagggcattccaccacggtgccatcaggggcagtcccaaatgggactccggtagaagggggaaccaccacgacgctggtggggcaggctacggtagagtgcggtggtggtggggaagtaagtcgctgtcgggaaccaccacgacgtcggcgggggcatgttgtgctggattgcatcggcggtggggaaggacctcgccgtcaggaaccaccacggcgcctgcggtgaagtgcgtcggtggtggggaaggaccttgccgtcaggaatgaccacgacgtcggcgagggcaggatgcggtgtagcgcagcggtggcggggacaagcgaggagtcggacggagcaaggacgtgcaacggcaagtagcgcggcggcagaatcatagcgtggggaaagtgcagtggtggagtcatagctccgtcgacggctggggatgacctcggcttcggcagcggcggaagggacgaccacggctccggcggtggcggaaagggtcagccacagctccagtggcagctggggaagacctcagctccggtgggggcagcggtggagtgtgggtatggcggcggctagagaagaactcactccgacggcagcaatacacgcgaggaggaggaggtgagaggaggagcgagtactgcaaaggtgcagtcttcgtgcgaacatcttcgtgcggtgttcgcacggaggcgtagtattcgtgcggtggagatggagagggttaaatcgcggtggacggtagggatcagatcagggcaatacagatgcagatggacggcagagattacacatgttggattggaagggtaaattcttcctttttatatcttagtatagaaaagggtaataattaactatttgtcacttaccagtaacaattaaggatttgccactaagctacgagtggcaaatccttaatagccacatcttaaaagtggcaaaaagttaaatgcctctaaaaaacaggtaaaatatgttctagagatgttgtttgttataaattgataaatgataaagaataaaatggaactaggatagtcactctcccataagaacagtagaggatttcaattgagagtatccaacaaggaaaaatggcgttatgctccgatggaaataaacaaaaacttaggaggaaaaatcaccccaatcacatgattgcacacttgaatggagatttgccagtacttctggcaaacataaacgaacaaattgttcaatcatggagaacgaaaaaccagaaagttacaagtgaaaactccatattcccacaaggacttgtttaaaaaaactagaaggggttacaaaaggcacagccgtatatatcttgttgcaaagaaatagtgaattgtgtacaacagtaagaagcctgaagatcgcatcaagaaccgacatggacctgcctgtaggatgttgcaaaaagatgagggtgcaaaaggagaggcgtatctgtaaggtatctggaaactgagggaaaaagtgcaaagctggaaggacctggatgtaagaaatcagagcccaggggcatatgtgcaacgaaaatgaagaacgcaaggacctggccataattcgatatctggaaactttgagggaaaaagtgcaaagcttgaaggacctggatgtaagaaatcagagcccaggggcatatgtgcaacgaaaataacgaacaaaataccgaacgcgcaaggacctggccagaattcgcaaaaaaatttggaccatttctcgatttgtgcgtgtcatccttgcgcaggggccatgctaatcttctctgtatcgttccaattttatcggatgtctccgaagagacaagctgactacagcgcgcgggtttataagctggttccatcgtctttcggtttccgatgtggtactaaacatcccccgcaacgccaccgcgcaaaccatcggatccccatccaacggactaaagtgggtagcagcgccacccgcgcggtacggcgcgcgtgggctgcaccttccgacgcagcccaaatcaggatacggcccattagtatatattctcctcctcccagcccacatcacatgcgtttcacactttcgcctgtaatcgctcaagtagtcaagtatgagctctgtctgcacgaactgattgtcactagtgtaccatcaaactactagacgtgacttgtgataatctcagacgcttatggagtgaaacatggtaaaaaaatgcgtttatgtgcttgatcactttgatcagccttgcctccatcgtctgaaacatgataagaagacctttgttacgaaagtgtgaaacgattctgttattccttcggctatgccgtaattcaactttcacaaaatgttttcccaaaaactcgctgacagtgtcgacaacatctactgcgaacaaaccacgaataatcaaatcatgtactcaacgagtcagtaaagaaaccgtttgaagcaagtggcaaattaacactagctgaagcacgataaggattcacagagctgttattcaaaagagtaagaatgacatcaacattcacataatccgtcactccctagaacattacactcgtggaacaaaagagaaactcaagacgaggcatttacacggacaaaatccaacggaggaaagaggtgaagctacccaccatccctcttgaggttattcacttggttcacttcccttggaacttcgacaaaaagttttgaaacgaggaaaaaccctccattgcctcttgcggaagagggagcgtgaagggaggaagaactctgtgtccagccttgagatccttcgtgccagtgatagatggacgagcaagtgcaggttcctgtttattgagcatctctatgatgtatgagaaagttccgaaggtcaggcagctctgaatcattgtttgtggtgcacctggaaccaaaagaagaaaaaggaccatcagttaatgaataggtacgaaactatgatctttttgttaacattttcctatataggaagaaccgataatccgatatcactgttaatagtaatgttatcatcatgcgaataaggagctattttgtcacaggacaaaagtgtgttctcaataatgataagaaacactcatgatctcacaagaaattgtcgattttgtagtgcttcattttaccagtgcaaaaatgaagacataaatggacaactctaaatgcaaaactgtgtgcacaccaatacagcaaaagacaagaaaaatgaaatatagaacaaaaataataacaactgtagtgaaaataaacaaatatttcaggtgcatccaaaccaaattagtttaggacgcattatcaacaagataggagataaagatacaaatgcctatatgaacaaactaagggaacatgaaaatgaaaaaattgtagagattgaatcatcaaacttgaaacggatgccagagattaataactcccaaaagggctgcatgcattcttaatgaacaatgtcaggaccgtttgagatcacctattccataactcagcataatgaaaattgctcttgttgatattaataccagtcctagccaggacatccaggaacaagttgtaaatttaaacagttcacactcacagctacattgtgtgtgtaacgttacctggaaaactcagggcaaggccagtgcaacagcctgcaattccagcattgagaactgcagatataaaaggattcacaagttaatgattgtacttgacatttgattgtagtacatcctaaggattgggacatggtttcctagagaaagaaatgagcacaatagatatcaagactgaccatcatctttcccacgtagttgtctcaaagtgcaggcaaccaaactttgaacaccagcaagaacagcaaatatctagagcaaaagacaaaataatggcatgagctgtgaacaatgaaacatctgctgcaaaatgaacatgtgtaatgtgaatcattaccttagcagaagatgcagcatcagcaaacgagcctttaaaccctttagtggtgaccaaaccttttcctgtcaagttatcagaaaaggcgagttggaaaaaaatattttgtgctttggcccaaaggacaacaggcaacaggatggctaacagagtacatgaaacaaggaggaacgttgaccttacaatgaaagtctatgatccacttccatataagttccattgaaagcattaacccaagaggtaaatggtaatgaatgtgattgtaggtcaaggcattaagagtttacttaaagtttatctaagccttctggctatccacaacattcttatatggagcatgcaaggaagccatgtcaatttatactagttaaaacagtattcaagtaatctttacctattataaaagttaaaggtgtttttgccagaattttggtacgtcatccgtgtttgaaacggttttaattttatatttcggttttaatctatatctctacaagaaattcccgtcttctgtataaaagaaagaaagaaaaagtccgactcaaaaaaggtaaataaagaaagaaaagaaagtccgacataacgagcgattaaaaaaaacttcttcgtcgtcagtaaaaaaacatctcttgtccgactcctgtagaaaaaggaaaaaaaaatctcccagtaaaaaaaagtccgtttggtttttttggcaccggtattttttttcccttttttctttgcacgcaaaagacttttttacgcgcacatgctaagtcttttggttttttgtcccttttttaatccgatctgttcaccgtgcgcctcttgggtgcttttagctttttttcgtcaatcttttttgtcgccagttttttctcccatgtgctttttgtttttctcatccggttttataatcccatctgttcgccgcacgccttctgtggtgaaccttagcgccgcgccgccgccatatcgatcgtgtgttttctcctccaatttgattgaaaaaatcgattccccactcctctctcatcattttatccatgattttccctacgattgggctttaattgccagatttaatctatgttctacacttgccgatgatgacggcaatcttccccagtcagttttatcccgagttttacgctctaattttggggaaaacggaaagagtagatcgagtggatcaaaaaccctcgaccaattttggttgaccaataaagattcggccggatttgatgggtagatttgctccggcaaacgtacgggcacgggattatcttcgggggcacaggattatcttcgagaggttgaagatggtagtcatattcgggaaatttaagatggtagggtcgaagagaagcagaccaaatggagggaggtagcggactagccgctgaaaaggaaggaaggctttcggccaaaaacccaagaaatattttcattaacttttttttaattataatctatagcaatcccaatgttaagatttttattaacattttcaattatagtgtatagtgatcccaatatttcaatttattacttagctcttaatgtatcactgaaaaaagtatttacccgttgcaacgtacgggcatcttttctagttaagataaaataatcaaattttccagcaaattaaggctggaaggacattttaaacattgtttttcttacacaagtcaatgtggcccaagattgtctaaacaagagagcacaaaagtggttttgtttggttagatgtattcagttatgttggctgagttgaacagatgatcgatttgacatgatgggtagcaagctggttttagtagagtgcatataacaggaccttctgatgcaccttaatccactttgatattcttaatccatggtaagaaacttaacaaggaaacatacatgctgggagcatcaccaactaaatatatgcatctaggaggaaagtagaaacagattggatagagtgtgtgcaaccgcaacttattttggacaattaaacagtcaaacaccagcatgcacatggcccaagcaattgaaccttttggttgcatcaagccatgataataagttagcactggcagttaagtaggaaataaatgtgtcatcaactcatcatttcatcgtgtagatcaccctttacttcatattcagttttagtcaacaaagctccagctttcccctaccccaaaaaagaatagcagtactgttgaaatgtcctccaactatgaaaaatggaaccttatcatttctccaaggatggttttaaaggtgcttccagtaaaacaacacagcatagagcatggaccaacctgacttgatttacaagaaaaaaaaatatgtcgacctttttcaaaatgagatgctgtggatgtcatgtgttgaaaaaggcttgtcatatggcaatataactcaagagaacaattttttggtgtaatctgcaaaggttttaacatataagggatgaagattaaacttgaagttcagggtggaaactgtactgtagcaggagttgaaggaacaaaactgatatgttcagttagatgagttttatggttgtggacataattaagtaatatgtacatcagcaaaatatgtacaataagagaatgcacaaggagaaccaccttcatttcaaacaaaacaacaacaaaaatatcttccggggtgttatttgtctggttttgtaagtatggggtaaaagcaaccggtgagaaatagacatcgagcaaaatcaagggccaaaaagatgggctctataaaaaagaacacatatgcatgcattccaccctgtacaccacttagtatcaatcaaatttaataaaaacacaatttcagcgctggtacattcctatatacagaccctaagctaaactaaacgtctcccactcgaaccaaatgttcctggaagcctctcaaaacccatataccgcgaaactaatccaactaaaggaatttctttcaaggatggtctgattggcacaattacatagtacatacagtatatctctactagactacgagcacaaccatgcaatattgcagataacaccactattataccaccagataccaaattgttccggccgcacgcccgcaaagcgcaatagtgcaatgcacagccaacttacagcaatcacaccgaattggagtattgaattgaaggaatctaatactactaaccactcccgtctcacaggtcgcaagaaccctaacctaaccggaacgggaacagggaagggtacaagggtgtcgttaccatatccgacgacggcgccgacgagggacccagcggcggactcccacgcgaaccgcaggaggcagaccccgggcgccgcggtggccgccgcgagcgggctcgggttccgcgacaccgcgaggcggctcaggatggggttcgcgcccggcaccgccctcctccccgcccccgcccccgccctctcgtccgacgactcagcgtcggtggtgtccccgccgtccgacgagaacccgtcctcctccccttcctccttcctcctcctcgcgtcgccgccgccgctcgccatcgccgcttctcctctctctctctctctctctctctctctctctctctctcgcgtgtacgcgcgcgcgtgtggccgtagcacacgcgcggcggcgtcacgggagggtgtacgtgtcacgtgtcggtgtgctgcagtggcagggagtggtaaatagcctcctcggttgatctaataagtcaaataataaccaaaatttaaactttttgaacttgattttaaagttatttaaatatatttttaacgtatattttttattattagcttttgagccactacaaacatatatataaaaaatttaccaatagattcttttaggccctgtttggttcagcataggattattataatctagattattaggagtatcgacgggtgatacccgtagaccggatatagagggtattggggtacgttggtacaaggatctacgtagtacgacatcaagcaaccaaaagacaagaattatactggttcaagccccttgataggtaatagccctaatccagttggtatgggattatatggtggaaaatacaggttacaaagggaacgatggaacttgtcagatctggcgagattgtagtcgagttggttcgacttactctcgatgacttggctcctcgtagacttcggcttcgtaggctgtgtgggttgtattggctctgagattcgatgtcctatgccctccccgggggtcccttttatatcgcagacctggaggtttccaagtagaactcggaggtatcagaccctatacgatacatcaacgacccagttctgtccgagtaggattcttcccatctgtagatttcgtgaaaggtttccttagaatatgcaggaaatatccgcgtgcgcgtgggtatgccatatcgatatgtaacgtatatcgaagggtaaagggtatgccgaacccgtaaccctgacaaggagtaactgaaacaaacaagtagattattatgctagattattataatctatagccagattagtataatccaataatctcctctatagccagattagtataattcgcaccgtcggtagtgtgtctatttaaaggaattttgggagcccattttgaagtccgccaaccctgttgaacacacaccgcctaccagcgctctttgccttctccaccgccgcaagaaaccctagttcactaactttggcccattttccggcgatctccaaacagcaatggatctcggcaaatcggcttccaccagcgcgacgttgaagaaccttcaggaggacggcgcccttcccggccgtggaagcatggagagagaagcaggaggtactaatcctcagcccatcttgggtcacatggttgcgatcgaagattacgttctctgcggttttctccctccgccttccgagtttcttctcctggtcttgaagttctatggtctttctcttcttcatttgaatcctaattccatcgcctttcttagtatctttgttcatctctgtgaggcctacattggggtagagccttattcttgatctcttccgcttctattatgagctgcgttggatggaacccaatagagtgtctggttgcgtcgggttccgacttcgtgatggcatgaagtcgcgttatgtccccttccagtgtcctttttcccgcagcaagtggcggaacaggtggttctatcttgagatcaaggactcgaaccctgtcttcgttgttcccgaggatcaaccggacaagattccagcctggactgccaagcctcccttgaccccctctcttcagtcgtttatcgacatcatcgatgatctccaagaacggggcttgtcgggatatgaagtcgttgcagacttcgtcggtaggcggatccagccgctccaggctcgggcccatccagcctataactattccgggccggaagacgcgacccaggtttctcctcggggtatctttctcgcattcatcttgacgtgcttgcgttcgcattccgcttgacttatcgaaggttggttctcgattaacaggtctgagcagcgaagtcgtggagcggcgcgtcggccaagtgatgatcagcggcccgaccacggcgagtgacatccccgtgcccctttgtgaaaagggggcgacggaacgcgatgaagccatcaacgtaagtgtattcgataagcatcttgcattcctcctttcgaaatcaccttatgacttgattaagcataggcccttcctttgactgacatcatcgggccgctcgcgaaccatcaggtggcgacatctctgaaggagaaggttgtcaaggaggcgtctgacgcggccaccactagcggtggcaatgtcccgaccaagccgaggaaattctcgtctatactcggacatcgtcgcaaggcagcgaccccctcggtaatttaatcttgtcattagatcatgcggcaaggagggtttttccttactctgtattgattgtctttcaggcctcggacgcgtctcctccacctccacgacgacaacgcattgtgatgatcggcgagaagtaagtagatagattcctgaatttccgtgcttctcattcgagcggtgtttgacccgtggttgttcgtagggaagcgcgggcgaaggctgcacgagctaagtctggaggagcttccagcacatcacctgccgcggcctcgacagatgtcgtgcccgcagccgggagccgggaagcgacgcctagcggccccgtcagcgatcctgcgggaggtcgtggtctgccagctgccgtcctcacctgggaggagctccaagtcgagatggggcgcctcctcgaagctggtgctcgcggcatcgaccgcgagattgcggaggcgaggtcggaggcggcgacggtgaacgcgcgtgctgatcgactggtgcgcaagttggctgaagcccatgaagacctcacgaaaatgagggagctggtggccggcaacgagcgacaacggaaggggctcgaggaccgcatgtcggaactcgggaacaacctgtccaagatccggggctcgttgcgggtcacctacactggactccactagctcgccggggagtgcggcatcgagtccacaatcccagtgaatcccgatgagttctctctgacctcctcccttgcggaactggcgacggcgatgggggagatcccctccaagcatgcagccaggatcgcggaggagacgtcgaacgggatctacaccggggcgtgtcatgtcctcgcgtgtgtaaggctgtcgcatcctgaactcgatctgcgcgagatcttggatcagggggcggcaagcaacacgcgtaaggaggtgatggaagaagtcggtgatctgggggagtctgttctccccctttttgaagagtaggacttcttgtatttgttagataatgtgtaaaaattgaactctgaccgccttcgtgcgtgcaattaccatccttgtttagttttgtatgttgatctcggaagcttttgtccattgtagagatgctgatgacgaggatgtccagcagcgcgggcagcccgagtcactggcgataattccggtactcgagcttgaaccacacatctcgcctgacaatgtggatcaaacccttggtgcggaggccgggatagcgacgactacctcaagtgagtagccccttcacctcttagtgacctcctgattaggtcatccatgttccaaaagaggtatccagcttgtcttagtggttgtcacgtttagcagatctcgaggatgcccttgaaagccaagatcgtcgtatccaatactggaagacgaagtttgaagtggcggaactcgagagaaccatgctggccgtgaagaaagagcaggctgtggaaacgctccgaggtcgcgaggtgtggtttaactcgtacttgaagagttgctgcacctccatggccagagtatgcagggaacttcgagtagtccgcggtgatcccgaggagtcggcggccgggtacatctcgtggctgaacggggcttgtgcccaactcgatggcatcggcaagcgtatcgacgaggccttgaaacatgagtgtcgtcgagcgagctgatacgccggaggacacgtgctggcttgcctacgagatcaccgcccgcgcctggacctcgaatttctccgcgaaggttttgctcgttctcagagaactctggcggagatagaccatctggtgaggtcgatgtcgccattggccgagaagatcttccagtttatgaactggcgttggccttcttggtagtactcgtaccctgcgacaaatatcttagggaaagatgtaatgcagcgagagatttatgtaaaaactgtaagaagtactttgtgaataaagaaatctatctttaacaaatgtttcttactctagatgtcgtgtgtaacagtgtgttctcagttaacgactttagtcagccgtttgagtcgtacactctccctagcccccagccttgtcgtcgggggaattttctcggaggataaggctcttggacccttgacctgccttggttgaataagctctgatcctagcccccagtcgtaaagttggaaaattgatttccgatttcacggcttggttaatacgcacggcgagaactcttacacgaccagatcttacatggtctttcgtctctacaggatctgacaaggccttatcggctctgggcgtccccagccgaagatcccttaggttcctcgcaggccttgtcgagacggcataaagggacataagggcaggtttcaacgctaggtgtcatcagagtaagggatcatcaggcgaaaacacattgattgtgatatgggcctagatataggctttattgatactataagggtacttacaggtacggtggtattgactcatacatagaatttacatagttggtcaatgttccaagaatttgctaattcgcgaccgtcgccgtctgcgatttggaatgcgcctggccgcaagacttgtgtgatcatgtaaggtccttcccattttggtgagagtttgtttcgccctgcttgggtttgaactcgtctgaggacatagtcgtcgatcgaaagtatgcgtgctcggatacgcttctcgtgataacggcggagggcctgttgatagctggctgctcgaacggcaactcgttcacgatgctcctcgagaagatttacatcgatgtctcgctgctcctcctggttctcgtcggagtacttctatactcgtgtactctggtgtcgtagctcgccggggagcatggcctcagagccgtacacgaggaagaagggtgtttccttattggacgttgtcggtgtggtgcgtacggcccatagtactgacgggagttcttcaacccactttttgtcgtgtgacatgagcctgtcgtagacgcgggttttcatcccttgtagtactatgtcgtttgcgctctcgacttgtccgttgctttgagggtgagagaccgaggcgaagcatattttgacccccagggcgatgcagtaatcctggaaatcagcgctgatgaactgggagccgttgtcggttatgatgcggtgcggtagtccgtatctgcagaatatccctttgatgaatttgatggcgttgtcggccttgatttcccccgtgggtactgcttcgatccattttgtgaatttgtcgatcgccacgaataggaatttgtagccgccctgtcctcgtgggaatggcccgagtatatctagcccccagcatgagaactgccaagtcagagggatagtctggagcgcttgtgcgggtatctttgtgtgtttactgtggaattgacaggcttcgcatcgctggaccatgtcgcatgcatctttaagggcggttggccagaaaaagccttgtcgaaaagctttgccgaccaatgtccgaccagcggcgtgtgacccacatatgccttcatgtatgtcgaggaggaggtgtctgccgtcgtcggtagagacgcatttgagaagtaccccgtttggcgcttttttgtatagatcgttgccgatcatacagtagatctttgctttacgggttattttctcggcctctgtatcgtcctcgggcaactcctcgctgctaatgaatttgattagtgggatgcgccagtcgtctgtggtttcgatgtcggcaacggcgtgttctgcctcggtgacctccgagccaatgtcgggggtgttcgggctatcttcgtcgctaaccttttccaccgatggcttcgtcaggatatcgagaaaagtaccgggctcgagcggttctcgtctggacgcgcgtcgtgctaggtcgtctggctcgacattgtccttgcggtagatgtgtcggacctcgatcccatcgaaccttttctctagcttcctgacttctgcgagatacttggataactcggggttagagcatttataatctttgtgcacctggttcgcgactagctcggagtcccctttgacgattagtcgcttggccccaagtgcagttgcggctcgtatcccggcgagtaatccttcgtattctgcagtgttattggttgccctgaagttgaggtggattgcgtgtttgaattgatctccgaagggagacgtcaagataaatcctgcccctgctccttggctgttgagtgcgccatcgaacgccattgtccatgtttcgttgtcgccttggttatctgatttgttatctggcatagtccaatcggcgacgaagtcggcgagtacctgggacttgatggctgtttgtggtacaaagtggacatcaaactggctcagctcgactacccatttcgcaatgcggccgacaacgtctttgtttctcacaacttcgccaagggggcaagaggagacaactgtgacactgtgggcttgaaagtagtggcgcagcttccttgatgtcataatgactgcataaagcagcttttggatctgtgggtatcttgtctttgcatcatggagagcttcgctgatgtaataaactggtcgctgtacttctctctctcgacaacaatgacagtgctaacggaatatggcgtggcggcaatatagaggaataattcttcattaggttggggagcaacaagtacaggggggtttgataggtagcgcttgagtgcaatgaatgcctcttcggcttcccgtgtccatacaaatttgtcttgtttcttcagcaaggcgaagaaaggttatcctcgttctcccatcctggcgacaaacctgcttagcgctgccatgcatccggttagcttttgtacctccttgagtcttgtgggcgacttcatgttctcaattgctttgatcttctcgggatttgcttctattcctctgccagagacaaggaatccgagtagcttgcccgacggtactccgaacgtgcacttctcaggattgagcatgaggcgatatcgtcgaaggttgtcgaacgtttcccatagatcgtcaatcaatgagtcgcctgtcttggttttgacaacgatgtcgtcgacgtaagccttgacattgttgccaagctggtcgctaagtgcgccctggatcgtgcgctggaaagtattcccggcggttatcagtccgaacggcatcttaacatagcaaaatactccgaacggcgtgatgaatgctgtcttctcttcgtcctcttttgccatgctgatttggtggtagccagagtaagcgttgaggaagctcaatagctcgcaaccggctgttgaatccaccagttgatctattcgagggagaggaaagtgatccttggggcacgccttgttgaggtcggtgaagtcgacacacattctccattttccgttggccttccgcaccatgactggattggctagccactttggatgaagtacttctctgatgaagccagctttgagaagtttgtcaagctcttctcgtatggcttgttttcggtctggtgcaaatctccgcagtctttgctttactagcttggcatcgggtcgtaccatgagtttgtgctcaatcaccttcctggggacccccggcatgtcggacggctgccaagcgaacacgtcggcattatcgcggaggaaggtgatgagcgcgagtttctatttctcgtttagtgtcgccccgatcttaacggttttgtcggggttggcactggagagtggaacgaccttgatggcgccgtccggcttcggcgtcttgtttgtcttgctcactttcttgggtggctcagtcgtggcggatgggctgggcgtttgctcgaccatgtcgaggctccgcttgtcacactgcaccgctagctttgcgttcccccgaatagtgattgttcccttcggtcccggcatcttgagcacttgatacacgtagtgaaatgcggccatgaacttcacaagtgcagttctcccgatgatggcgttgcaagctgtatcgaattcaacgacatcgaaggtaatctgctctgttcggaaattgttggcttggccgaaagtcacgggcaacgtaatcttgcccaaaggtctggacgatgattggggagtaattccatggaagggttgatcagttggtgtcaactcgctttgcggaattcccgttgcgtccaaagtgctggcgaagagaagattgattgagctgcccccgtcgatgagaactcgcgctaccttgatgttccgaatggtgggttcgaccatgattggatatcgtcctgggataacggcggtcttggggtggtcttcttccgagaactctatcttctgctcagaccacttcatcttgggtgcagccccctgccatgtggagcagacttcacgttccactttcttgtattctcgtttggaggagtacgttgtagaactgccgaagatgtgtgagacgtggaggtcggagtctggatacgctgaatccgattcattaggagccgtctcttcgttcttctcgacaacacgtactcgcttgcctttttcaaatgccatgtgcttctcgagcgactttttaaaaacaaggcaatcttctagagaatgtctgtccgtcttgtgtatggggcaccatgatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctggtttcttcactccccccggtcttcggcatgtcgttcttgcgccttagcgcatcatccgcgtgggcgcatcgctcgacgatctcgaataatctccgagtggttgtgatgcgtcttgtcgccaactcctaggtagtgtagcgatctctgacaccggatttgaaggcacgaattacagaagcgtcggtgatttcaggaattgtgtttctgcactcgttgaaacgtcgaacatattccctcaatgattcacccgagttttgtgtcaacgcgtgtaggtcgtcttcgatcgcgtggcgcttgtatgttccttggaaattggcgacgaattgttgccacaggtctgcccacgaagagattgagtagggaggaatatgcatcagccatgaacgtgcagaacccttcaatgcggttggtaaatagttcgctaacgcgttgtcgtctgctccggcagcataaagtactgtggagtagacttgaaggaactcctctgggtcggtgctcccatcatacttttctattgctccgggtcggaatctctcaggccatcggacatcacgtagggaacgaccgaaagccctacacccagcgttgggggcggtgggttgtcggcggtcgtgtgtctttcgtggatgtctgtctgacgatgaggaggacgctgatgatgacgatgacgatgggtcacttggttccgacgtacgattatgaggatgacggcctggatctcgggaatcctgtcgtcgtctcccgctgttgtctcggcaccgatctccatcatcatcgtcgttacggcgcgggcatgaccagtattgtctggcccccgtcgttcgcgatcgttgcgatcgtggtggttgtcgtggtcccggtcctcgtttgagcggtctcctcgatttccgttatcatggcgccgtgaggagacatgacgccgagagcgatccacgttgtctcgtgtgagtcgtgcttctcggcggccgttgatttgatctcgaagatcgccagtgccgcgaggtggaggggtagctcgttgaggggattccctctgttacggatcttcaccattggcatcgccagttggtggctgctcctggtgtgctgcggtagcggcttcttcaaacgcattgctgaggttagtcacagattcccgtagtcgttctgtccaacactcgaggtcatcgttcagaacgggatcgtaaggagtttccctcagtatagcttgaacggccctgatgtgttgggctggtgtagtcgattgatttgccgcttctgcgttggcgtgcgctgacgtgccaacgtcatcgatagccaatacctcccgcggtgcgctcgttatcgatgacccatagtcctcgagaagatgtaagaccgatggtttgtgaggatcgatatcgattaccccaacgaatcgatctgaggttggagttgctccttgttccttgccgttatccctgatgggggcatatgacttaggagatggagctttcatggcgccgaggaagactttgcagctcgagaggtcgtgattctttgtcttgtgaataggacaatagacatcccgagttggagaagtgcgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgcggttcatgtcggaaagacaaggtttgaccgtatcagaatccttctcgagcttggatgttgtcgatgttccgttcttcgtttcaacgggaggatttttcgacatggagtcgccttggttcgtagccactgcgttctcgtttccggtcattgggggaccggttgagatcagcgtcgtggtgtaaaccgggaagacgatttcgccaacttgagtccataccagcattgttgaagcagggagtacttggctgaggctggtgttgacgttgttgtcgacgaagctggatgacatagtagtagaaccttgagtaccaagtgtccctacctggcgcgccactatcgacgggtgatacccgtagaccgggtatagagggtattggggtacgttggtacaaggatctacgtagtacgacatcaagcaaccaaaagacaagaattatactagttcaggccccttgataggtaatagccctaatccagttggtatgggattatatggtggaaaacacaggttacaaagggaacgatggaacttatcagatccggcgagattgtagtcgagttggttcgacttactctcgatgacttggctcttcgtagactccggcttcgtaggctgtgtgggttgtgttggctctgagattcaatgtcctatgccctccccgggggtcccttttatatcgcagatctagaggtctctaagtagaactcggaggtatcagaccctatacgatacgtcaacgacccagttctgtccgagtaggattcttcccatctgtagatttcgtgaaaggtttccttacaggaaatatccgcgtgcgcgtgagtatgctatatcgatatgtaacgtatatcgaagggtaaagggtatgccgaacctgtaaccctgacaaggagtaactgaaacaaacaagtagattattatgctagattattataatctatagccagattagtataatccaataatctcctctagaggaggtttttttcagattattgagtggctgaagacccactacccttagatgcatctaataatccaaagaaacaaacaactcacaacttattctatgtcagcttattataatctagcttagagtaatctgatttaataatctagattacaataatcttaaactgaaacaaacagtatcttggcatatcagggaatacggatgatccatggggtaaaattttctggtaaatccaagtgaggggggtggctgtgactgcaggtgggcccgggactgggtcggcggggattctctgcggccgggtggagtacggcgctattcggtggcggctcttcggttaaaaatgttttttattactttttaattaaaaaccgtttttggcgagtgttgcactgttgccttgcccttttgtgttgttgaaaagatgtgaaccgttcttcttccgagcaagttggacatgtttctcgatggataacacaagtgggggttatcatctactatttgatttggaactagttactagctgggttggtgttctctaggagaaaaacatactgtggtgctttttttaattagcaaatcacacatagggataaggagaatgtatgatatatactcgagttaattttgaagagaaacccaaaaaataagttagacgtatgtttcaaagataatttcaaatgtcaccgattgatattggaatatatttaaggagcatgtagctataccataagatgtacttcccccgtttcacaatg

SEQ ID NO: 73309 - DNA, 726 bp, Oryza sativa
gtagtcccaacatgataacgacaagttccaaacatgtgtgttcttgttgtgtttcacaatttttaaatgttccaattaatatttttttttcatcgtgcataattttaatgtttcatccgttggtccatctgatttttatggaggaatcgaacgttcgatttggagtttcctcccagaaagacagacatgtgccaagcacacaccaaaagagggaagggaacacgatattattccaataatgaatctataagtgtttcttaattaactcgttgatcaccaactttacaaacatcgactgacgggtcctccttgggacgacccaatgcattcctccggcacaacaatgtcgaatccactcagcgtccactctgcctccgcatacttgctgacgtatatctccgttccgacgtccagcgacgaccacctcctcttcgccggtggcgtgcccggatcctacatccatgttgcaaaacaacatcaatcacactcacccaaaatcctttccattttgctaaaaagaagaacgatcacttcctatctctgcattctgcattgaaatttctcaaccaaagtaaaacatcaactgcacaaatgcaatggactccctacatcctacaatataagaatctaaattcagatggatatttctgattcgtaacaatagaaaatatcccatctcatctacgattctaggtcttatattttgggacggaatgagtacctggt

SEQ ID NO: 73310 - DNA, 689 bp, Oryza sativa
tatttctaataatataattacttagataccgtatgaacccgcagaagggatccacggtacccagcccattgatctgctaggcttcatcagtcatggtactgccaccagacctggccaccatcagaggcatggggcagcaagtttttttttcttcgaacgatcaggccgttgccgacgttttacataaagaagaagttgttttattttaaagagaaaacgagaccaaagcttacagtgcatagttaattagggaaaactatgcgaaaaccacaactattccctgttataattatgagcgcaaccagtgggattataagttatgtgattaatagtactaactataaaagtaaattacaactatcgacggggaatacccgtagaccggatatagagggtactggggtacgctggtacgaggatctacgtagtacgacatcaagcagacaaaaaaacaaagattatactggttcaggccccttgataggtaatagccctaatgtcacgtcctgataaattcatcccgaattaaaaatcattctctaaaaggaataatagaattaattaaaattcgaaaagaaattggcaaacactaaaatacgtacaagaaaattcaatgtgacccggagaaattttgtaaaatctccttggtctaaaaggagccctcaaatttaaatggaatttcagagcac

SEQ ID NO: 73311 - DNA, 2388 bp, Oryza sativa
cctatgagcatcacacttaggccctgtatagatgggactaaaacttttaagtccctatcacatcggatatttagaaattaattataaatattaaacgtagactattaataaaacccatccataatcttggactaattcgcgagacgaatctattgagcctaattaatccatgattagccatgtgatgctacagtaaacgttctctaattatggattaattaggcttaaaaaaattatctcgtgaattagctttcatttatgtaattagttttataagtagtctatatttaatactataaattagtttctaaatatagggactaaagttaagtccctggatccaaacaccacctaagccgttgtagcctatagtagaccttgtccaatggcagtgccgcagaggacgaggtcactatcacagcttccataaaccccagcaagttctacactggcacaaccaccaacccaagatcgagggcctctgcaccatgaagcgtgaccgggacgaaaagttcaccgctattgacctgagaacaaagggctcaccacaaagaacaaggtcagggacgggcgacactcttggatggcagtaggatgccatgaatgagcgatgggagaggttaggaatagggcgctgtgcatcagggatgcccgctagagcatgaggcagtcctggtggggcagcaataagcagtgagaggttgatctccgcacaatgagaggctggcccagagctggtggtgggaggatggctggatgggaacggcgacactcggggacaggcgatggagggcagggaagttgtcgggatgccgagacggtagggcggaggcggtggtgggaggatagggtgggattggttcatccattagggatgttggatcaagttggagcacccaaaacccaaataatgacagtttcttttagtaccgaagattcttattgacaatcggcaggagatgttctaagcctttgtattccgggggtaatttcgaactctaaaagtatttatattttgggatggagtatacttacttattatacttcccttattaacaggttaggtttgttgttaatggcacttgcaataagatgttttctttccttactatgaggttttacctctaacaaggtaatagattatagagataatccaagaaatgccattgacaagcgtccaaatccaaaaaatgtcatcgacaagtgtaagttcaaagaaatgctatcgtacaaattattttgtcccaaaaatgctatcactgttaggaattgacagtgttcttacggcgcggaatggacggaaccctaacgatgatggcatgtttaggacaaagtcatttgtacgaagacatttcttggaactcacacttatcgggtagcatttcttggatttggacgcttgtcaatagcatttcttatattatctctagattatatcacccattggatcaaacaccaatgaactgttcaaatatacttggagctccttaagaagtccttatattttggccccatttgatagggctccaaactccaactcctagctctaaactacaatttcagtgagagctagcttctgttagagtttggctaggtttcagctccagatctgaagataaaaaagaaaaaaaactaaaaataaagaaaacaagccgccggccgttcgctgtcccaggcgcgccgcccgtcgtcgtctcgggcgccgtcgcccgtcgccaccagacgccgctgtcgcccaccgcttcccgcagacgccgacgatgccgccgccgcccgctgacaaagatgctgccatcactcgccgcttcccgccgccgttgtcgcccactgccgtcgacgctgccgccccgctcgccgacacagatgttgccgtcgcccgccgcttcccgccgctacccgctgccgtcaccacagacgcccatcaggaagaagatgtgaggatgagaggaggtgtggaggggtagttgagtagcattttcatgtaaatagactaaaaacttaaagggtagtgggtcttttggggtggagtggagctgtggagcagcaaaaacctagctccacccccgtagttcattttctaggaatagttctgctaactccgctccagaaaacggaagatctggaccgtttggcacagctccggctctaggtaagctagagctgtgccaaacggggcctttatttagaattttcaatgttatcatttgatgatctccatggtcagggatgcttatggtacagcttcatcaagaagagccttcatggcatatgtgtctgaagggttaggcaacctacaagactggaatcaggtaatggcgtatcaaaggaagaatggatcgattttcaactcgccttctgcaactgctgctacaataatccatggccaca

SEQ ID NO: 73312 - DNA, 8190 bp, Oryza sativa
aaacgtttgacctttcgtcttatttaaaaaatttatgtaattataatttattttattgtgacttgatttatcatcaaatattctttaagcatgacataagtatttttatatttatataaaaattttgaataagatgagtggtcaaacgttggttaaaaagtcaacggcgtcatacattaaaatacggagggagtatttgaattgtatagttttaatttgtattgtatttatctagaaattagatgtcgagggatatgcagaagtcacccgcaaattaatttcagaagtaaaaattaacatttccaaattatttcacacggacacaactaattaaggaagaacgtactccacttcattatatgcttcattttcttcaatattagctgagcgtttttgatatggacggtggcgcgatcttcgctgcgaaaacctgcctttgtgatgatggacttactacagataaagcattttggaaaaagaaaaaaaaaagaaagaaagcacaacaaaaaaaaaaatcaatattttgatgattaataaaaaacgaaaaaaatattccctccatattttaatatatgacgccgttgactttttatctaatgtttgaccattcgtcttattaaaaaaattatgtaattatcatttattttattgtgacttgattcatcatcaaatgttctttaagtataacgtaaatatttttatatttgcataaaaaatttgaataaaacgaatggtcaaatgttagttaaaaagtcaacggcgtcatacattaaaatatggagggagtagtacggaagaaaattgcacaggactccagtcctttactcatccgaaggaccgtgcttctttccgtgacacctgtccgtgaacgtctccgacatgtccagcttctccttgccgtcggggaaccgccaccagtcgaacaacgagtgcaccagctgcagaacaagttgtggacgaacacctttgccagcgcagtccagcactaattaatgtgttctaaagcaagaatgtgcaggtaaggtagcaaaagcgagctcagagcgttaatcagaattcacaagataatagttactccgcagtatctgttgctgccaaaagcaaatctcatctcaggtaacaaatcgatcgagcaggtcaaattaatcagaaggaattaattattgagaccggggagcaatgcatgaacgattggacgacgaggtcgacagccaccgatcggaacgaacctgcgcctgcgcggcgacggcccaagcccattatcagtttctgctgcttcggcccattagcacagcccaagcccctctcaatccaaccaacgacacgacatcatcgatcatgactagcgcgtttccttgcggatacggcggaggcgctgccggacgacgtggtcgtcgacgagatccaccgtgcaccaccgtccgcatcaaacggctcggcgacgaaagctcggaggagcagccggcttcctcatgcgccgcgggccgcggccgtgtcgttcgtctcgttgcggtcgcgatccatgatctccgtcgttggcttttgggacggcgtcggcctcgtcacggcctctcgtggccgccttcgacatggcacgggaggagttccggctgatggagacccctgagcaatgggcggcggcgtgcaggcccacgagctcggctgcgcgcgtagtgagaaggatacactgcacatcacccgacatcgcggcaagctgtgcgccctcgccgacgagcagctggcggccggcgccaccgacgcgttcgggggtgtgggtgctcgaggactactccgacccaagaagcagctggcggctccggtggaagatcgattactcttgcggcgccgccggtgtcctcggtggaccagatggtgcttgattctttcgcgcccgcttctcgacagctgctgtggtggaggtgctacccggccgatggcatcgatggcggcgaggagatcctgctccagctcgtttgctgagagcaaatagttataacggctaaattgtacatgagagcaaatagttagaactcttcccaaacagctatagcgggagatagcgcagtaatagcgggagttttaaaaccctggtgtttaggcgtccggttttaattagctcgtttgctgataggtttggtgtttcggatccctcttttcccaacactcccaacttgttttccgcttgtacgtttttcaaactgctaaacggtgcgttttttgtaaaaagtttttatatgaaagttgcttataaaaatcatatcgatctattttttaaaaataatttactaatacttaattaatcacacgctaatgaactgctctatttttcgtacgcactattcctgttcggaacacctcctagcgaacacacagctcggtgttgtcgtttatcagtctaactctaatcgaatcgacgtactataccttgctgctgcagtgctgcttcggcccatcaaactgatgacagcccatgcaagccccaagtccccccacactggttcgtacaatatactacgagatttgcaacctaattaagctaactatagcggtttttcctcccggtgccaatggactacgacgatcgggaacggcggcgcgggagaagggcccccggggaggcgctgccggacgacctggtcgaggagatcctcctccgcctgccggcgccgtcgatcgggcggtgccgcgccgtgtgcaaggcctggctctcccgcacctctcagccggatttcctccgcgcccacgccgcccgttcctgcacggccaccgtcaccgccgcggccaccgtggaaactagaacgacggctccccgcggaaggtcgtgcaccaccgtctgcgtcagacagcttggccgcaaatgctcgggggcggtggcttccctcgccgtgtcgttcgtctcggcgtcggagccggggcgatccatgacagtcgtcatcggcttttgggacggcatcctgtgcgcagcgcacatactgtttggccccggaagaggcgttgagcggtacgtgctctgcaacccactcaccgaggcctgcaccatcgtgccggctccgtcgaccgacggcttcctcgtcggcggttacgcccacccgaccacgtcgcgcttccacatcatgcacgccaacttcttcacaacgatggagaccttttggatcctgcggctcggggagaacagcgtgtggcgcgaggtccgccgccctgccctcgcgacgatgagggtctgtattaagttcctacatgctccgcctgtcagactgcacggctgtcttcactggctggcctcgtcggcctcatcggcacagtttctcgtggccgtcttcaacatggaacgggaggaattccggctgatggaggcccccggggggcaaggagtgcgcttcggctcgcactcgcacacgatgatgggaatgcacatcacccattgccacggcaagctgtgcgccctcgccgacgagccgggcgccaacgcgttggggatgtgggtgctcgacgactactccgacccaacaagctggcggcttcagcggaagatcgactactactactcgtgcggcgccggcggcgccggtgctgctctcgacgacgacccacacgccgccgccgctcaaacttttcgtgcccgcttctcgacagccgatgtggtggaggttctgcccaatggtgtcgatgacgatgacgagggcgaggagatcctgctccagcttggtgacgaggaggtcgtgtacaatgttgggcgcgcggcgtggcgcaggtgggggatattgccgctgactacacgccgcctgatgatgcataggcagtgcatattgccgcgcgaggtgagcttcggtgacgcgtctcaggttccttgggaggacatcggcggccactgtttctaccgcatatactagggggaagtttttactagtatcatgcatgtaatttaaatagttatataaaaaatttataaaacttgataacatagactatgataatataagataagtactatgtaaacatgtaagtctaataaattcaatcgacatatgaacatatctgtacaggtactattcactgtctgattttattatttttgtttctcttgttgtagatcaaaattagtactgcatgtttgtgtatagacttatataatcataatcgatgttactaatttttttttaattttttctataactatttaagtcgcatgcgaatgttgggtgccatggcacctaggtgaaccatgggtgtagaaaatccttatcacatatactagtactagttgggcgggcgtgctgtattttaaccctagtcctaagatggccttgtgtgtctaatcaattagttttgttgaaaaaatttttttgagagagatttgtttgaaattatttgactttttttacgagatttgcttcaaactacctaatacatgtacatgattttatccttcaaaaacaatattttagactcaaaggtggattaatccttcgaaaacaacctaaaaagctcatgcatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccaaccgggactaaagatgatctttagtcccggttcgaatgctgtcagggtctgtcaggccctcccggtatctttagtcccggttgataacaccaaccgggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaataaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatatagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtcgggggaaaacggattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgatagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaagggccctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtaccggaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagag

SEQ ID NO: 73313 - DNA, 1121 bp, Oryza sativa
cctccgccgtgcaggaagctcttctggctcatgagcaaggttttacactttgtctacatggaaaaggataggtatttcacggcagaggggatgatggcctcggcaaatgcggtgattcttgatcccctgcaagtgacacttcctccatctgattcgggaacactgtgaccacaaacaaaacctgaattgtgtactgtgttaagcagcctgcgcaggtgtttattgcccgcgtagctctcctgcaaattataactaggtcgaaataagttgcttgtaatgtctattactcaataattcttggtctagaatgcatatagtgtattcaaacatttgactttttaagtatgaaataagttgtttgtaatgtatacaactactctttcagtcctgcaaaacagagtgaagcgaataaagcatacacacatataagaggaaatacacttccagtgattcaggggaaacagattaagatcatatatgaactgcttttttcttacgaagttgtaaaacatgcagctccaaagaaatcaaaaggtacaatattcagccataccaaatataatttttcaattcgacatttgcgtgctaatatgccacgtctgaaaggaaattctaacactttacttcctccatcttcttatataataaagttagttagttaaaaaaaataaactaaccaacgtaaagtaaaagacaaattgtgttcttactcctatttatgttgcagttatgatttttttctgatttctttaggttgcatatttgaacttacttttttcaaacgaggcttcagtatgcccttgttctggatgacagtaaggtggacttcagatttgtgagataacataaaaggaaaaaaatatttacaaaatgcaaaaggacttttttaccctggcagacataacttacccacccccatacccaactagctagcccaacacaatgttcgttaagccattccgtccaaatcccgtgctaggctcaagcaatcatttggccatgcacgtggtggggaaatggagaggcggtgacaaatccacttccaagctgatcgtgcaacagctcggaaaaatcaggcaatcaaagcgccccgggcctgccgctacaagctgtcaatgcat

SEQ ID NO: 73314 - DNA, 15456 bp, Oryza sativa
  unsure (1)..(15456): unsure at all n locations
agggttggcacatcataacggaagtggacgaagacggccgacctagtgccccggtagaagccgccaagaactatgtgtcatgcccggaaattcactagtaatttccgaacttatttgtgtataaaaccctcatccaggaatcagccgaggtacacaaactgacaatttaatatacaaatccatcataataacgttacatacttacaaaagaaaagaaaacagcagcggaattacggtctagcgatggcttcagctccactcccacaggcagctcaactggggtataagccaaacgtcttctccttctggatcctttctcttcaactgaggtttgatggttattgcaagaatgagcatatgacatactcaacaagccacacagcaaatatgcaagtgcacaaggataccaaaggatggcataatatagggttcatatgcgaaagcagcatttaacaaagagttgagaatttgtaaaacagtagagtaattaatcattaatattaatcaacactgaacagcacacccatgctgcacaggcccaaccaaacctgaataaccaaccccggtcatacagatcaaacctccaaaccaggaattatccattccaaatcaggagtcaaattaattatcacattattatcattaatgagtagtgtgggactaatcacaaaaaacattgctcaaagggttgtttgggatctgtgtgacttgccttgagcttcctcaaacgcttccgaaccttcctcaacgaaaacgctctccttcggaacgtcggaaactaaagcgaaagaacaaaatcaagaacaagcataaatagtacatgtggatatttttaacatgtagatcttgattttagaaaaaattagcaacttgaaccactgaaatccgagttacgatgatttagttatgaatttccgaagtttaaatcgattttcatctaataaagaaaactaaaagagatttatgacgtcatcatcgccggcatgacgcgagcgacgacatcaccggcgctagagagatcggccgggctaacggaggacatctacgcgtagaggacgacgacgcgaactcaccgatgcaagaaaacgcgacgaacgacgaagaacgacggccggcggcgaggttctatggcagcgcggttcgggtcggcggcggcgacggcgctccggcgtccggcgacggcggcgagggggcggccgagatgcacctcctccgtgcgcacccaacggcggcgaaaagaggcggcggcgacggcgctagcggcggcgcgacgcggctgcacgatggccggcggcggcggcgactaagactacgcggcggcggcgctacgagcgacgagggagctcgggagttggggcaaacgaaagaggacgactaggggatgctatttataggcttggattgaagagatcggactccagccgagaggaatcgaagctggaaaatcttcgggttagtttggagagataaactcaaaacgaattcgatttggtttatccggatgaaattgatctccgaaacgttaggggaaaggaagaggataaggtggagatgatttcccctcaactaatcggactcgagggcgaccggatgaggcgaatttggtggagaggcggcggcggctcgggctcggcttggcaaggcggctggccggaggtaggggatgggtccgacatgtgggccccacatgtctgcggcttggggagaggaggggcgggcggttcggctgggccgacttgggccgctcggcacgcgtgaggagagagagagagagagttgggccggaaacggcccaacaacttagaggaggattttaaagagtttttcaattaaaataatcactgaaatgatctttgaattgttaaaaatacttcaaatgctcaaataatttcaataaaaaacctgaaaatacttggacactcaaagtatttaacaaaattaaaatcagatcatttaatgattaatttaatatgtgggtaattactgaaatgttcttggtatgattaaaattaggaattgaggtccgaaaaatccgagaataatccagagagtataattaaccatggagaatttaataaaaattaaattcatccatgctttatatttaggaaattttatttcccacatttaacttcacttgtaaattaatgaacatttaatataaattctaataataatttgttaaataatttataaatcctaagacgaaaatcaggatgtgacaactatgtacgtcacagcggttgggttgtgcgggataacgtgaatgtcagtacggtgtactggcacagaaaagggcacgcggagatcatgagagctttgtcccagattcggagaaagagatgatgtggaccacaatgctcgagacattcacccttcccgcgggtacagaggacaaagtgaaaaggtggactctgaagaaaatggcagaacagtttcagagcttcaagagagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatagaggctagcttgcttgagaggggtatcgaatcggccaccgctaattggccggaacgatcgaagttctggtactatactcacggtggaacgctcaacccagctgatggctccctggtcttcggcgatcagatacgcgaggctgcgcgtcgactaacagacacagtggaagcctcttctcagggcatgttccgaccggacaaagggaaggacgagctgtcactcgccctgcagactccagagtatccaggacgaacacgagggaaaggggtgattccttggaagattgggttcaaggaggacatccacacgtacaggagtcggatggggagcaaaagagataccgaggcgaagattgcagatcttgagttcagggtatcgaactacgagctcagcatgcaagaggaggtggcaaggaagggtgatgaacgcatgaccacacatcggtccaatgatccctagccgaccattcctcctgcaatggtgagcccgtcaggaaattgtagcagctgcgcctcaacggggcaggtaggatcacagagcatggacgtcatgcaaacccaggacgaaaccacctgccccgttgatgacatcactcagcggacaccatgtgagctgcatatccccttcaggaacttatcaataaaggtaagctcgtagtttatagattttagatttggccattccgctagttgctgcttatatatgttgattattaataaataacctctcaccacatgaaggtggcgtcgggcatggccatcccaacggacccttcaggtacttaccactgtaggccgattccagcaagatactccaaggtcgaagttgagttggtcgaaggcgcgtacgaggacctcgagctagattaccctagaggagacggtgagacacatctacgagacacaagccacgccattattctatggcgcaagcggtacatcatcctccctaggcgacaagcggcgtctcgtgcaccatctcctccggctctgccatctcctcctcatgctcctgcaccatctcctcctcatgctccagcaccgtctccacctcaggctcctgcaccgactcctcctcaggctcctgcaccgactcctccttaggctcctcttccggcaccttccaagtcaagggccccccaagctccaccgcctgcccccacaagggcaacgaagaaggcgaaagttgacgccgccaagaacaaggacccggggtacgattgcatgcaagaggagcttgacgcttacatggcatcagaagtcaggagacaattcaagcctcgaagtccagaaaagaagattcctatagacccgagtgtcaggaacttcttcaggggtatgtctgcacctgccaaggaggccataaagctatcggactatgagcgaacactcaagaaagcatcttctagaaagtccaaaccagtcccccagcttggagagcaaccaaaccaggagatcgagccattggtgaccggtgaagattttggaatacaagactttattaatgacaccgggctaactatggatcaattgctagaagacgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacaaggacttcttgcaaggagatgacattctctggatcaatttcaagggaatctacgaactataccagctggacgccctcgacgtctctattatgagttgctggattttgtaagtatatcgttcagttagatttcttactacgtctactttaattaattaggtccttgtatataagtagactctatatataatatatactcccttttattgttgtagaatggagatccaaagggcccgacggcagggggttttcgatactggattcatcgaccctcggaaagtaaacgttgcaatgctcgaccaatatccgcaagccacagaggacaatctcgtccatctcctgaaggcgcaacattacaagacgttcatactgttgccgtacaacacagagttagttcaattttactgtcttcctataccaaatttcattcccgtatgaacatgctaagtatttcatatgtaatgcatcccacgcacattgcagattccactatgtgcttttactcttcgacctggaggcctgcaccgtcaacgtatatgactcaatggataaaaaagagtctacatttgacaaggttttcgaacttatagacaggtactgtcataagttcctatattaattaagaatcttgttatagttaattgctactacgaatcatagctttaaactgcatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatatctcgtcgtttgtcatttatttatagtgcgcaaagcaaaagcaaggaactaacttgtgcggctactatgtgtgcgagtattgccactgccttgcagaccaaatcatcaccacaaaagagctcgatgtacgtacaaataaattcaaaatttcattacgtatcgatttgttgtttaattactaatcaatttcatacattcatatagtttattggcatgagggataacctgatcacacacaaggaatttatcgcggcggttcaagaacaactcatgggattcatcaacgaacaaatccttgatcctaagagtgaattctactacgacggaaacacaattcataagtccttagcttctgagctagcgactactactacgtcgaaatcgtagctagctaggacatataatggattgtaattaatacatgactatgtttctatatgcatgtgtacacattttctataatgtaaatatatattttggtcatatatatatatatatatatatatatatatatatatatatatatatatatatgtatgtataaatacatatatattatgcatgtacatatgtattgaaacatatatatgcatggtttatatatatatatatatatatatatataaaccatgcagcaacagggccatgaaaaaaaaaggtcagctcgatctttagtcccggttggtgtcacgcccagaaattctcgaatagaattccaagcagaatgtgcattaaaatccctgtccaggaccggccggggtacacaagcgacaaagttgacatacagatccacgtcttacaaacattataaaagtcttacataaatgcagcggaaaacttaaaggataactggagctaagccttgacttggactgcagcgggaacaccactccacaggcatcctcgacggcacggacgaagcctactcctcggagaaaccaccatctgacgcatactcaaactctggggtttggggaaaatagagcaagactgagtactacccactgcactcagcaagtcataccggaatagaggtatgatgcagggaattatcaaggggtagctatattggttcatttgcataaagcgggcatttataaacggaagttgaaagcagaaaacagttgtaataattaatcaatattaatcatccactgtccaacgctataccacgttgcaacaggcccaaccatccacctatattattcaattccattagattaatctagggtgagtctaatcacggtgaatctggttaaccgcccataaccgcgggcacggctattcgaatagttttactctgatcagaggtgtacaactgtacccaccagacacagccccacgacacgttaccgtgcgccgacatgccaccacgacataccggaaagaggccgcgacaggacccttcgcataaccccctctaaccaagcacaccacacctcaggtttcacccccactcctcgcaaggcagcgggcagtcccctcttgtgcctaggtgaatccggaggccgcataggcagtcgggggcccatccaaactccatcacgcccacccttgcctggatgcgtcggctagaggaaagctacactacaagcccagccgttgcccacgctggcttgtggtaagtacgaggaattcgtccagggtttcccgcgaaccggtccttaattgccatgggcgcgaccatccaaaccatgcacccacggcccaccatttaatatattttaattaaccaacaccggagcggtgagtattaaccaacatcattactagaatgtgattaatgtagtccctcattgtgtgctagttgaactaagcaaagttaagcattccctagtccaatctctagtcatgttatatcccaagttaacaaaggaacatggtacaagatagcatggccatgacagtaggtaaacatcccatagtaatattataaaacaatgcagaatttaaaggaaaacaatagagcatttgcaatataggatcaacatgttcaagtgactagcatgacttgccttgctctgcagctggaggaacttcggcgactaattcaaggtaaaccggagtgtcgggagagccggaatctaagcgacatacaaagcaaacaatacaaacaggctataagactactgaaacagagaacaaaaccatttttaatggattctacacatttttcttgatttactgagacttgaatgggcttaaacggagctcggatgaattagttaagaattttagaagattcactatgtttttactataaacggaaaaatccttaattaaattattgcgcaataaataaatcccggggagagagagggggcggcgctgacatgcgggccccacatggcagtgacccgaggagggcgctccacggcggaccaggtccacggaccgggggagaagcggcgtaccacgtggcgcacacgtggcaccgacgcggcggtcacgcggcagccgaaccgacggccccgatctacccaagggtagatcggacggcgggtgtggctcgcggccggcgcgcgcaggcacggctcaagctggcccggcggccatggcgcatggcggcgcggcgcgcatgcggcggtggcgcgagacggcgaccgacggcggagagcggcgtcgtgggtggctaagcggcggcgcggcggctagcggcacgggagagagagagggaggggaaggggaggcctcaccgacggcgagcaacggagggcggcggcgacggcgggacgatctccggaatcacctaagaaatcgaaatggagggattagagggagggaggcaaaagggagagggcgagggcgccggccgaaggtnnnnnnnnnnnnnnnnnnnnnnngcgcacggcgcggagtggattccgacggcggattccggtggggaaggggtggacgggatggcccgcacgacggcgaacgcgacggcgtcgatagcgcagctcggcacggcggctagcggcgaccggagcggcggcggcggcggcggagaggagggcgacggcgctagggcgctagagggcatgggagagctcggcgagatagggaaaaagagagagggggtggcggtggagcttaaataggggagggggagctcggacgtggccggtagagtcgggaatcgccggccgacgtggggagtggaggaggagagagaggcgggattcgaaaatcgaatcccggccgtttcgagcgcgggcgcgagcgagagagagggggaaatgggtgcggggaacgtgggcacgagggcgacgtgggcgacgtggcccgggaggcgcgggagcggggcacgacggcggttgcgggcgcggtggcgccggctggaggaaggggacgggcccgacaggcgggccccacctgtcggcgaccccaggggagaggaggcgggcggccagttcagctcggctcagctgggcctcggccttcggccggcccagcgggaagaggggggaaaggagaatgggccggcggcccaattgaaggaaaaagagaaaagaaagaaaaaaaagaaaaagaaggaaaatggattttcctgggattaaatattgcttgtgctcaattttaattggttaaaattatttctagagcactgaaaattccactaaaaatcttgttagcgtatttcgacatgtagaactcaagaaaaattccacatgacaaatccaattattatttgcattaatttattagggttttctcttgcttttacaccgatattttctctggtggattataaattcaatttaggcttgggaaagaacttcaggatgtgacagttggtgttaccaaccgggactaaagatcgatctttagtcccggttatttcacccgggactaaagatagcgatctttagtcccggattggtagtcccggtttggaaactgggactaatggggggttacgaaccgggactacaaacactttctccaccaatgagtcgtccccctcgaacttagagaccttgactatacaaaataaaccaaatgtttcctaatattcacaccctaaataaattgcctcttttggtcttctttcttcctatacaacttaatagtttaccatgtgaaatggttaaaccagaaagtggatgaactagagtagattaacgggaacacagactgtggtcaccatcgcgtcttttttcctcagcaagcttgaatccaagttgacacttgatgtctctgctttcacccaaatttggcacctatgttaaaaataggaaaacattgccaaaacttggaaggcgccggtttccttcacggagccggtctgaccgccgtctacgggccggcctgaccggtgtaaagggccggtctaaccgacggtgtgtggccagtctgaccggcagaatttgatttcgagtccgttttcgttggatctcgggattccttgctcgggagggtatgtctcgggttttcattagtttctatcccgagttggacgtggaggaggacccgtaggaggcaagactaacccctatataaggacaaggccagttcaattgaaaaaacaatatactctcaacacaatttagccaatcgaatcactttttcaatattatatttacttttcgcctagttctagcctagttcgtccatatttgtcgatttgcacttaaatcgtctgtcttcactgcgagagtgcgaaatccctttgtaggtttgtcccgtaaaccttccgttcgcccatgagacgggtgtttatcgcttgtttcatctaaatcagctccgctagccggtttaatctatcaaacccatcttgatctagcttttgttagattgaggtggttggcgactccatatcactgcaaggtgtttaggtctcccgatcgtgatcgtcttcttgccaaaaaaaagttgttaacacgatttttagcgactccgttggggaacgacttcatcaacatcattgccaagtgtgaagtggacccaaacaacatcctccccatcactttggaggattcggatgagtaacaacaccaagagatcgaatgtcatgtaaaggcgacgccagaggcattcttggcgagatgcttcatcaagactcgtcaaagagttattcgtaagcccggccttacgtcctaagtcaccgtcaatgaggtaaatattggtgacattgctctttctgttcaaaagcttgtagcaagttccgtagatgaatctggtgccgctactttgaataataaatttgagcatactatgagttcttattttgataaaagaattgagtcatttatgagttccaaattcgaccgacttgtcacctaattctactttaagtactagtcaagcccctgtacttaaaatagatccggtggaattgtacccgtgcatgaaatagatccaatcactaagaatgttgttttgcaccattatctagtacataatccaccagttgctcttgctaatccacatattcctccacatgtaactaatgcctataatgatcctaatgttggatagcctcaagatgttagatatgtccaatataacaatattgcgccgccaccaccttttaggccacaaaatccacaaccaaagcctgaaaagatggaggagcatgtgaggaatattactagagaagcatttggaattgagccaaggaatcatgctagggtttaccaaaagtcgtattctgattattttgataacatcccatatcctcgtggtttttgagtgcctgtatttactaaattaaatggtgaagatagtagaaccacatgggaacacacagaccaattcttagcacaatgtggtgaagctagtaaaagggatgattttaaattgcgcttattttctttatctttgtccggtactgtttttgcatggtttacttctttaccagcaaattctattcatatttgggctaaattagaacaaaaaattcatgattacttatatactggtgaaactgagcttaggttgtctgatttgacatcggttaggcaaaagtacaatgaatacgtcactgattatgttaagagatttagggatgctagaaactaatgttttagtttgaatataactgaaagagatttggccgaccttgcttataatggtttacttgctcctattaaagaaagattagaatgtcaacaatttcttgatgttagtcaacttatgcaaaaggctttagctcaagaaaaccgggttaaagaaactaagaggtttattaggtctaatgataagaagcctaatgctagtattgttgtttgccctgatgatattgattccgataatgatgatggtgatcatgatatttatattactgagtggtcatggactaataagaataaaccttttctttgttctaacttgacaccgactactcgcaaggatcagcaaagtgagattaagaatagttttgatgtggccaagtgtgataagatttttgattatcttttgcaaaaaaaaaacaaattagattacccagaggccatgtcataccatctttagaggagttgaagagtcgttttttttgcaaatggcatgattcttattctcatactactaatgaatgcaatgtgtttcatcggccatagaagaaggatgattgaaatttactgaaggttctaagatgaagctagattatgatttttttttcctgtgaatactattgatttcaatgataagaatgtgttaatttggcgggagcaagctatatctacaaaggggaaggaagttgtgataggagaatctagacctaagatgattgtgccaaaaagtctagaagttggtgtatggaaggagaataaaggtgaagcttcaagttctagaacgccacaaaagtcaaaggcgtctttttagatgcttttgaacaagtatgggaagaagagtgccgaggaacatcctaataagggtaaaagaccaagatcacttccttgggagagaatgtgttgattaccaaggcaattggagcaaccttttccttacaatcctcaactcatgccatgggggccttgtccaatgacgccgctgggttatcctttcccttacttcatgccatgaaaggcaccaccaccaatgtacgagtacatgctgccaatgcaattttataaaggttagctagagccacgaaggtcagtgcatgagcggttgtctttatcaagcaaagaccggtttcagtcaaaaaatcggtttgaggaggaaagaggaggaagaaagcatgctaaagtggagccaaggacttcgaaggtgattactgtcaaagtggggtcttatgatgtaccaatacctactggaaatagagccaaggtggtccagagtaagaaaaccaaagccgggaccagcataacgcagagtgctggtctgaccaggccttctggccggtctaaccgcgccttagggccggtctgattgaagccaattaggagctggaccatcgcgaagggcctgtctgaccggcggtcttcaaccggtttgacctggtctcgaggtcggtctgaccggggtcatctagggagcagttcgggagcttcatcttcatcaagtaaaatcaattagggacattacattgctcctgggatagagacaaattaaaggtggatgcctaagaatttgacggcttcacaaaagaggaggttgcaacatcttcgtgctcaagaaatgagggaaaagaaatccgaagagtggagagatatgagattcaatgagttgcgaccaccagcaagacaagagtggaggcctaagccaatggaggtctaaaagccggtggttgctcaagatgaggaagggaagacttgaaagaagatgagccaccaattgttagtaatgattcaccgccaagggaacatggatgtcaacatggtgtgtatgttgcctatggagttccatgccatggatgaggccagaattgcccaactttcactaggaccaagggatatggtttttgagaagcctgatgagtctaatcgtcatatgaagcctctatatctcaagggacatattgatggaagacgatctttaggatgttagtggatggtggtgccaccgtgaatttgatgccatacttactattcaagaagttggggcgtggagatgaagagttgaagaagaccaacatgacgctcaacggcttcaatggtgaaccaacggaggccaaagggatcttttccgtggagcttaccataggaaacaagatgttgcctaccgctttcttaatcatcgacgtgcaaggtaactgtagtgttattttgggttgttgttggattcatgccaattgttgcgttccttccaccttgcaccaatgcttgattcaatgcgacaataataatattgagattgttcaagcggatacatcggctgaggttgcaatggccaatgcttcaattgaatggcaacatggaaacattcaatgcttgtcggggttagatctttctagctatggtttttattagtatttctaagatggctttgtacctatctctttaaagccgtctagttttcggcttggcaatatagctatgtatgatgagtaaggatgctaatttagagtggttgcaaaagagggtacaagaatatcggtatataaagaacgatattggtgagtccattgaagattttgctgaagtggagaagttggatcaaggttttacatcggttgatccattagaggaagtagatataggtgatggaactataccaaggttgattataaggttaaaataattgagttgtttaatgagtatgttgattgttttgcatgggaataccatgagatgctaggacttaactgtgagcttgttgagcatcgacttatgataaaattaggatttaggccttataaacaaccacctcttcatttcaatcctctcatatacgatcgtgtcaaggaaaagatagaccgattgttaaaagcggggtttattaggccatgtagatatgcggagtgggtgcccaatattgttccggttgagaataaaggaattggtaagattagaatatgcatagattttagagatttaaataaagttactcctaaatatgaatatcatatgcctatagccgacatgttgattaatgatgcttcgggacataatgttattagctttttagatggtaatgctgactgcaatcaaatctttatggccaaagagaacatgttcaaaacggctagtgcaacatatcaaagagcatatgacttttgggttaaagaatgccagtgcaacatatcaaagagcaatgagtttgatctttcatcaggataaaaggactaatacatctaaagcgacataatagccccgatagcgcaagccatcgagataagttacctcttgtcaagaaatcgttgtcgatgccctaacttgaagcaagaactcatcgaaaagtaaaaagaaaaggatggcgatgcatcggaagttgtattgattggattgtcgtcccttattacaatgatctggggtttatatttataccccgagtacaaaacttgtccattatggacacgactcaaactttcctaaagataaaatacaaacaggtccacgtggcagactcttaacatatctctaactcaaaccggcattaatatcctaattaatagatacaattgccttaaatgacctttatctctatgcggcaatgacggttatcccaatcgaggcctaaaccgagcccaagtcaagttgtatcaactgctcgccatatcgactcagtcatactcttactctattttcagtagatacgctacccagtcgattcgcagtccgttttggcaaagatccaatctccttcgattccgcttcgatacccaacttcaaatctgatctgatcttgccaaatttcactgttaacaactgctcccctcatcgaagctctccgctttccgccgccaccatgtcgtagtccatggcgaaatccgtcccgatcctggatcaagccgtctcttggatgcgatcgatggtgacgacggcgatgctggaggaggcggtggaggaggggatgctccctcctcaggttctcatcggctggcgggaggactccgaggaggagttcccgaccccgaacaccgacaagattgtattgttcctccccttcttcctacgctaaattgtacctgtcgctcctggaatttgtgctagcactcaaggaagcaagagcgcctcgccatgagtcgcgctgcctccacttggttgcagaacaccattcccaacgcccctggatggtgagccaggcgtcacatgcatgagcggtggcaaaattgccgacgttgaccctggcagtgcaccacccatttgcaccgctgctgtcggtagacggagcctg

SEQ ID NO: 73315 - DNA, 33234 bp, Oryza sativa
  unsure (1)..(33234): unsure at all n locations
cttacattgtgaaacggaggaagtaattgtgatttgcggctgataaccataagaaccaatactcggctatctttcgacgccttaagtcctcaataatttatatgttggaaatgtaatgtaagctcatatggatttgttttatttaataaataaatcatgacgacgtgaagatcaactatcacaatcatatcatgtaagtatattctacacatggagtacatggacatatcaaacataattgacaaaattctccctctccagatgcatgatgtagaagttgatggtttcggagacctactctcccgaacatcggtgcagggctgcatgcagcatgctgatgagcagattgcaaatcctaaaatatttttcacatactccttttttgtgtgtagatagcgcctgtttgtgctcttgaaaagatgtgaactgttccaagcatgttggacatgtttctcgatggataaaacaagtgggattcttgtgtgtttgatctggactagttgggatggtgttctcgataaaaaaaaaacgtaacattttcatgatcaaaccacatagggttaaggaggaagtacatgatttagtggaattaatttatatccagtagaaaacatcagagtattcatgtatatttcaaacataatttgtaatcgataaatgttggaatatctcggaaaaacatgtcacaaatttaataccatgggatgctagttctgatctatgacagagcaaccaatacttagctatgtgtttgaagccttgagagtccatattgatttggcgaattttgctacgaaaatcatgatttcgcagctttacttgcaggatatgcaccgttaaagtcacgatatcttttggcaaattttgcctattgatttgtactttacatatattggctttaattgtggaccgataagccctagaaaactaacgaagcaaccatcaaatatttatgtataatatttttacatatctgttagcggtttgaatgctaatactgaaaaatagactactgtgaaaaaacaaatctactccaaaatcaacttttaaaattcgaaatttagttgtggataataaacgagtgaacgagtttgctaaaagtttattgtgtaggaaaaagaggatgtgagggatgatcaatagctagaaaattgatgaatagtagtgctgaaaaatactggtccgtaaatagggagtttatatgtaagatttcaaacatattggtgacatggacaagataggacgataagaatcgaatatatatctcataaagctgatacccttcttaaaaaaaaactcataaagctgatgcgatgtagaatcctaacggcaagaatgacataatttcatctacgaaaactcacagatgtcctaatcatacttgcaatatggctaaaaagccaataaagccgtgagagaaatttcccaagctagctacagtactagctagctttagcaaatatatatactatgatggtatgatatctcctaaaagcgtgctttatattattgatagtgaaatatgtatcacatttgttgaataacatttttataagtccttaaccaactgatcatcgaaagaattgcgtcacgctgttactacagaagcataatgacaacatatcaaacaactatcaaatgagctattaattagcatcgtgtcggcaagataaagtccctagggtacaaccaaaatgataggtccccaaagtacgaatcggatgatatgtcagtttgtttattttgtctaaccatatatccatccgcctaatgccaccggatcttttaggctctttcaaatagatgatttgaaaaaaaaaatagaacaatataaaaaaagattttagtagaaatataagtatgaatcagaggattgcaagacacataaatattcgtttgattaggttgtatgaaaaacacagaaataaaataagagaaataaactcaaagaaaattttataaaatattggagctcttgataactttcctttataaaatctttataagattgtctatttcatttaaatttgaaaggtatgataggatttaatcttttatttcaaatgtttttgtagaaaattttcttatagaattataatcctttaaattctaaaatgattaaacttaagccatatataatcacactgtacactgattttcagactttttaactggaaatttgatgatgtaaattcttcatagattcaatcatgattatcttaatctaatcacatcgataccgcgtgatgtgttttgattctttaaaaacgaaaggcgacatgtgaaagaaattatagcatcatatgttatctatatttcctaataagccaaaacgacttaagaaataaaaattaatttgtaggtaaaacttttatatatttgctcgtgccaacttaaaagtcaatgttaaaaaatacgttgaaaatatctaaaagttaactttgaaatcaagttaaaaaaatattaaaatttagcttttttttcttcgactattaggtcaaaccgatgggactctcggtggcgacgcaaaccttttgagaggtgagacgaggccctgtcacgtaaaactccaaaacctcagggtcccatctgcacaagtaccctcccatccagcaggccccaccacaaaatcctttttctttttttcattttttctgtgcttttttcttcctccttttttcacagtggcttgcatctgtcaccctcccgagctccccactcgtctccacctccccgcgatcccctcctccactcccccccgcgcgctcccatcaagaggagagagagtgagaggaggtagctctgccaccggagcggctgcggggagcggcggcagtgctcctccttccggggagatcggggtcgctggttggatccaagaaacggtagctttcgggggttggttcttgtttttgggggaatctttcggttggggagtgagttggctgatctgtgtgtgtgtgtgtgcaggggagggggatttgctggcggggaggagccgagtagggagatgagccgggggcggtcgccggagccgctggatttcttcatctggacagtcgaggtacgctcacctgtggactccctcccgtcttcttcttcttcttcttcttctttttctgattttctccaccgactaatttgtgttttggatgctgatttcgcggaaatttaggggctctctcgtcgccgcatttcagctaggtggggctttagttcgggggaattttttggtaggggattgggggggaacatttgatatgattggtctttcagtttgcagttgttcagtcagttcttagctttagtagattgcttgttcggatttgagggtggactcgtgggggccaaatttggaggtacattttttatatgctgttaattgccagactttttcgtaggcagttcataagcggttactgcggttagtataaatcttttatgtgattttgtaataaagttccctgtacttcctgcatatcttatgcttttgttcgaggtttcacttgttttgcacttgtcattcagtaaatcattgatcgtttagctttataaagcttgtgatgggttctattgtgttgatgccattgtgctggggtgcaaggaaaaccatcagaccatacaagatacatgtgtttcatgcatttgtttgcgagcttttcgttggcctagtgaatgctgttacattaagttcagttaactggggcgctcttttgctttgtattacaatcgcgaatataatatacttttttggcacaatatgggataatacatccattgtatgatactgatttgtgttgcaatgggcataaatgcaaccttttagacatctatatactgtctgactgcatatattacctcttatcttgagctagaacgcctaaacaaaggataactagtttgattgtaaatattgcagtgcaatagttcggattttatcttgttagaaattgggcctatgtgcaattcagttcaagccctgctaaatttgtagcaacctgaacctccaacatagcccctgctaagacaaagtttgattaaggactaacctagaaggctagcccaagtttaattcatgatgaggagcagcccagaccagattttaactcttgtcgaactcaagatatgtttagtattacttggttgagtattgctctgttggctgaaattgcgctcaactttaaacaagagagagatttacaagcagctaactcatgtggtgagctggttctccataaatatctttgtcactaaccatctaaagtattaatccctctgttcctaaatattagcatttcaagtttgtttagcaaatactaaggttgaggtaaaagattccctttcagtcacatcagtgtcagatttgaattgcttggattacctttctaagcacctgattggttgaaaaatggctagattcccatgcattggaatcagtatcctagaaatgcttatatcgtgtacaataattgaaacttagagatgcttatatttgggaacggagggagtattatttatcatttaaagttgaggacagctgtgctcaatcatgaacaatgtatcttcacatgcatatgtaggtacatgcactgtacagcctatccaaagttttccaagattcatccaaatgcattataataaataaaagacgggctgattggtttgaattgaaatggatctgtttcgaggcacattgacggtggtgaataatacttgaattttcatgtgcatcaattgaaatgttcctttcattacaatggaatacttcctccgtttcatattataagactttctagcattgcctacattcatatatatgttaatgaatctagacatatatgtgtgcctagattcattaacatctatatgaatgtgggcaatgctagaaagtcttataacctgaaacggaggtagtacaacttttcataagggttgcatgtgttatctaacacaagcaggtttagcataatgtttaaaccatatctaccatgccttttaattttcatgtgcctatgctttctcttttcgctctttgttctttttgtcattcatatctatgtgggttttggttcctgtaaaattgaaaagggcatcttagtttcatttaatcattttaaggatctcatcacgcggtgatatttactctgaaatagtgttttcatttgatccttatgttttggcaatctgtttttgttctaactgactaacttgatatttacctattcgcagttttgaacatatagcagttagtgtcatgtgcatgatcgaaagggcatgttacctcaaggtgcttaatatttacctaagattatcaattctctttcaggatgttggattatggcttgaagagataaaccttggcagctacaggcaagtttttgaggaaaacggtgtcaatggagagtatcttgaaagcctgtcgatgtttactacagaacagattctgcggtttatcaggaggtgccatatgaaatggggagatttcattacattgtgcaaagagttgaggcgcatcaaaggtttgtatatttctgtgccttagcctttagtacgaaggaataaccataacacatttctactactctaaaagcattttgctgctacatattttaccttttgtttctcatttgattttatgatgtgccaagcagtcgtcataatcaaattctcttttcctttcactaatgccatgctttatgtcaaattcgaaaccaatcaaaatactagttgattgaagtggttgaaggtcactgttttaacttttacccctcaaaagtttttgatggtgctatgcaaattgattccttttattttgttttgatgtaaatatgaagcacaaatagataaaaaaccatgatccaattatcaacatatattgcattattcaaaagtcaactttgactaagcatcaatattacctcaaaacatgctgtgtgcctggttaattatgaatacatatcttcggaatgttggctgaatggatgattatgccgaatagtattattgtgcaagcactttaggaataatggggatgaggatactagcaaaaggtgattgtgattggatctggtccgcgtcaatagtactttgaattatgctgcatgttttgctaattatgaatggatatctttggaatgttggttgattatgtcgaacaacatcgttgcacaagcacttggggataattgggatactggcaaattagcaaaaggtgattgtgattggatctggtcccatccttaccatcacttcgatctacttttggattctagcatggcactgatgggtattgtagaccaatatgtaagactgaatctagaaatacacccttgttacaccattgaacttgtctgatggattaatgaacttgccatacaagtctgcaaactttcggcattctttgaagagttctttctttctcttttggttcttgtagacagtttaagatgccatgattgcacacagatattgatatgtacttctaactgctcaattggttggtgttttggcactgaatgtttatttacctgacgcctgcaaaatctaatctccagtggcctgcctgaaaggggagcaagaagtccgcaggccatggtgggcgccgtcatgcctatcggtggtgttcgtgagggcggccaagcggaaccggcagtcccgagtcgtctccctgaagctggagccctagtacccatccaccgcctcaaatctttgcgcattcgccgttctaccccgccttccagctcctcttggtggaggcggcactgcaaccgcacaccgttggtgtgctagttcccagtgatatgaaaggtcttttgctgtgaagagcagaagtatgctgctctactatgttcaaccggtcctcttatccttttttttcttgatctgttttaatcatgatatatagggtttggaatagtaaccttggtgtagacaaacaagatacatatattgtgcagatggttccccttaaaagtttctgctgcttgcaagtcagtctgagcttgttctagtaggtatttttatcttgtgaaagattgatccccctagagatcttgatcaatctgcagaaaatgcagatgttttatttggtgttggtaaaaaaaaaaacactactacttccaacatttcttttatttgatgacattgtagaattagaatctgtctggtcaatcactcaaaaactttgcatcattgatacttttcaatttacatgaacaagggagaaccgcatcactaaaacttccattaggaatacttctgtaaaatttatcatttgtataaattttactgatgtctttgttatgaaaaagatatccctggtggttatatgtatctagacctggcccttgggcgtgtacattgtatctgtacaatgtagcaggagtacacgtgtatccagaaccttctgccgtatccaagcaagaggtgtgcagtgactgacaggtgggccgcattaaaagcaggcccacttgtcagccgtaatcctcctcttgctagccttctggattctggaaccttctcccacggggtggaccccacatgtcatcgtctcaaaacagttacgctggactttaccgcaggtgcacctagcatctccgcgacgagccaatccagaaccttctccccccaaaaaccctcggccactcgtccgccctctcactgacagtggggcccacgcggtggggccacaaggtcagtgacccgtagtaaccccccatcttcttgctccgcaaggcgcacgccatttatacgcctccgtcctccgtcgcgccgcccccacaaaaaccctaccgccgcccccaaaaccctcgcctcgccgtcgccgccgccgccgccgttgctgtctcccctcggcgaatccacggtagctctcccgctccccctcctcggtggtaggagtagcggaggagatgctcggggcctcgaggcgttccgtctgcaccgccgcggcggcggcggcggccgggtcacgccgccgcgccgccgccggcgtcgcctccgccgtttccggggattcctccgtctcgtcttcctcggcgcccccacgctcggtacgtgccatctccggccttgactttctctacggctgcggctgtttcgggctggttgcgggttcagagggaaaatgtgggggctggtcgtgatcgcaaattagcggaaattgagtggtgcttaatctgtatagtactcttgttcgcccattacgtggtatcaatttgagttaattttgcggtgtgtgttaattcaagctaattcgttggtttaagttcatcttgttgattgtgatatttaatagtcgattgggggaatcattagatttttactgtctgattgattgtttgaattgagtcgagcctttgagcttctgtatgtgatactcacaacccacatgtatcgtccgattctcaggtgattaatggggagcctggtgtccctcagcttcagaagaggttgctctctgtgcttgctgcgcccaagcttaccgggaccgacaatgctgcctccctcaagctgagggagggttcccttgttggcaggcgatatgaatcgagtgctgcagcagttgattcttctgatacgccacctgtggagaagcatgagtaccaggcagaggtaactactggagcaatggctaatgttttatttttcttaatcaatctcgtgttaccaacggtgtcatgatattgtccaatgtgcatggcaggtcaataggctcatggacttgattgttcacagcttgtatagcaacaaggaggtgtttcttcgagagcttgtcaggtgggtgtcattcaagaacataagttgttcactaattgaagtttgtactaatcatcatcttggtttactcttgtgcgtttagtttgatctctatggtttaattttttttaatttcttcatcgtgtatctgtttgcagcaatgcaagtgatgcacttgataagttgcggtatcttagtgtcactgatcctgatcttataaaggatggtgctggtcttgacattcgcatccaaacagataaggagaatggaataataccaatcacgtaagtattagttacttgatcaattatgtggctcctttcttgcaaactcatgcctgcatttgctcctttttatctttagtgatactgggattggtatgacgaggcaagaacttgttgattctcttggaactatagcgagcagtggaactgccaaattccttaaggcactaaaggtgtgttccatttgcactttgctgatgttaccttcatgtccttatttttctttgtttcttatcctgtcatattactaatcttaagtattattatataataggagagccaagaggctggtgttgacagcaacttgattggtcaatttggtgttggattctattctgcgtttcttgtttctgataaggtaagatgctatcgtgattgtctttaattagaaggttaatagctggctgttaatgacctagtgtttatttcccattgtccttggctgacatgttaatatttcatgaatattatttattttgtctaataggttgcagtgtcaactaagagcccaaaatctgacaagcaatatgtttgggaaggcgaggcagaatctagttcttacaccattagagaggagacagacccagagaagctccttcctaggggaactcgccttactctgtaccttaaggtctatttgcttattttgatatcatccaactcattttatacatgacctgtttctaactacaattcttggtattgtttcagcgtgaggacaagggtttcgcacaccctgagaagattcagaaacttgtgaagaattactcacagtttgtttccttccctatttatacttggcaagagaaaggttacacaaaagaggtgaatgctcttcctttgttaattattttttattggaccaatgcatcaatttaattgtggcatattttgctcttttaggttgaggtcgatgaacctgttaaagctaaagaaggcgacgatgagactaacacagaggtaactgtgatatgcttttctgccaagataaatctgttatacttaatacttgtgcataattgtattaccatgatattaacaggttaagaaaaagacaaaaacagttgttgagaagtactgggattgggagcttacaaatgaaacacaacctatatgggtgagatttgatctgttcagtgtgctaatatgtttttattaatgaatgcacccatcacttattgaaaatatgaaggttccaaaaaaaaactgaagctttttttttcattctctgtttatgggagcttcggaaccctagagaggtatcaactgaggagtacaatgagttttacaagaagacattcaatgagtacatggatcccttagcatcctcacactttactacagaggtatgtctgattgcatttgattagttatcagttgattctttctttttgtcaattgaaccagaatcaaggttgatataggtagcagtgcagttattttgatgatatgttcattgtgcatgactattctatgaagacaagttttttttcatgcttatacatttgacaaatttaaccaaacttgcgatatcacagtattctgtaactgctgtgaccaaattaatatcttcatactattctttcacaaagagtcaaagacacacgagtgctattcatcaggcaaacatatttatatacaggaacagataatagttcatccttcgttaacactaactcagctggtaaagttatgtaatacatgtctattgctgcatatgcgactcttcatttcaattatggtggttctattcaaatatttttttggatatccacaagcatgcgaatgtttggttttgtaacattgtattgcattattcagtgaaaatgatattgtgatcagtgcggcaaagatgccaaactggttcatctttttggttagaattgcaccgatctccatgtgatagttcatttatcttcatggattggcaccaatatagcacatctgtctatctcacggtaaaactgtgcctgattgcacttcacaggctcacttggctgtgtttgattttattcatgcagggggaagtagaattcagatctattctctatgtgcctgctacaaagaaggaggatataactgataggaagaccaaaaatatcaggctttatgttaagcgcgtgtttatatcagacgactttgatggggaactggtatgcttaatacacagcagctcttcatgattctttgtcaagttttagataaccatggaaatctgacaataaaaaaatgttattgatcagttcccaagatacctgagctttgtgaggggtgttgttgactcaaatgaccttccattaaatgtttctcgtgagatcctgcaagaaagccgaattgtaagtgttaatgaatggttttctgtctatgtcttgtacatttctatcatgatcttctaacattgatttatctttcctttttttttccttcttgtttgttacaggtgcgtataatgagaaagaggttggtgcgaaaggcctttgatatgatacttggcatctcttgtagcgaaaacagagatgtaagttgtttactttccttttgtgcatgatgcctctgttctctcccttatccttcagtagttcagttctcacctgaaatttactgtaggactatgaaaggttctgggaaaactatggcaagttcttaaagctgggttgcatggaagacaaggaaaatcacaagagaattgctcctttgctccgattcttttcttctcaaagcaatgaagaattaattagcttggatgaatacgtggaaaatatgaaacctgagcaaaaggacatttactacattgctgcggacagtttgagtagtgcaaaacatgctcctttcctggagaagctcaatgaaaaagagtacgaggtatgtactgtgaatagcttaccatgtttgcagacacatgatcatatttcttaattatattttgctattggattctgggctttattgaatgcattcattgcccatgcaaactttgccctgaaaggcaaatatagtttactggccttcagggcctgttgaatttcatagttgagatgccttatattttcccaaatattggaacaaacatgcttgtttttgctactatctcactgacatctagccatctagaaggcttaagccggagaacccaatggcaaaaacagtgttgcagtactgctgaatggcaaaaacaaagtttctgtatttgtttacatgtcttactgattaatgcttttacccagaaatgagttgattcacttcatcacttgtttcctttttgtgacggttctaacttgtgtatattttgtaggttctatttttagtgacccaatggatgaagtgtctgtcacaaatctgaacttcctacaaaaggggggggggaatagcgttcgtgatttagcaggaagactggactttgtatgcatacacaatctttgaaacctncttctactgctgaatgagatgagtttgaaaatagttgttgtgctcgcatgagaattatattgtccttcattatggcaagacttgtttatatttcacccttttaatataatgaatagagccctgtatgtcttgtttggatggtgggggtaggcaatgtcttaaccttgcagaattgggacaattacctcatttcagtcgtgtaaatcttttttcctgatttctgattttcatctataatgtaacttaggtgataagaatgaggaaaaagagaaggagatcaagcaggaatacagccaaacatgtgactggatcaagaaacgcttgggtgaaaaggttgctcgagttgatatatcaaaccgtctcagctcatcaccatgtgttctagttgcagctaagtttggttggtctgcgaacatggaaaggttagtctctatcatgttgacctttctagcacataattcttgtaacttaaagttcttaatagtattgttgtgttaacaggttgatgagagcgcaatctatgggtgacatgtcatctctggatttcatgcgttctaggaaagtttttgaaatcaacccatagcatgagatcatcaagggcttgaatgtaagtgttcggtctgctgtttgcacttcgcgcttgtaatttcctgatagtccttatgggttcctttttcctcctcaatgcaggctgcctgcagagccaaccctgatgacccagaagctctaaaggctgtagatatcctgtttgaaacttctatgatctctagtggctttacagtaagtacacctgattgccttcttttccatcaaataaccctggtccatttgatatgataggatattccgccttaccgttgtgcatgttttctatactgaatgtcgtaatctgtttaaatttcatcaatttgtgtcatctcatttgtggtatcatattgcagcctgacaaccctgccgagctaagtgggaagatatatgagatgatgagcacagctatggccagcaagtgggcctcgcacgctcaacccgctgagatgaacctgcagcgagactcacctgtcagctctgagccgattgaagccgaggtgattgagccggagttggtggacgatagccagaagaaataagggaatcgtcgagttttccctcaagttctataaaccttaggttctttttcggatccatttcatacgattatgccgtcctcccagaatattgtagcttaattttgttgccgaaacgctgagatttttttttttcagtttggttgagcggccagtgcaatgagctgtgtgttaaaccaataggattgtgttatgttaggaataatggtttctttgctaggaacaattactttgaaacaatcctttgctctccaatttttccattgctcacttatctcctgcgcaagtaaaacatgatcaagtattagtataaaattcaagcaatattcgtcctgctctaaatttcttattggtatatattgcttgaatttctattaagtaatgcaaggaatcgcctcttaaaatgatttatggtcagatttgttttttctctactttgtctcttagtgtattgtcatattgctcttctagcattgacattggtcatcaaagaaagacacttgtagactgtagtaaagatattccaatccagtatgtactgtccattttaaacgtagtcattagacttttgatcgttttgttttttttttctaactttgatcatttgtcttatttgaaatttgtttatgattagtatttttattaaaattaaatgataaaacatgaatagcactttagcgtgacttatttttattttttaaaaaaatttcaaatattagtatttttattaaaattaaataataaaatataaatataaatagtactttaagcgtgacttatatttttctttaattctaaaaaaatttaaataagacgggaaattaaaattggatatgaaaacttatggccgagcttaaaatgaaacggagggagtatctgcataggacctatagatgttctacagatgtttattgtcatataaccagcaaaacattcattaaattgagtgatcatctacattcatcatgtattaaaaaacatctttatttaagaagccaaactcacctgagttggcctggtttgataggcttgctcaatttgttgcccaaatcaaccgtatcaaaataattttagtgcgatgtttctcttgatataaatacaagtctatagtcttagaagacaatagtcagaaaaagaaaaagacagtcgccccaagtgtctacgactggtcctgctattaaaacagaacaagcacaaaacatccctaaaaaatggtcttctaagcgatgcctccaaggaggaaatgacgctagcgcgccgccaaggggagaatcaggatgtggttttcacctaaagaaaccaatgagagataagagaaaatgtggcaatgccccaaggggaaagtggcgcctcatctgtgacggcctatagtttaggcccgattgagatgagagtcatccgtgacgggctataatttaggtccgattgaggtgaaagtcatccgtgacggcctatagtttaggcccgttagagatgagagtcatccgtgacgagctatagtgttggcccgattgagatgtgtgtcatctgtgacggccggatgcccgattgagatattttaccatattagtgacctttgctctgtgacgtgggccctacccgatagagatgaggcttgtcgcccgttacagatgaccgaacccatgctagtggctcaatctttctctaaacttgaaattgtaccggcgtgaacgtagccgccaactcccgcgccaatggttacatatccgtttcagcagaaaccactagctaatcccctttaatgcacagctaccgcgtcgacgcctcattgctggccagccttcagggtaggatctcaacctccggcgcactccaattcgatccacatagttgggttggagagggatagggtgtgagagaagtagggctggatgtcgagctggctcggctcggctcggcttggtctggctcgttaggataacgagctagctcggcttggctcgttatcctaacgagctagaaacccagctcggctcagctcgtttgaaagctcgagccagctcgttaggctcgtgagctttgggggcagccgacgaccatggaggcacggaagcaactcaacctcgccggcaccttgatagcttgccggcgaccacggggaggagcttgacggcagaggaaacgagcttgagctcgccgacgaccacgtggaggagcttgacagcggaggaaacgagcttgagctcgccggcgaccacagggaggaacttggtggcagaggggatgagctcgagctcgccggcgaccacggggaggaacttggcggtggagggacgagctcgagctcgccggcgaccacggggaggagggcgatggaggagacgagctcgagcttgccggcggcgttaggcacagggggagggacggagagcggcggcggcgcgtgggacgagctcgagctcgagctcgccgatggagtcaggcgtgggggcaaggagaggcgaagagcggcgggccgacggcgtcgggcgctggggttgggtagcggcatcggtcactggggtggaggcccagagcggtggtgctggggtgggggagacgaggagctcagccgccaccaccagggaagggggaagggaagctagggttttggtttttggtctattgggccttctaaataaatgggcctatgggctttgtggcctagcagcctggctcgttaaggctcacgagcagctcgcgagccagctcgagctggctcgttatctctaacgagctaaacttccagctcggctcgttaggaaaatcaaacgagccgagcttgtcacgagccgagcgagctaacgagccacgagcttctcgtgaacccctagagagaagaatggatcccctctcccccgcattcactcgtccaacgtgtccatcttgttgcggcaagctgccgccgcaaaaggactgactcctgaaaataagcttgtcgcagccttcaaagcctacatcatggcgctaccgtcgttgccgcctcaaccaggctgtccgtgttcgaacgggctgcctggccgtgtcgccgtcgccttcgtccttccaccgcgacagcctcctcaccgctgtgccctcccaccatggcaggctcgccggcataccgtttccacgccgtgctcacctgcctcccgccgtcgagatcacccacgcctgctgtcgctcgccacgactcctccctctggccgactactgccgtcgcccacaccggcctcttgccgctagttgtgctggccggctgctgccatcacctatgtagacccctgccaccaaccgtgctagccaccacagccatcgcccgttcttcccgccggcctatcgtattaccgaaatttgatagtgttggttttgtttggacttatgcttttatcaatttttgatagagttttaagattgaacttttagaaatagaaaaatttaataaggtagcaatgattaaagtgtgtttagtttgttgtctgactaaaacttggtaaggttaaaagtatcaacaaactaaggttaaaatgtgtttgatgtttgggttctatattgccacgctcgagatttgattcaaacacgcggttaatccacattattttcaaacggaccattcgaacatcggattatcgtacgagcaatgaaaaaaaaatttcaagccctttgcagaattctcaaaaaaaaaaaaccctttgcagaaaaaaaagaaaaagaaaaacccatccaatccaacgaacagtagtacatcctcggagacggagtcgtgacggtcaaatctgcaaaagcgaaagccgcccactgcaacaagtccgcaaccaccaatgccccacccgtgggcccagccatccatccattccgcgttttccccgcccaccggtcaaaccggtcaccctccccactacagccggtcaccccactctcccccacttgataataataattactccgtaattaaataatttcgttttggagctcgacctggactccattactcgcagaaaagtcaaatccaatcaaatcaaaatccaacccaactgcgccgaggaggacggaccaactccggctactccccgccgccgccgccgccgccgccgtcggcaggaggaggaggagctaggtcgccgccccgccccacatcgaggtgagcttcttctgccaaagctctctccgacgaggtctccgcccgacggatggggttggaatggatccggctcgtcggcgagcgagcgagcgagattcgtgattcgatgagcgattgatgccgcctacttttgcaggattagggtttgctttgtgtttgcccgacgcgaggaggatggggacctcatcgggagccaacttccaccagcagcaaccgcccccgccgacgtcctccgccgcggccgcggcaggagcagcggcggtggcgcaggggatgctgccgccgcggaggcccacggggctgcagacctcgctgtcgctagcctcctcggagcaggtcggctcgccggagatgcaggagccgggttcgaattccgaccaggggcacgactccgccaccgagagcgctagctccagggagacgtggcccgccgagcccaaccacggtagtgcggccgccgtcgtggccgcctccaccgccgctagcggcggcggtggtgttgttggtggaattggtgttggtgtgaggatcgtggacaaggagaaggaggtggggaatggtatccccaagctgcaggtgatccgcgggtcatcccgccttgatcggatgtcgctgcgggaggttgcccgggagagggtcgatctagttgctgagaaaatgaaggtgatgccggaggagcacttggaggacatgaagaacgagctcaggtcgattctggagggcacgggtggttctcaccatatcgaggagttcctgtatctccagaagtttgtgcagagtaggggcgatctcacccagaccatgctctcgatggcgcatcatgtgcagctcgagatcctcgtcgcgatcaagactggaatccaggcgttcttgcaccccagcgttaccattcctcagaaccgcctggtggaggtcttcttgtacaagaggtgccggaacatcgcttgccagagtgccctccctgcggaggagtgtagatgcaatgtttgttctaacaggaatgggttctgtaacctctgcatgtgtgtgatctgcaacaagtttgatttcgaggtcaacacatgccgctggattgggtgtgatttctgctctcactggactcacacggactgcgcgattcgtgatggccagattgggatgggtcaatccattaagagtggtactggtcatgctgaaatgctttttaggtgccaggcttgccagaaaacatcggagctgttaggttgggttaaggatgtcttccaacaatgtgctcctggttgggacagggatgctttgttacgtgagcttgagtttgtctgcaagatattccgtttaagtgaagactcaaaagggaggaagttgttcaggaaatgtgcagatctgattgaaaggttacggaatagccccgcggatgctatcaatcctcggatgatactgcaggtgctccaaggtatgaatattatccttaactgagacttgcattagcacttgatttgctggtatcctattagcatgtatctgcttcttcatttactaaattctccatataagccttcttaattctgtatattgattagtggtactgtacacatgtattattgtaggcttctattaccaccctcttaattcagttgaaagcttatacattcctgtgatataggtggtcagcaaaatgtatttagctattcaaattatacagcaatatgtgtccacccttgtttgcagatctattgctctacattacaagagcatgtattctgagggtctgattgttatttgcttcctgattttgttttcacacttacatgtgcttgtttatcaaaataaactaccttggtctggttattgttgctaccttgctggggctaatttcttataatcttatttgtgtcttttgtgtgattaatccctttgtaaacgattcagaacaacgtattcatatgtatgctagcactcagaatgagtgttgacaccatgtaggctggcctagttctatttaatattattttcccctcgagcctgttatggccatgactcacgaaattgtttactgcaaatatccaggcaaacagcccactgtaaaatcctgaactatgttctgtattgtttagaatgcacgtatgcttcagatttgtgtctgtactaagtcaacctgcactccaagttgattgtaaagctatttattatgccattgatgtggggctggaatttggagcacatttatcttgtggttgaatgatgacagaaagaactagttgttgcatttagaattcttcaagttcattgccatgggatgttgggaaactgtgggtattagttgcttgttgaactcctatgtgaaatgcgtgttttggccaagcactttatggatcaatacatgccttttgctcttgctccacacctagaatcctatattgcacagttcttgttacttggtattctaaatttttatgtgcatcactgattttggtttcttagatttgattcattaacactgaactatgcttacgttttgacagagctcgagttggattcccccaagagcacagaaaatgaagaaatagggcgcttgatcactcctcaggaggcctgtaatcgtattgcagaggttgtccatgaagccgttaaaaagatggagcttgttgctgaagagaaaatgcgactctacaaaaaggctcgcattgctgtggaggcctgtgaccgggagcttgacgagaaggccagagagcttcaggagctgaaggccgagaggctgcgcaagaagcagcaggtggatgagctagagagcattgtccggttgaagcaggccgaggccgagatgttccagctgaaggcaaacgaggcccgtcaggaggctgacaggctccagagcatcgcgcttgccaaatctgagagggccgagcaggactacgccagcctatacctgaagcgccgcctggaggaagctgaagcagagaagcagttcctcttcgagaaaataaagtaccaggagacccagaggcccatgcaggcgagcggcagcggcgccggcgattcatcgcagacgcccatgctctccaagattcacgacctcctcaagaacgtccgcagcataccgccgaagacggaggggcatcaatgaaaacaaagagcagcagagctgcatacgattcaggttggtgaatcttaggtgtccttgtgctgatgtactcctacgctgatttccttcggtgtaaattgttagcaaaagtcgttgtaacaatattattggagctaacggtgtgctatcgtaggatccaatatatacttagcttcggtgtttgcagttgagcatggatgagaaatagctgaagcaccctgtactctgtaatagccaaaaaaagaacttctatcatgtatgaccatttctgacattgttagatcgaataatttgtataatttgtgttgtaacttctgtacgtaaccctgtcatttactatttggttaaatgtgaaattgtgaatcttcatgaggagacatacttctggaaaagcctgcgtgatccaagagaagtgtcagtctgtaccacactgcactggcaacttccatggctgggctgtgtttagttcacactaaagtttggttgaaattggtacgatgtgatagaaaagttatgtgtgtatgaaagatttgatgcgatggaaagttggaagtttaaaaaaaaactttggaactaaacagggcatggtccttagggggtgtttgggaactagggactaaactttagtccctctcacaaaagcataagtcagggactaaagtttagcctctctctcccaaacactctcttaaatggctggtacaaggagagtagcatccaccatacatacaatcctggaaatgtgaatgaagctaaacttgtgagatttgtctcttcttcttggtgggcatgaatgtgatcatgtgatgatgacccacatggcttttgtgcaaatgtgaaacctagaattgtgttctgcccccatattcctacccttgtgacacctaatattccactatctcagccatgctcctctgcctctcattactccctttttgacaacactcaccagttttctgctgatgattgatagtatattgacaagttctatattgttttgaaattcagggactgaaattgatcttttttaggggacaaattgaaaacaaacaaattcagggactgaaattgatttttttttcaagagttaacaaaacaaatggaaccatatcaacagatcaaatatagatttgccattctacaaattaatcagctgtttctggatgaatcattttgtggcacatgtcaagcaagcactactagatctatgcgtcatttccactttggcatgcccaaaatttttctgatgtatacggacatacatttgaaatattaaatgtagtataataacaaaacaaattacataatccactggtaaactgcgaagtgaatttattaagactaattaatctatcattagcaaatatttactgtagcattatattatcaaatcatgacgtaattaggctcaaaagattcatctcgcaatttacatgtaaattatgcaattgatttttttcgtccatatttaatattttatacatgtatccaaatatttgatgtgacggaatttttagaagtttaaaggtgactaaacacagccagtccaaagatgtagggcatatggcaatgacacgtcgcccacgcatcaatgtgacattaatcacattatcgccttgttttgagcgtgccctagtgctcctactcctattgccctttcaatctctcttctgcaaacgcacgcattcgctagctgcatttaacacaaacctaggagagttagtagctcaaagctagcatcatgcagtgcagggcacgtcttggcaaagcatgcgagcacgcgacacctcttactcgtgagtaaatttactctttttttttgcgaaattcaatgtgatgacacgttggatcagccattaaattctaatcataatcgcaggatcagcgcgaaatctgaaggcgacatgatcgcacgaaggttctcgtgcaggggatttcctgtgcacctgtttcagttgcttactttagaagataaatttcggccgaatagggcttcggtaaatcgacattggatgcaatttttaacttgtttttgccttttgaggtttatgttcttgttaatttgtccttgatgaggcactattttttttctataataaattattcaccggattattttctatgcttcgaaaactacgttctcttaaaaaactttcttctactttattgctattagatcacttgacttgagctatttatttagtttatttcttataaattatataacattcctataatcaagcagataatttatgcaacaatacaatcaaaaatctaaatcaaacaaaggcagcatttcttatatgtcgatgcgattgataaaaaccctactcttatactacattcgttccaaaataatttcatttttagaacgaaggaagtaccttttattattttatttttttgaaaataaggttttatgtttcgagtactaggcactaataataagcatgctgcttgtagttaaaattcatgcaacttgaatagcaaatccagacatctaaaaaaagctattccttctagagataaagcataatatacaaacatatgtggcctcatcctttcgcttatatttatacctatcagctaaaaattaaattttcaaccttaagcttgaagctgattttaggttttttcatcaaagtataaaaattttatttacaaattacttttcgtttgcaaatatatcgttttacttattccacgaaaaaaccaagctatggggccagatgtagtttgttgggagggccatggtgtgaagccattttccaccaaattaaagctggtcttggcgtgcacctgtaaaatatactattgctcacttgttgggaaagaacactttctagtgatgatggcaataataactagatgaattaaaaaaaaagaggatgcaagaaagctacaggcactgcccacagatcccacattcccactactgcatgcttagttgattactctctccattccattttaagtttttatatacaacgtttaaccgtcttatttaaaaaaattataaaataattaaaaataagacacgtctaaaataatatttatattttattatctaataaaaatactaatcataattttttaaataaaataaatggttaaacattgaacacaaaaatttatggctgtaattaaaaatgataaaatggaggggggggggagtactattttttccactataaaatggcccatcgatggcgccatcttatcgctcatgtcgacgacaacgcaactgaacaacctcgccggtgagcagctaaagctaagctgaggttagccatggcggcggcgatggggttggagaggaaggcgaaggtggcggaggtggcgctgcggtgcgcggtgtgcgccctggcggcgctggcggcggcgctggtgggcacgggaagccagacgaggaccttcttctcgctggagaagaaggccaggttcacggacatgaaggcactcgtcctcctcgtcgccgcccacggccccgccgccgtgtacagcctgctccagctggcgcggtgcgccgcggccgcggcgtggaaaggcggcaccaatgccggcccgccggtggtggcgtggtcggtgttctcgtgcgaccaggcggtggcgtacgcgctgatgccggcgacggcggcggcgctgcagtcgtcggtggtgggaaagcgcgggcagccggagctgcagtggatgcctgtctgcggcctctacggagcgttctgccgccgcgtcggggagggcctcgccgctctccgtagccgcgggcctcgccgccgtgctcctcgccgccgtctccgcgttcaacctgttccgcctctacggcggcggcggcggcggccgcaagagcagcgccggcgccgtctccggcaatggcgcgaacacgtggtaagcaaggctagtttagctgcttcgatggagtttaatttctttgtagtttcagaattaaattaagcgagactggctcactgacacgtaattaagttcgttaaatcgttggtaataactgttatgggcttatggctgtggatgataataattaagtcagatttgccgacgaccaaatcgcctgtttaatactccctccctccatcctaaatataaataattttggttggacgtgacatatcctattacaataaatctagacatgaaagctgtccagattcactgtactgaaaagtatcatatctaaccaaaattttttatatggagtactggttaatgacgtattaaggttggtgtctttttttttaaaagactattaaggttggtgtcggcgtgaatcaatcgatggacaccgtgtgagtgcggcaggcacgtccgcatgcgtgagtccactcaaatcgccttctgttaatgggtctcaaatctggtaccacttcacgtatacttcctccgtccaaaaaaaaaaagacaaaccttgatttccgtgtccaacgtttgaccatctgtcttattttaaaaaaatatgaaaaaaattaaaaagataagtcacgcataaagtattaatcatgttttatcatctaacaacaatgaaaatactaattataaaaaaattttatataacacagacagttaaacgttggcacgtaaacccaacgttttgactttttttggacacaaggagtagctcctaatctaatatactcaaaatttaacaaatgtttatatttgagtatgtaactttcgcatactacaacaaatagttatatttcaagaaaaacctatagatcctcaccatcacggtaaattaagaaagacacttagggcaaccacaatgtatgaaaaaggtgaccttaaggcaatgattgcacttgtaaagtgagccatatacattgtggaaagtagcattagcttaggatgcagcttatgcttaagttctcccataagcaaaaagaaaatattttctctctcattcacttcatgaacaagagatgaaacaattatttttccattctatgtgggccatcttgtggctaaattctaaccatagcattatgggtatggctataacaatggctcactattcataaggcccaccttaaggttacactacaccacaaacattgaggatgcccttgtagatagtggtggacctagaaaactttccaagcacaggaaaactcaaatatacctaatatttgctataatatttttaactttaattctttcaaataaaataaaattttaacagtgtatttgacagtgagcccggatggtggatggtggctccacgctgcttatagagcaaaccaatgtagatggacgaagcactaaactacggcaaaggtagagaaaaaggaccattcgagtagctaattaattatatgttggatcgtagtaagatattttcatgtaataccatggtctctacatgtttagtaggtttagagatcaattagtttttaaaagacgagatgtactataattgcacttgaacttaagtctgtcggttagaccatgtggccaatgccgatcagattgtagaccgcccatttgtgacctggtcggatttttaggttgttgatcaaaccgcccctacatggatagctatactggcctcactacagaagctctaacattattttttttaaaaaaaatggcttaatcttaccatgggctattttgaattgatgacaaaatatgtcctactattgatagcttgaatagtaatattggctattcgatttgaagccaaataattagtaatgcctaaaatcaatttgacttcacattggtagtaatcctctgccaatccaaacattcgtactacaactctatcctacttaaaagaaatgaaatgatagtacataccaatacttatcaagaatttgatactatcaaatatttagtatgttaacgaaccaaacccaccctataacttcatcccaatgccaacttgtcctcctgcatttttagcaaacttgaaagctaaaacactcgtaaatttaagagcgatggaccgttactggccatgtaaaaactgttactctattcgtcacaaaatataacaattttaaactacaaagttgtcttaagctataacaatttctcaagcaaatgagggaaaaaagtacatcgaaggtccctcaacttgtcatcgagttacaaaatcgtccccgaaacacaaaaccagatatccggcatctctcaactaatcaaaaccggtaacattaggcccttcgatggttttgaccccggttttgtccgacgtggcggttgagtcagcgtgggacccacgtgggccccatgtgtcagtataccacgtcatcatctctctctctcccccttctctccggctctcccttctcctcctctctctctctcactcttcttttctctgggcgagctggatggcagctgggaggaggccgccggggcgaggcatgaggcggcggttggcggctgcgacgtgggagaaggccgtcgagcagggagcagcagaggccgagcacattggcgcacacgcgcagctttagcgcgtcgcgtgggctcgacgacgacccggtgctgggtgtcggcgtcggcctcagcgggcagttggagccacaggcgctcgccaccacggccacggtgaggaggctcaccgccagaacaagcaccaccagaacaagcaccgccttcgccgccattgctatcgatcgagctttgctaggctgctagcttgtacttgtagctagctcgagcttgccgctgctactgctgcttgctgtgtgctgggcctgggagtgtgcatggcaaggtgtattgtgtatttatagtggccatggagaagaagatgagaggaagcgacggcgcgggagcaccagaccaggagggcctcccttcacgccgccccaccgccaccgccactgccaccgcaaccggcaggtggggaggaggccgacggggcgaagcggggaggctggcgattctgcaaagtcgcggatgatgccgccgtgatgaggtgctcctcatctctgacagcaacggggagctcgcccatgccatgggagtcgatctcgacctctccgacaagcccgccgggctcgacgtccggtctcaccgctacacgttcctggcaaaggacgacgcccgctgggtctagccgacggccgccactgccaacgccaagctcctctccgtcggccgctgcttctctccccactcgtcttcgccagctagcgtcgccgccgccaacgagggacaatgccgccaggtttaggaggacgtgcgggcgaccgctggagtcgcctcccgtcgagcagagcggaaagcgagatgacgcaaggcgagggcgaggaagaggccgtcgctggtggcgccgccgccgcgtccgtctccacctttgttcctctcccctccaattgttagcccagccccactccttccccgccgcccgtcgcaccggccctcctctccgctgcgctcccccccgccggccgccagacgcccccgccgcatgcgctgggccagggcctcctcccatgccggccgccggccgtgcccgtcgcgctggccctcctcccctgttggccgccggacgcacccgccgcacccgccccaccgtaccttcctcttcggccagccgccggcactcctcccctaccggccgtgatcctgcagaggagaagtgagagagagagagagaaagtgaggaagggagaggagggggaagagagagtgtgtttacatggcgtcctaacatgtggggcccacgtgggtcccgcattgactcagccgccgcgtaggatataaccggggtaaaaaaaaaaaccactaagagacttaaaatgaacggttttgtgagttgagggacgtcagatacttagatacttggttttgtggttcggggatgattttgtaactcgatgagaagttgagcgaccttgtactttttccagcaaaggaggtagtaccgtcgcaggcgggaggcggcatgccaaatttgggccggctcaagaggttgcgtcacggcccagtacatcaaggcccatccaaggaaacttctagaacgtttgccttctacgtcacgcccccgccacccccatccccggtcggtcgcgtgcacgcctacctatcctatggaccccgcccaccgcaccaccacccaccccacgaatctcgaggcataacgggtggttcacatcgctccggactatggaccaggtccagccatatcccaccctcccccggggaaacagtccagactcccacaaagaacggttcgattttgtataaaacccctcgcaattttttttctcccccacaaaactcccgcatcgccccacactgctcctgctgcctctctctctctcccctccggcttctccgccgccgcgaacgcctctcgactccggcgagttcatcaccggcgttcacgaggatggtgagtttggttaggggggcagagccccttctcaggcctgaaatgtttttaccctcggattgtttaggatttcgcgattcaattcgcgctattttttttttagttttagttttattatttcgtgtgatctgagaggctgagatgtgtggatgcgtatgtgtggttccggggtggagcgattttggtcgatccgtggggaattgatcggtgggggttgcgttttgaaatgaggggatttgggccgcggtttggatatggatctgcgtgcgtgtctgcgacatctgacctcgaattttagccagggttttgttgatttctcccgcttcgttggggtttcgtatcatccacattatggaattatggaatagagatgatttaggggggaagacaggagcggtgatgtctgtccttcgattttttttcctgcttttggttgattgctgttgtagattttgctggataggcacgattcagggggtggatctgtggtttcgtcgatatgtttctgagcttagtgtggtagattttatttttgcggagttcagttgtgtgggttgaactcatgcagttgtgcagccaatgaatacgatctggtaggaaattatttcgattaagcttttgaaaagaaataaaaattgcactgctgaaccgattataatgaattgaaaagaaataggaattgctgtggcatttatacaattaagctatgatgtgctcatctccaaaaaaatgaattataagaaacggatgcaatatttcagtaccatatatcggccatgacatgcttattcctgcaattttagatgagaaattcatataagccttgaaaagttgaaatcttagcaggaaatgttgtttggtgttagaaatgagaaatgcggagcagtctgttttaagaaaatagggataattctggatataattgggtcctttgttgccaccggtcacttgtcttgagttgtgggctcgtacttattactgaattctgtatttctgatgagtgctacaatgatatatataatataataatcagtgttctccttgggtttagttattttttctatggtgagaattgtagttgttgaactacttatttatatatatttgtttctaattaagacaattgtggtcttcaacagctcctttgggtcattgagtagttatgttagagggaaatgataaaatttattttgttttattagtaagcattttcaggggtagcttaccagatactctgaagttttatcattacttcattagtaatgatagaagtgatactaagtttgatctgacatcattcagctgttgtcgtttcctcctacgggataatgtcactacctttttatgttatttccttatggttagcagaatgcaaatacgttctgtccttatgttatatttgtccacttcaagcaatttctttttactgtatcctaaactatttcattgcattcagactacctcaaggcgtcttgctgacaggaagagcgcaaagttccagaagaatatcacgaagaggggttcagtgcctgagactactgtgaagaaggggaatgactaccctgttggacccatggtgcttgggttcttcatttttgtcgtcattggatcatgtaagctttggcccttcactttcctattcctgtctgtttgatatttcagtatcccttgtggtgtggttcgcaggaatgcacatgcacaaaatagtatatatgcatcttcagctttatgaaatcaatctgactagctttatgactgctgagttagcattttgcactgaaggcctcctgtaacatttacttaccactaggttgactttgtacctccttaggaaaggttctcttttccactgtccatgttagctgtctgacttgttgaacaagatatttcttatcactcataagtttgtggttgaggttttccaaacatggttggccaaggtgtcttttcgccgctagatggctggatatttttcatttgatagtgcattgtaaacatgttggttgttgaaccatatatagtgacatatttctgaactttcttgtagtgttaaccaccataaaatctggagtattatccatgatgaatagaaagtacattcattcagggatgttgtttgtttttatatgttaaatatgtggcctgtgcttaaggaaatgtaaactgtgactactatcacatttacaatgtgttagaactgtcaattcaacaaattaatttcctgagtaatgcctatttcctttcctgccatggtccaaatgttaaattgttaataccctctgcaatttttcaagcccccatctaaaatataatggaaaattgagctttttgcttaagttcctcctaagatacatcaattattctcagctttcacttcccatatttcccaatacagtatatccaaagaacatatgtattgattgttgatacagttcattttgtacaaagtccttttctggcctacatgctataacagttgaaattaggaaatgtaaagctgcttctctcttgtgacttttcacttacatgtttccctattctgtgtttcagtagaattctgtcatacttttgcttcatacacgtgcctgttctgtctatccgtgtacaatatgcaacacaaacttcatttatcaactctgtgttccttacaaagttgtcaaaaaacggatggaaatgacagtctctaacatttggttgtcttgcagccttgttccagataatcaggacggcaactagtggcgggatggcttaaattggagctaaattcagttatttatgctgtgtctgagagagaggctgtacctgtactttgtagtgaagtttgttcctggatgatatcgtgtagagggtccatgttgtgtccgtttgcattttactaaatctaaactagatgttggtacctgaatcttacagactttaaacttaaatggatataattgaactttgatctggagactaataattagcattgttctttgttattttctgtagtattctgttttcctgcagttacgcaagcctatgcagtgattttcagttgatcactacgagttcctcttctgcatttcaatatgcaccttgagcaaatgcatatgtaatacgaaaaactagctattagacaaaacatcatgatggtttatgccatcaaaccttctctgtttgatagggtatgcaaatgtgttggctcaagttttgataagttaatagttaacaaaaattggtatgcaaacgtgttgttaacaaaattatccagaatatttatatatgatccagataaactgttagggcatgtacaaaggtagagacgggtatgagctctacgctatttagagtctaatgtcatacaacagttgaagacaatatggtctctactattaatgtatcaaaaacaattttcttactcatctttcctttctttgttatgcataataaccatatttctcattcctcctttctctttcttacatatcatcaaatttacttgcgcgataatagagagaccagtaataaagaccatcgtacatgcccataggctgttaaaatctggaaatgtgaatgtgtctgtcttttgggcatgaaagataagctggtttgtattctaagcatatgtcatgatactccaaggctgtaattcctgggcatggctctatcacaatcatcttcacaggggcgcaaaaatctctggaattttccaatggatctcgaatctctttctgatctgtgatgcttctgcgtagttcttgtgaacaatctcatcaggttcacccaaaaactaatggtccatgcagtccttgtgaagttagagatattattgccttgcattgaaatcagaataggaattctattcttgtgaatgcaagttagcttacgccatgtctagatcccacctcaaatttttttttccctgtcagatcgaacgtttgaacacctgtatgaagtattaaatataggctaaaaaacaactaattgtatagattgcgactaatttgcgagacgaatcttttaagcctaattactctatgattcgataatgtggtgctacagtaaatatttgc

SEQ ID NO: 73316 - DNA, 711 bp, Oryza sativa
tccccagatggtatacccgagcaatgatgagagggagtaatatagatagctgaatattgtggtgacttggtcttatcttattattattttttcaacatatataaacccatgttgcatgtaactcaaaaccatgctgtgtagtatctttacagggcagtcgtgaatgatgcttcctatgagttcagcatgctcaggaggacaattccccggagcttcacctcatgggataataccaaagcagttcagcagagcgcctcgtattcgtgtcagtataagaggtatgaggtacctcccaagtgctacaaaagatctcttaatatatggtatacctctttgctactccctccgtttataataagttttatattataagtcgcttgattttttttctagtcaaactttattaagtttgaccaagtttattgaaaaatttagcaacatctaaaatattaagttagttctattaaatctaataaaaattaatatattttgtataatgtatttgttttgggttgaaaatactactatatttttctataaatttggttaaacttaaaagaaatttgactaggaaaaaagtcaaatgacttataatataaaacggaggaagtatttgagagtacagttgtcgaagctgttatactagacagataaattttattgtctatcacaatcctttctattgcaaagagatatctcacacatttcctt

SEQ ID NO: 73317 - DNA, 10883 bp, Oryza sativa
gattaaaacaagagggagacaaatattttatcctgaagtttggatcatagggatcctactctccgttgaggatcaaaatataaaaagaaatttaaataaatctccgagtcctcttgccgctttgtatttgttgttgggggatttcccagcacacctaagcaccctgggactaattatctgtatttatctcaataaacatattagtcccttacttgttttgtcattaatcaccaaaactcacttatgaggttagatgcactttcactccctcccctcttgttttctctcttgctgttagcagcaacacgccgtcccaagaccctaggtctccgccggttgctggctcccaccccgcgctaccggcatccacctcctaccatccctcttcttcctgtccgggcatctgagtaggtgtggtggggtggataacaaggtctgttgccatggagttagccgctcctatgaggtctggccggcgccaccatgcccctagccatgtggtcctcttgctcgattcatcgaccgaatcaccgaagaagcaagcgggtgaatgagatcaaccatgccatatgtccatcctttctttcaagatgattatttctcacatgttttgtcaaccctcattttccttttttagatctggaatgtttcttggatttttgtaatactggtttaatccagcattctggccactcggtttcacatggtttgtaataattgatcattagcatgcttgatgtattaatcataccaaacgttggaggatttcttgattttctttccaatcttaatttattcaacattaaggctaggggctgacatattgcatctgctctttttttaattctggctctagctcgcaagctaaacgagctagctcgagctggtacacgagccaagccaaagcctgccttttagctcgtttggataataagctgagctgaaccagcttgttatcctaacgagctaggtcgagcagagctgacctaagctagctcgatatccacccctagaagagagcgacctattttagctttatttttttattaaattgagttgagacaatttgagatttttgtcgggagcatccaaactacgcgaatctacatgatactcatgcaacaccgattatcttttatattttcttggaaactgtctttcagaaatgctaggggactagatcccaccccgtattccatgtggtatgctccccctgttagcttggcctcctctccttgcggcgtcacttttgccaccattccctttctctcactccgaccatcgctgccaccccctgaccttgccatccagtgaagagcccccatggcagctctagtcgagactagttcttgtcagcaccaaactacactagcgatcaaaatgtatccatgtcaaccacctccttaggtcggacctctgcggcatctatctcgtacgacaccctcgttgcagcggctgatccgcctgatggcgtatacaagccactacttccacctagaggctaaacctcttcggcaaataatgaagattggacactatgaggtttgaccatccgagtccccgctgctcgactccactaacccgatgggctagattctctgcaatgcgaccacgatgtctcgtataccgatgctacgcgggccttcggcgtaggcaaggaggcttggtaccgatggttttcggcctaatatcgatgagtatcaaactggtactgataggggtaccgcatctggtatcggtaaatatcaacctacttactgtcatcctgtccgaacggaattctgtataataacagcctcaaaattgaattcctatatccacacaagctatctcatatattttttctatatttttcaatccaccattttatgcatacattttctatcatgttaatatgtctttttgtctgttttcaataacaaatgatccgagcaataagcatacccaatagtataggatgtgtttagatccaggggtgaaaatttttgcgatgtcacatcggatatacggacacacatttgaaatattaaatgtagtctaataacaaaacaaattacagaatccgctcgtaaactgcgagacgaatttattaaacctaattaatccgttattagcaaatgtttactatagcaccacattattaaatcatggagcaattagggcttaaaagattcgtctcgcaatttacacccaatccgtgtaattagttttttttgtctatatttaatactccatacatatatccaaacattcgatatggcaggatatggcaagatgaaagaacttaccagggagtctaaagaggcccatagtacacttgttattcttcccactacgatacgattgcagcagtaccagcttgatgattcctctcacgacggtcgctactagtagtactacagtatgttgttgggcattcacttaacacatttttttagataattcactttacacatgattaaactgttctctagtcctggttgcctcctaatcaccatccacgggctgacggacgtcgacctcgcctacattttctatcgaattattcccattggaggagaagagggtggccccaaccgcaatccaacggaacttttgctcctcatcagtcctcacctcaccatactcctgtttgctgtgcgactgcttcgcaaagccgcccacttgaccgcccgcgcacgacgaattgagaatgccccacacttgtacgcacacacccacaacccatcccctcgcgacgcacgcaccgccgctgcctgcctcgtgagccgtcgccccgctgaggctgacgctgacgcgtgagcccgtgccgtgccgtgtcgtgtcgcggtggccggtggggaaaggagtgtcagcgagaggagttggtgggtggggaaaggcgggtggtggcgtggcgtcgcgtgcgtgcgtgcgtgcgtgcgtgcgagcgacgacgagaggagaggagctcacaactttgactttgatcacgacggccccgcttgcgcactccaccgctgggcaccgcaccgcggaccgcgcccccaaaactcctatccgatctgcctacctcttttgccattccacccttgctctttacgctttattctttctttcctgaaagccccaaccgtcgtacgcagaattacatcctggcccagaacgtgaaaccttccaaaccagcttgtaattttagaaaatagtatatgatttgtgtatgtttatctgaaataaataaatatatatatatatataatgtgtatcaaatagaagtcgaataataggggttgctagtacgcgcatatgcgctggttgattaactagcgttgggttagccaactagcatagccgagatagtagtacactcgtgcatcattagcgctaatgatagtgtaaaatgattgtgctaattatagtttttataatcagaataaattgaaaagttttgaatatatgagttgaaagttttaaaaatttgagttgattttttttaaaaaaatagcttaaaagtttaaattgtaagttgaaagttttcaaattcgacttgaaagtattcaaaatttgagttgaaagttttcatttcgagcttaaagttttcaaaaatcgagttaaaagttttcaaattttgagttaaaagtcttcacaaactgagttgaaagtttcaaaatttgagtttaaaattttcaaatttcgagttgaaagttttattttttatagtaagttttaaatttaattggatactttcaaattttatgtctatatttttaagcttatagtgaaaaagaaaacaatcttaggcagaaaaaaaggaaagattaattaagattgtgattattgaaaattaattacgtaattgttaagttaatcacgattttttctctccgagtccaggacatgtgcgcgtgttgtcggctaaaaaaaaaaaggaaaagtcacaagaaaacataacgtatggctgtgcatgggcctaaaacgtgcgccgccaacgcgcacgcgtgaattagcttttccggaataatagacacgtagatgagaaattagacattgtgccattaccaaaattgggtttcaacgaaatgccactccgcaaaagggattcgataagatgctatcctcaacccgtggcttcacgctagattgctatatgggaccaaattgcccttggattcctccatccctatcttctatttcaactccgattacccctcgccgtcattgatggttggccattggacatcgctctcgtctcatcttctcaaattgttgtagtaggggctcgcaactgactgagaccagcaaaggggctggtagtgaggccttcgagtgcgagcgcggacaaggggagctcctgtgcagtggcgaagctcgagcacaagggccaacgccgacaagcaaaagactcagctactggttggcctacctctctccctcacagtactgctcgatgacaagaaggggaggggagatccatgcctctatggaggcggtggttcaaggcgaagcacggcggtggatctcaagctctcctcgaggaggttgctgaaggcgacgattggtcggcaacaaagctctcggtagccatggaggcagctaatggagcaacaccatgcagggaaggagccggagttggagtgaagaggagtcgcgacaactggggaaacagagctctcgcataggcggttgtactagcgagagagatcatcctcgatggtgcctccaccgccggagacctcgttgttgactgccaccctagggaagttcatcctgaggaacaacttcgctcctcgttgccgctggtgtcctcaccgccgctgctgccatgagtaccatgtcacacactgacccaacagttacatgcccaggcaagaaaggagagggtaatttggtcccatatagcattctagcgtgtagccacgggtttaggatggcattttatcgattcccttttgtggtgtggcattttatcaaattcattttgtggaatggcattttatcaaatcccttttgcggagtggcatttagaagaaacctagttttgacaatggcacaatgtctaatttcttcatgtagatagaactccgctgcgaataatatcatatcatgaaagtatatggagagatgtgtctttatgatatttccttttcgaaaaagtatgagggaaaaaagttatagccataactggatgtgcaaatgtgcaacataaaagcaaaatggtataactgaaaagccactttatttattcacattatgtagcgtcatcctttggaaaagaaaagaaaaaaaaagggggcaatggaaatacttgcaaaatttaccaattgcagggacctgcgcgcaaaaggtatcacaaacctcaaagccgtcaaacgcgtcgtgatgccaaagcgaagttagaaaaaaaaaaggttgggaaatgaagtccaccacccacctactcgccggcggcggtggcggcggctccgtcgcgccaccaacggctgccacggcgccgacgctggccatggaagtaggggatccctctggcgccctcgtcggcggggccggcggcgccggagccggaggaggagacggggatgcccgcgacgcgctcctccggttggttgctctcggcgaccgcatggccgccgtccgccgccgcatcgccgcatctatatccggagaatccgggcccctctcttcctccgacatccactccgtctcctccgagatctcctccgctgcccacctcgtcgtcctcaacgccgcctccctcctctcttccaccgtcgcctccctcccggctccacctccgcctccggctactaccgtccaggagctcccccccgtggtggtctccgtgcctcaggaacccccgcaagaagcagccaagggcgacggcgactacgacgtcgtcgagctcgacgcctccgagcttctcgcggagcacgtccacttctgcgacatctgcggcaaggggttccgccgcgacgccaacctccggatgcacatgcgcgcccacggcgaccgcttcaagaccctggacgcgctctccaggcccggccagccgaagccgcctgccggccgggaggtgcggttctcgtgcccctacgccggctgcaaccggaaccgcgcgcaccgccgcttccggccgctcaagtcggccgtgtgcgcgcgcaaccacttccggcggagccactgccccaagctctacgcctgcgagcgctgcggcggcaagaagcgcttcgccgtcctcgccgacctccggagccacctccgccactgcggcgaggaggcgcagtggcgctgctcctgcggcaccaccttctcccgcaaggacaagctgttcggccatctcgctctcttcgaaggccacacgccggcgatcgccgagccgaacaagggtgtggcgacagcggctgcagaggcatcgatttctatgatggaggaaggaggagttgaagcgaattgtgatcgagaggaggatgaggagggtggttttgatccgaagttcttccaggagtggatggaggagctcagaggtggcgctgttgcccccaattggtctgcgccgtcagaagctggacattagcagtgcagcaagagcaatttgggtaagagcttctttatcttcctgccattttgttgcatatatttaaggaaatttggttgagatactgatgataggactaattagctgatagaaaccctttcaaaggcagaaagaaggaaaatgaaaagacgaattgctacattgttctgctaatcactgaaatcatgatgtactggatgtgtcgacttgatagacaaatcatcttcttctatgcaacttaatttgagtatgttagatgttcatggaaagattgttagtcaccttaatttatagtagcgaggcctgaatgaacctagctagatgcaaggttgtaggtagagaactaaacttagtgggtgggggaaattttgtatttgtttagctggttcattcctctggttgttttaaatcctgtgtgaatagaggttcaaatacttaatcttttgccttttccttcttgaatatgggactttcaaagtattcatgctcttgtataggttaggccggaaaagggagtataactaactttatgagtgcaactttcgtaatatgctgtatggaaggtctttcaacctttgctgccatttttgtgggtttgtcctcgacaatggcatgcccatctgttttgtgttctattaattaggtgataaatactccctctgtcccatattaagttcatttttggttcagggcacatattttctctaatgtgctagtatatatactaccaatagttagggtttgtgtacgtatgaaacttcctactagcagaaaagatgatgtcgtgcatggcagtatggcacttgtcttgaatttattgggcgttcacctgttggcgagtactgataaagattcgcgtatttgttgtgtaatccttctgctgaccagtaaggcagtaatgtgatctttctccaattagtctctgttgtcgcttagcggcttagtgtctttgtttttgaacaaaaacaaccttacctattccaagtatcaaatctgggttttgtctcttttccgcaaccgcactacgaggagcacatcacagcccacttgtcctctgttttaaggtgcttcccgcctttctttatatactgcgaagctaacggttttgtggaaatattatgttttcttttcctctacatatgctttcatctcaatgattattaatggcacttattttttcttgcatatgcttttatttcccattgtgcaaagattgtgaagtatcatgcattttatttaattttactcttcaccaatgcatttgggtatttcacttggaaggaaagttttgtttgtaaatttcttatcatcttggaaatgttaagaatttcatctgtctaagagagattggtgtccttattcatcatacattggagaggaatatgggttatattgctcttgttcgtgtgttgttaattgtaggtatactgaatgagataaattccacatgatcggatgaatcatgtctgatggttttctggtacctcacaggaggtaacaggtgatccttacttttcaacaggttatgcattccaaggaccaaattagaaaaggcttaccatacagtacataaatccatactatttgcaaaactcaaatctgggaaggatattttcatgaggaataaagagatccgttgattaacttacatgtttatatagccttatccgaaagttatgtatcattttgactagattgaatccatattatttggcggctgtgactgaaaattcctttattacaaactacaatgtttgcaaattgtgatctcattatttctatcttgcaggcctatggtaggaagagatgactgagaagatgaatgaagaagggtcctgtgaagaacagaccttcccccggcttgcctctgtctctctctctctctctcttcccctggtctccccatcttttaccgctcgctgttagcctgttatgcaactctcttttacccatgacaaggatctttataacctggaaagtagtggtatctgtttccgaagcagtcgaaataccaaatgatgaaagatattaaccgttggtacatcgtgttgtatgctcattgtgtatgtcttcatgattcagctttctacggtagtgtagatacaggtttctacacgttacagtagtattaaacacaacatcagcacccaacactgtaacgaacaccatacatgtgagatcttacaattgatcgaggtgaagtcacactgaaggcttctggcatgacagtttctactggggtaggcaatatgtgagatgttttgacagttgatcacagcagtagtaaactgaatgtttttaacttctttagctaatttatcagcaactctgctgatttcccttgggttattcatgttttatcatctaataacaataaaaatacaaatcataaaaaaaatttaaataagatgaacgtttaaagttgaacaacttacgggctatggttgcgcttataacaggctggagggagtactacctttctcacgaataccatacattctgaccttggtacccagttttagacgttgggctacagcgttgtttattatttttttgataaattttttttgttgatatacaattaatataagaccacttctggccttttgataactagaatatacacaatatataattattgaaaaaaatgaaggacatgataacaggtatcatgtcagggtgagcaacaatacatcgaccatcgacatattcattcttcaccatagtaacacatggactgtaagaaagaacatccaacaacaccttataaaaatatgcatcggccatcattgccatgatcaatcagcgaaccattcactccaaagaactttttttttttgccttttataaaaggcaaatacagctattgctagcgtatccaggaataaaaaagtggggtgggggtcaaacatactggaaacaccggcataagcacatcatgtctcatacaatattataatatcataatattacattgtagtctaaagaagtttcatatggaatcagagaaatacatcctaacttcacaagacaattgattatttttcacttgtggcacagattatctttcatgcaagtatgagacaaaacaaattagtgataactaccaaataagaactttaattcttcaaaataattctgagcattacaataggatagagaatataccagtaaattgttttgagggcactaacatatactatgttttttttatctcttcaaattgttttatgattgttttttcattatcaatgctcatgaatatctccttctcaatgtcgcatatcatcaaatcattgagccattcatcccccaatttgatatgcaaatccatctttataagcgacgtggctgaaaagactctctcaactgaagccgttatgccaccggcagtatcgatgttagctcagtgagtcgataaaccaatcgctacgatctgtgcattccggatttaaccattatttcaacaacctttggaaaatctgtacatccaagaaattctgaacttctcctaacatggctgatgaagtctttaagttgacctagtaacacaaaagatcaccgacattataatcttcagcataaattccaacatgtcctacaagcttatctagttccttggattaagagaagtcattagctcgccggcgccactcacctcttgcgtagctgaacgggttcaggagctcactacctcgatgcattggctgccagggatttggggatgggtattggggaattaggtagttgggctggggggctatttgtaggcaggggcggagctaggtaggagatgtgggggtgcctaggaatctggttaagaaaattttttagttatagttcatctattttcaccatatatgcaccccctcaatccaaatttaggcacttatatcagtctaatgtagagtaaagcaagtgagtggcacccctctccatttctttctagctccgcccctggttgtaggcctgtggcctattttctaagtgagtaggttgaaagtccaatagcgtatgcctagtccaattgcattcactggtctaatttcacgattttttcaacctccaaccattcatagatttttagcatacactccctactctatcatccatggtgaaatatttagggggtgcagggtgctctataggtctggagagggtaggcacccacattgaatcggctcctacacctatctaaacctaaatatttcgtctaggagtcaaggaactagtacttgataaacaccactgaatcaaaatctcctagtggaattgctcgctctttccttgtggtcgctgttatacctcacaatctggtccgactataaaatgg

SEQ ID NO: 73318 - DNA, 3561 bp, Oryza sativa
  unsure (1)..(3561): unsure at all n locations
tttaaaagtccaaatggctgacgtggatgcaactgcctcgcttcgtttcgcttttcgctgacgacttcggcgacctgttcattattcagagcccatgtttgcagttatctgagaaacaaccacgactcaaaagttattcagtgggcattagatcaagttccttaaacagttaatctgtactaaaatccaacaacaatccatccaagcaagcaaaatcgcaaggggaaaaaagaggtccaccggccatttctaaacgcgtatagtatcacgtctatccaaaagcatacagtgtaattataaccaaacttttagcccgtcatttggtctctctaggactctaggtaattggattggagccagggatttatatatagtcacacttcatatgacatccccatttcgatactgaaacaatgcacaccgtgacaaaaatatactcctctatttggtagtattgtttttcggctcgtgagttgtcatggccgtgccaatggtagcccgacacatcaacgtccgtgacaaataaaatatacgatgactgcttcgccactggaccgcccaaaaactgctacttgatcagggtgatgcacgaacgttggcggctttcacttgtatttggcatcatctagggctagctagcttggacatgatatgtatcaaatccaaattacctacctatacaaacggattaagctaacgactcgatggaagcaactgaaaaactcccaaaattcccattggatcgcgagcagatagatatactagtcgtaaactcgcatgggatcactcgcgacggtccagatcgaacacgctgtctctttcactcgctcacctgctccatgctcgtccagtactactgccacgattattctacactatcctggtgttatttgctaatcccgatgcgtcactgcactgaaagtctgaaaccttctaatccctctgctataaaatcgctctgctttactgctgttttctggcattgcctgtgcgccgcgctgcgctgcgtacgtgacagcagaagcgacgcgcgcgcgcgcgagcgacaccagatgttgccgtccaggccgaggtgagcgcgcgaaaccgtctctctgccgccatttttttttaactcggcgatcgagcgagcgagcattccgaactgactgactgactgggtgagatgatcgccgtgcagatccgggtcctggggaggcgggacgcggagttctccggtgtccacgccgaggtctcgccacgagcgcagcaaatccgtcgccaccatcttctcgccgtcgtctcccgaggtgcgtctcctgatcgtgcgtgaaacttgtgtttgatcggcagcggtggtgagcggtgacaggtgacgcactggctggtgcagagttacggcggcgtcgtgatggagatggaggagaagaagacnnnnnnnnnnnnnnnnnnnnnnnntgggttgcggcagagcgacggtggcgtggacaaggaagtggtgggcggcggcgcggcgtgctccgacgaccgggtgcggctgctggagcgggaggtggcgacggcgaaggcgacggagatgaatatgctggagtcgctgatacagcagacgaaggagatggagcaggcgaagatcgctctcgaggaggctaagctcgaggtcgccacgctgcggcagcagcagggacgcgcccctgccgccgagccagccgccgccgcccagtggagcgtcatggacctcatgttcggcggcgtcgacgaggagatcaacgggctgagggccaagctccgggcggccgtgcaggcggaggagaagagcaggaaggcggccgacgacctcaccgccgcgctctccgccgtcaccatggaggccaagcaggtgaaggcgtggctgtccgacgcgcaggccgagctggaggacgccaacgccgaggtcgaccggctcagggagtcgctgcacgccgccgaggcggagctgtggtcgacgaccgagcagctcgacggcctcacgtcggactggaaggaggccgccgtttcgtggcgcgccagggagaaggtgcttctcgcgcgcgtccgggcggccgaggacgaggcccacgcggccgggcaagagaacgtcgagctcgccgagctgcaccgggtggtcgacgacgagaacggcagcctgcgtcgcgctctggagcgcgccgtcgaggaggtcaacgcggcgaacgagtcgctcgagctcgccaccggcgagaactccaagctgcaggacgccgtcgcggagaaggagagcgccatggaggcactacgtcaggagaacgagagcctcaaggccagcgaggccgaggcgcgcgggcgcgccaaggagctcgacggccagctcgcggcagcacggaaggccgccgatcacggtcatggcgccggcgagctcgcggcggcggccgaccccttgtcgtcgctgcacaagtggaggggcgacatgcatggcaagctcagcgccacattcctggactccaacagggtgatggcgggcaggaaggaccggatgttcgcgtcgctcagcaacatcgccgagctcaagtcggcggcggccgcggcggccatggacgacttcgactacgagttcgaccacttcgacggcgggcagtacggcgacctggaccacgccatgaagcagaagaagaggaggtcgatcctaaggaagttcggggatttcttccggaggagaagcttgtacaagcgcaacctagcgccggtgattcactactagtagatttttactacttaggttgatctagattagatgctttaatgttttcgcgtgatgctttgtatggtacgtgtttgattgaaatgattagcaaaaaaaaaaacgcccaataaatgaagagaaacatcatcgtgtcacatgcgtggtcttcacatctccctcctgcctgctcgaaaatttgatcattgtgtatggaaaccacgcaggtttatctgaaatccgaaggaaaggataggagaatagacactgtgagaataacgtgataagttcatgtatgatattgtttgatactatatgctgtccacagaacctgctttgcactgtatagatatacatgcataattaattaacacgttaatgatcatgccaataagtcagatttcggtggtgtcagtgcatttgtaagttattactcgaaaaatttccctttggacaaggatttgtgttgggcttgtggtttccggacggacatggggacaccggcactacgactttttaaggcccagctgctgcagtacgattattctgaggaataagttcacattgggtccctctatttgtcgcccagtccaattttcatcccttgaccgcaaaaccggatatgacccgtcccccaacttacgaaaaccgggtaaacgtggtccctcgtcggttttgaaggcggttttggctgacgtggcgcctacgtggcttgtttgacttggtcttcatcccacgtggcattgacgtggcgcttgcgtggcaattatatctcggaaaaataataaaaaacgtggccccacatgtcacctgcacaaacaaaaatagttttaaaatggtggggcccacgt

SEQ ID NO: 73319 - DNA, 3887 bp, Oryza sativa
tcctgcagcccaggctttaacgagtacaattttatcatcgaattgaagaaatgcaatccttcatcaattaacccaccttgactgcaagctgataacacaactaccaacgtgatctcatcaggtctgacactgttagcttccatttcccggaatactgctatcacctcagacccattaccattagaagcatagccatcgatgagtgcattccatgaaacgatgtcttgtactaccatctcatcaaagacttgtcttgcttccaacatccttccacacttagcataggcagaaatcaaggcatttccaggagaagaatcactgataaacccagtcctgacaagaagactgtggaattgtctccctatttgcagagtagccaaatttgcacttgcacttagacaacatgcatatgtacaccagtcagcgctctttgcatcccttctcataagcataaaatgctgcagtgcttcaacaaatagaccattttgaacaaatccagagataattgaattccatgaaactgtatttctcctcttcattttcctgaaaatactggctgccttgcgaatttgtccaccctgagcacagccagcaatcatggtgttccaagaaatcatatccttgttcggcatttgctggaataaaaccatggcctcatcaagcataccacactgaacatatcctgatatcattgtattccagcacactgcatcccgaaccacaattccatcaaatagttgacgggcgtcatcaatcaggttgcttttcaaatagccatgcatcagtgcagtctttgctccgacattgtcggaaggcatcttgctgagcacatccttcgcttcttggagcttcccagaacgtacaaaaccactcaccatcgttgtccatgagattgaattcttctctggcatctctataaacagattataggccgcctccacctgagagaactgcacatacccagaaagcagcacattccaagccacaacattacgctcaggcattctatcaaacaattctcttgcctcgcccatcctccctgcctgacaatacccattgaccaagttaacccaagaaataacattaggtgaggggatccttgaaaagaatgcactggccacatccaaatccccagcacgcacatacccctctagcatcaagttccaggacaccaagtccttatctggcatctcatcaaagaactgcactgatcgagagatttcctcattccggatgagcccccccaacactgagttccatgaaacaatatcaggggccggcatctcctgcaacaaagcaattgcatcctcaaacctgccgttcttggcatacccggagatcatggtgttgtagcacgccgcgcacttctccccgggcatgcggtcgagcagctcccttgcgagggtgagctcaccagcccgcacgtagcaggataccatgattgtccaggagtactcgtttcgggcgggcattgcatcgaatagccctcgcgcatcctcgacgcgcccgtgctgagagcatgccaccatcatggtgttccaggacacggggttgcggcgcggcatctcgtcgaacagcctgcgcgcctcggcgaggcggccgtggtgggccagcgcggagaccatcgcgttgtaggagaccacgttgcggcggggcatctcctcgaacaggcggcgcgcggcggccagctggcccgagcgcgccagcgacgtgagctcctggttgctcctaaacacagcagaggcggtgagcttcgcagctgccattgggggcggtgatggcgctggtgccgccagataccacaattcgggatggtcacggaccgatggccccggatggatcggcgcgtcagccggccgacgaccgccagcagtggagcagctcctcaggcctggatccccgcactcgacctccaccagccgcttcgggaggtggcggccggaggtgctgagcagcaagagatgctctgtgcccggtgccctgatgcgctgcggtggcgagcttgttgccggggctcgggaggagatgcgccgcgggcgtgcgtgcaggggttgtttggttcgtaccagatgatgtcacgcgctttactgcaggatataggtaagatattggagaaatatcaatcagagcgtacatcgaaagtcatacttcttaacagcatgtgtatcaaagaaactgaaacttctttaaatttcagtgagcgtgtacattcaaaattataaaatactgttcaattataaaataaagtcaagagattttttttaaaaaaaatcagacaatagcatgcttatatgcttgatccgatttttatcatgaacagtagagttttttaaaatgactatcagacaaaagcatgaatactttagttatcgttatctaaaaaaatgaaatcttctgccatactaccacataatataccactaacatagaatgtataaagccatacttcttaacagcatgtgtatccaagaaacctaaacctctttaaatttcagtgagcgtatacattcaaacttataaaatcctgtttaattataaaatcatgtcaagagattttttttgtttaaaggaccattagaactgtgcaagtttatatgcttcaattataatatcatgtgaagagatgttttgtttaaaggaccatcagaactgtgcaagtttatgtgcttgaaccgatttgtataacattgatgaacaatagaatgggggagaaagagaagggcgaggagggatgtatgtacctttgtgcgaatcagagatccgtgagttggtcgacaaggcaggcgacggtgtcctagcggtggagatcgggggcggcgcggaggatgggaggagacaaccgaggcgggcgacgaggagtggagacgggcaacggtgtctggcggtggagatcaggcaggcggagcggcaggggtgattctcgttgttggcacgaagactgcacggcgttatggatcgacagtgacctgatggtggggtgacagaattatagggtagattaattatttgatttactcacatggttagcagcaaggtcactgtccaagtgaaacagccagagtagagaaatctaagaaaaatattgtcaatgaatacctttctacccgtggtgaggcgaaggtggcaacgagatagagacggagagacggtaccaggacctcagcagatgcagcgtcctccctcacacagtggccttaataggagtacagcaatttgcctgttaatttattttaaccattcctcatgaaatacattatctgaggaagataataagataaagttcagaatcaatattcagctaagtgagtgttctcataaaccctataaatcagagtgttcacagccacatggtactctgaccagttcccatgcattttcccggagccacatggtactctgacggtccaatgggttcatcatcttggttgatattttgacaggatataaaaaataagaggaccaaaagtacaaaaatttccattctatatcttttttttttacagaaatgccacctccctgaagtttcgagttttatttgatgcagtcatataaaccatgactttttgaaagcaaattgtaatgatgaatatcacaaaaaatgctgaaattgtatactctcttgaaaaaagatatgcagaacggaacaatcctgtgaaactgtttatgcaactgcagacatttcattatagggagaattttcggtttgcaaacatgatgaaaatgcaccttggtttgtcagttttggatagaacaaaagggatggagcttacctaccgtcggtggtggtgatccaccacgatgggggcggcgatgaatcagataagaggggaaagatgggggcggcaatgaatcaccgcggcggggggggggggggggggggaaagggg

SEQ ID NO: 73320 - DNA, 1854 bp, Oryza sativa
acgcgggctaaccaggccgcgcgggaggcggcgaatgccggcctaggcccaggttgttgggcctggagcccaggcggaaggcggcgcggcaatgacgggccaggccgagtgcggcctggctcgagaacgtggcccagttcaaaaaaaaaggttatgtgggctgcatactaatgggcctaattaaaaggattgggctgagataatattacaattaaaattttcttttttgaagaattatgattatgattatgatatttgtgtttaaacattgaagatattttattatgttttagttaatgataataagaataataagtgattttgttatgtgataaaattctctttcatttatttatttattttatgatcattacattatatttattacttaaagttattattgttttatgcattatgagtttatttccgttacaaataaatattataattaagtgtgacaaataattgtcattctggccaaagctgattgacttttatttgatcacaaaattttattaattcaattcaaatctggctaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaaggtactcatcttatgcctcacaaatttccggaataatgggcaatattgaacaacttaatggaagtaattatgcttcatggaaggagaagctggaaattactctagctctattggatattgattatgccctccataatgatcctccggttgagcctagaccggaaaatgagaattatgagacattaaaaaggatatatgatgaagtaaaggcaaaatgggatatttcaaaccgtaaatgccttatgattatcaagagctccattattgacgcaataagaggagcagtcccagatactcagacagccagagaatatcttgctaaagttgaggaacaatttaaggctcttctaaggtttatgccaccactcttattaaaagattggtcaatgaaagatacgattttactgaaaatctgagggaacatattatgaagaaatgtcacatggtttctaagcttaaatcaatggaaatggaaatctctgaaggttttcttgtccatttcattatgtcatctctgcctcaggagttttctccatttacgatcaattataatgcaatgaagatcaagtggggcattgatgaattaatagccatgtgtgtacaagaagaagaaaggcttaaggcagaaagagttgaccatgcaaatttatttaagcactccgagaagaaaaagtataagaaatttaagaaggagtatttgaagcctaagcctattcaatttaaagaaaaagggcaatcttcgaatcaatcccagcagaataaatctggaggaaatccctatacagaagaaaagggaaaagaaaaggatgggtgctacttttgtggaaagagtggacaccgccaaaaggactgtattggatttatgagatggctcagtaagaaaggtactgatgttatttcttttgttgatgaatccctaaatattgattatgccaccaattcttggtggattgactcaggagcgacaattcatgttgcaaattccttgcagggattcgctatgaggaggaccctaagaagagggcaaagaagaattagagttgctaatggagttgaaactgaagttgaggccattggagacttcactctcacacttcatactggcttcaaacttcagctgcatgatgttctttatgtaccctctatgaaaa

SEQ ID NO: 73321 - DNA, 18587 bp, Oryza sativa
ccgtttaattgattattgctccctccttccacaaaagttatactctacctattacttttgttaccaagattaaggagaaattaactcatgttgcaggtaacaaaaaagtgtatgcacgtttcaaccaatgagtattaagatgactcctcggattctgatcaaacatttaatttacctctccatttaagtcttagatgtatatagacttcaaatataaataacttatttggaaaaactaaaatataaaatatgtccaactcttttggatggagggagtaattattacaaacttaaaaagatggttttatttaagtttttaaagaaacctctatataaaatgtattttaaaaaacacattgtttagaagtatagaaaacatcatcacccctaaactcattaccgaacgagcctaattgcttgcttggtattttaacacggaccctatgaaccaattaaatccttatgttgactagattgctaaatcacgtttcagaggagtaggttggaaaatgagttttgttctcaggacattatactccagatttgattgagctcctgcgttcgtacctgaagctccccaacttctctatctcgttttccgtgcgcacgcttttcaaactgctaaatgatgctttttttaaaagtttttatacgaaagttgcttaaaaaaatcaaattaatctatttttttaaaaaattagctaatacttaattaatcatgtactaatggactactccgttttccgtacgtagaggatggattcccaacccattctattgaacgcagccatattgacttgtcatagagagttcattttgtacacaaagtccttttctcgcttacatgcaagaacatatcttagtttgcactgtttgagtactacaaatctttcaaggacaataataataacacatcagcatcagtgaatggtccacactccacacaaccattttgtttaatcaagagcacacccttaaatttttcaaagatattttatggatggtgagatctcagcaagaaatggacaagaccaatcatggctcttttatgtctccaaatagatggggtttcttgccctggctactcttcaacttcaagtggacaaccataagtaaaaatgctccacaataatcagtaaaaacattcaaaaatacagaaaagcaacaggaacgacattcagataaatacagaaaagcacccgttatagttcaaaaggaatcattaatcaggtcaaatggacaatcaaatagagaactaagccctacaaccaaaatacatagtactacctgcgtctcaaaataagtgcagccgtcgatatctgtgtccaacgtttgaccgtccgtcttatttaaaaaaattataaatatattttttaaaaatagtcacatataaattactattcatgctttatcatctaaaaaaactaattatataaaattttcaaataagatgaatggtcaaatgttgaacataaacagtgcaaaactgtaattattttaggacggaacgagtagttcgttttgatctattgctagatggattctagtacagatattagcagttattacctattccactagacatggatactcattaaatccatggtgatgttaggcagcttagactattcatcaaaataatccaattgcttaaggtatataaattaaagtcatcttgcccccaaattagcacttaaccacaactacccaaaatggccaaatccaacaaattaacaaacgaaaatcatttccatcatcatcaacaaacagagttgtacaaataattcaacatgcatctaaagaaaagaggaaccttcaacaagcatgtggttattccatttctcccatacaacaaaacaacaaaacaaatacattcactgaccattcctgttctcccatgtgctttgagttcaaaggccaaaactatacacatcatgagcatgtggcaagcaatccaagtaccaccctagcacataggaaactcctatatccctacgacaagtaaaactcgtcattttccaatttaataatctacatagaaatgattttgtgaaggtgtgtgacattttgtttgagcgacactcaaaagtactatctcttaatgccaaataaaaagttatacaacctccgtccaaaaagaatacatttctggctgcatgcacggatgcacctggattgtccaggtacgcacaaatacattccttttggacggaggtagtagttttatgttttaatgacaaacaaaacagtactccaactgtaatacaacaacacaagaacatggcttgtgatatgtgtccgatcaacacttacattataaaccatactctatcacaacaaataaaaactatagttttcctaatacaaggacttcaaattttcttttcgaaaatgttattcaatcattaatgactaataacaactataccccgaaattaagcccaaaacaaaaatcaatcacaattgctacgacatttctcctacggtccaagaatgaaaaaactatgaacctgcgagtgcgtgcaatatgccatctaactgatattgccaaacaaatacttcctctattccgtgttgtaaggtgttttagctttgagtcaacttgttttaagtttgatcaagcttataaaaaccggtcatatttctaacataaaattaagatacattcgatgttcgatttaacgaagcaaacttggtattgtagatgttatgttttcctattaatttgatcaaatataacaagtttaagttaggagttaggacaaacttaaaacaccctctaggagtaaattttttttttttgagggaacactaggagtaaaatctgatgtgacactaccatgacatttgaaggtgtatcgctagccaaaaaaactctcacaagatatcatcacctattccttttgttattgcaatccacatcttttcctctcatggaccatgtggttgctagcaattttgtctagtataaatcaacgccacaccacttgcctagtcatcaacacatcaaaaatattcatctttaattttttttgaattcatttcttcacgtaaacatcctactccatctctctcattacactcctttcaaaaacctccaaaacaaaaagaaaaaaaaagaagaagaagaagaaaaaaaccctccaaaacaaaagaaaaaaaagagaaaaaaagaagaagaaaaaaacatccagatatatatagccatactgcatactgttgtagctaattaagctatagcttggtaatccgcagccatggcgccggacgtcgaggcgcggctgctcgccgcctcctccaagccggccaccgccgccgccgcctcgctgccgcgccgcaacaagtaccccttcttctgcgccgtcctcgcctccatgacgtccgtcctcatgggctacagtacgcacgcacaccatcgatcacaccgtcggctagcctcgccgcgcgcgcgccgccgacgccgccattgacgttcgttgtttggttcttgcagacgtggcggtgacgagcggggcgcagatcttcatggcggaggacctgggcgtgagcgacgcgcagatcgaggtgctttcgggggccatcaacatctactcgctcgtcggcgcgctgctcgccgggtggacctccgaccgcctggggcggcggctcaccatcgtgctcaccaacggcttcttcctcgccggcccgctcgtcatgtcgctcgccggcgggtacgccgcgctcatggccgggaggttcgtcgccggcatcggcgtcggctatgccctcgtcatcgcccccgtctacgccgccgagatctcccccgcctcctcccgcggcctcctctcctccctccccgaggtcacccccattcatatcccaaacttcttttaatttactaaatttcgatcgaatttgggcaaaatagctttgaattttgtgatggtttttgtgtttttttgtttgttgaacatatttatcaatgggagagtgatttaattactaaatttcgatcgaatttgggcaaattagttttgaattttatgatgattttgtgttgtttttttttgatttttgaagatatttatcaatgggggagtgatttagttactaaatttcgatcgaatttgggcaaattagttttgaattttatgattgttttgtgttgtttttgttttttgaagatatttatcaatgggggagtgatgctgagctacgtgtcgaacttcgccttctcggggttgccggtgcacctgtcgtggcggctgatgttcgccgccggcgtggtgccgacggtgttcctggcggcgggcgtgctcaccatgccggagtcgccgcggtggctggcgatgaaggggcggcgcggcgaggcgagggtggtgctcgaccgcacgtccgacacgccggccgaggccgagcagcggctgcaggagatcgaggacgtcgtcgccgccgccggctccgttgccggcaacggcaacggcggcggcggcgcgtggaaggaggtggcgaccaagcccggcgtgcggcgggtgctcgccatcgtgctgacgctgcagttcttccagcaagcgtcgggcatcgactccgtggtgctgtacggcccgcgcgtgctcgccgcggcgggtgtggcgtcgaacaccctcctcctggggctcaacgtggtgttcggcgtcgccaaggcgagctccatcctcgtcgccatggcgctcaccgaccgcgtggggcggcgcccgctgctgctcgccagcacgggcggcatgacggcgtccctcctcgctctcggctcggtgttcgccgcgttcggcggcgcgagggacgacgcggcggtggcggcgggcgccgccgtcgccgtggtggtggcgttcgtgtgcgcgttctccgtcgggatcgggccgctggcgtgggtgtacagctcggagatcctgccgctgcggctgcgcgggcagggcgccggcgtcggcaccgccatgaaccgcgtcgtcagcggcgtggtcaccatgacgttcatctcgctctacggcgccatcaccatggcgggggcgttctacctctacgccgccatcgccgccgcctccttcgtgttcatctacgcctgcctgccggagaccagggggcggagcctcgaggacatggaggagctcttccacaccaagtgatgatctcatcttccatcaatgaatcaattcacatatatatgcatttgggttgttgcaacattttgaatggaaagtttgattctttcttggtaagattatcaaaggtttttcatgttcatttggctgattaattggtatactataaatttattattactgttgaaattgacatgtaaagatcggtgggacagtggatacatactggctgaatatggggaaaagagaaaagtttagaacggagggattttgtattatagaaagaaaactaaaacatgtgtgtttaattttgtaaaaatcctgtaaattttcttgacgagcctttatcggttggttttgctatttatcaggcgagccatatctcaagttccaagttccaatctctactactagtctagtgggtacagaaggactattttaatgggaggttaatgggaggcctaatttgggcatgatttgctatttgctctgctaaatttcggctttggtccatatagcctgtttatccacctacattcagcctaaaacaagtatactagaccattgaagctagatacgacaaaggcctaattttggctcgttaatcctctcaagtgggccaaatttcatttagcacgttaaatatcagaagcaggcctaatatgggaaaaagtacaccgaaggtccctcaacttgtcatcgggataaaaaacatcctcgaaccgcaaaaccagatatgcgaggtcccttgactatacaaaaccggtcacccaaggtccttcggtggttttgattccagttttggtctacgtgggccccacatgtcatgtgtccacgtcagcctcctctccctctttcccctcttctcacccttcctcatctctctctccccctcccttcgtcatcttcgtcaatgtcgcggcgaacccgcggctcggcgaggccgcgctccggcgggtcggcacgtcggctgcggtggtggaccagctggtggagatgctcagctggaacggcgccgccgaggccgccgccagggcgtccgccgcgctcgtcgtgtccaagctcgccagcaagaagcggaacacgctccgcgtcgccggcttccccggctccatcgagtcggtgttgttgctgctctacatcgccgacgaggagtgcaacctcctaggcctactcatcatcaagaagctggcgcgcgaccacgacaactgcagcaagattggctacgcgatgtatttgataggtggatgcacatgctgtcaaggaaaaaaccaagttccatcacaattgagttctcccgtgggaattattaaaagactccatcatgcctcttctctatcagtgatttggaatatctacagatagaaaagatgcatcatcagcttgtctcgagagtttgaaggttttaagcagctaattgttctgaatctgaaatatttctcctcaacaggcagtgacataaataatctgatctcctcatgccctcggctgaacacattgcgtttgaaacattttaagggtatcaatcgtctccgaattcaagctcaagcactacaggtttaagaggttaaagggtcctttgaagactttcatctgcatgcacctaacctgtccaatgtgtatgttacacttgacaaaacaaaagttgcagataggagtaaaaactatatgatgcaagcttcgttagactaactggaatagaagcacttgttatgaaaagatgtatggttgcgttgcctcagacgtttgaaggtttcaagcggctatctatcttgaatctgaaatatatatactcaacagacgcctcctcgacaagatcattgacttctccgccatcggcggcggcgccagcggcgccggatcagccgtgatcacgccgtcgtgcgccaaggccgtgaagcggtcgctgcaagtgatcaagatgctcgcggagacgacggggagcaccgggaagctgctccggcgggaggtcgccgagatcgtgttcacggtgagcaacatcgtccgcgccgtgctccagcacgaagccgggcacctcgagctgcagcggctcggcgccgaggtgcgccgcggccgcgtggggcgtagcctgccgccaccgccacgccttcgctttcactccactccgcatcgttcacacgccgcctccgccggcctcatcctcccgtccccgctgtccgccacggagagatcgagtgccgccgcatcctccagcaagtgccgcttcgatggtggctacgtcacccgctagccgcccgtgcagctgcggcccctccggctgcgcccacccacgcgccgttctgccgccccgcggctgcgcgcgccgggcgccgcccgtggagaagatagagagagaggggagaggtgaagaggagatgagaagaagagactgacacatggggcccacgtgggtctcacgctgactcagccatcgatggccgtggtcaaagcgccacgtaggacaaaaaccgggatgaagggacctcggatgaccggttttgtatagttaagggacatcgcatatctagttttgtggtttgagtatgtttttttatctcgctgacaagttgagggaccttcggtgtactttttcccctaatatggtaagcctcattaaaaggcccataaatagacactgaaggattcggcctgctcaaattagtaagcaggccaaatttcagcccattgtgaaatgtgaacaacgtcgtccgaaggccgaatttggctcaataagttcactttatgtctcttaatttgtcaccgagttaaaaatttatccctccaccgcaatatagggggggggggggggctaatgggcgatcggtcgcagggcgatcgcccagcgatcggtcccgccgccccccactgccttcttccttttcttcctccccttcttttcctattatagtacaccacaaaaatttttttaaaaaacaaaaagatagaaaaatttatgtataaacaaatttgaattcaaattcaaatttgaaatcggctatgtaaacttttgacttataaactttggatatataaactttaggtgtataaactttagatgtatagaaatactatatatgaaaaatatttgaattcaaattcaaatttgaatcggatatataaacttttgacttataaacttttggtctcaaactttagatgtgtaaacttgaggtgtataaactttagatacataaatttattaaaataggaaagtaatgcggtgctaaaaacgaaaaccagaggggggggggggtggagaatcgatcgctcgcccgcccagtagcatttccgaatatatgaccgtccctggacttgtaaaaccatatctactttcatcccaagataatatggttgccagtttcgttcaacccgtgctaaatcagcgtgggacttcctctcacctcgctcgcctctcttccctgtcctcaccaaccggggatgccagggcgcgcgccgcgtggatataggggtagcaccatgccaccatggcgagcttcctggtggcgtgggggctcgccacacggcagcctctcttcgtcaccgtgccactcggtttgcgtcgagttcgatctcgcacgggaagacggagttacaaggcgtcggcgccgcccaagaagaacggcgcgggagacgacgtggacgggtaggaactcgatcgacgcgcgcacgataagatcaagatcgaggcgcagtgtcgttcttgttctcgtagacgccgatgaggaagacgaccgtaccagaggtgcagaagtcgccggtgggcggtggggtcgaaccggtcttgctcccggttgccgatgccgtcaatataatgtacgtagaggttggtctgcacctgcaggtacggttcgccggtgacgttgcccaggaaaactcgaagtcgatcgaactcgtgtgtgcttgtccctgccggatgacagctgcgagccaaattcaatcacgactaaaatttagttttagctccggtttttaatattgcaaccgcagtaattattaattaatcgaataatcaggtgattagtgaagagcggctatctttaaagaaaattgtcttactgcacgagttcacctgctgctgttctttgtaaattggtctttggtagctttcccccgacagacatggctagctcgaggaggagcttaaggaggtcgctctcatacaagtgtcttgagctactaaaaattttagcgtaaaatttagatatcaagaggtactttcgtaaattttttcctacttcatttatattatcttttataattttcaatttatcaatttattttatgttaacataacaataaacactaactagtaaaaacactaaattcgaataataggaagtactaaatacaaaaaaaaaagatcctattacaagaaaattttcttggcagccaaaaaccgccaaggtaataatttttgtcagccaccgaccaagcaataaacaccaaggctagagaggcagggatatccagatttcttagctactaatcatgaggaaaagttttctcagtggtcaaatcaccaaaaaaaaactacagagattgcgaactttccaaagcgccaagaaatatggccttgacggtctataattgtactatatttatatgataaatttttaggacaatatttgtcgacaaatatatagatagtcccgatggggggagaggaaccattatattccaagaaacacccacataatcaacggggaaatttgaaggagaattcaaaatacgaagtaaatgctgagaattcaaacctttagtctgaacaatggcattctgcaggaggtggaagtgaatgcgaagaattcaaaatacgaagtgaatgctgagatgctttccttggcggtttgcgttcgaactaccaagaaaaatatagatttgtttgtcggttaggacaactcacaaggaaatcttccgaaccttggtggttctatatagccgccaacaaaatatgtatctacttggtggctagttttagccgttaagagttaagacaaagggtaaagttggcggttattgtttgaccgccattgaaatcagctggctgctaagaaaatctgtacgttttcttgtagagttgtagtacctactatactagtgagctcaatgattatcttagcttacttggtagttttcgttaagttaaaagttcaacttctcttggttcattataacaatgtgatcgagtcaagcttcttgtttttcatcactaatagcatatgtggcgccacgtgagatagctggtttgataaattatgtcagcttgatcattgcagcatttttgttacaggatgccatgctgttgcttattccggtaaacaacaagacctgttcaagctgtgctctgctggccatctatggcaagctcatgatctgtgtcaagtacgaatgtacaatccgcaaataattatcgagctggccctaaaacaatgtccagtttgtgcttcttttttgaacggcaacaacgtatactcaacacacccttttgtttttatttcaaaacttcaacgcttctctgagcatttccaaacatttacaatcggcaaaaaaatcgtcattcgaatcctaaaatgtgccgttgatgcaactacaaggaaaaccagctgagcttacacttaagtaatccaccaatggtagtaatgaacactgcaaaccaccggtgctgtagctgggcaaatattcctcaactctctctttttttaaaataatggaattctattttaaacttaatcaactttagcagcatttgcacgccatcaattttaatttccactatgatgcttatgatcactacgtaagtattaagtaacatgcatagtataaatataaaggaaccatgcaaacgatactaatatccatcaaagcagctagctagctagtgtaaaattataagtttgtaatcctgcttagttgcattctctgcctgtatagctttttactgtagtccaccattgcgatggaagtgccggagatcgcagtcgaagtggcgccggagatcatcatcgccgtcgaaatgccggaggcgatcaacaccaccattgtgcggctccccatgtacatgcaggaggcgaacaagggcctgttcaagccaagggtggtctctatcgggccataccactacggtcaggggagcaccctcgacatggaaactcacaaggaccgatttcaccatgctttcttccagcggttaggcaaccatgtcaaccatcaagacttgatcgctcagtgcactgaaggtgcaatgcagtgctacaacggcaatgttgacttcaggctctacaccctggagaagctcatgcacgacgggtgcttcattcttgagctcctcatccagtgggaagagggagagcatgcccatgtcgatgatcacatgcgattgatgtccaacagcatatactacgacctcctcatagtcgataaccaggtacctttcttcgttctcgctaggctgtttgaagaattcaggaggtacaacggtgaacatcctatcgtcctagtaaataccccgttggttaacctcatcagcaatttcttcaactatgatggccagttttcctgggttcattcaaacctgctgaatgaggatctccctaatgcaaaccatcgccatttgcttgagattcaatacaaccttgtcatccgcagaaacaataatagaaataacaatgatgagcagatgcattattatagttgcctgtgtggtttgtgcagcagaaacatttgccataaatcacctatgccgctaggaatccctggggcaaacgagctgcaagactacggcgttaaattccatcagaaagagaatcaccggatcaccgacatattcgacgtgacattctcgcataaaacgatgagcatccctcagttcaagatcaacttcggctccaagatcctactggcaaatctcttcgcctacgaccaaatcgctggccaacaagggagaaataataacggcgtcgtcgtaggtcccgtaacgagctacgtcgcgctcatgaacgcgctgatcaacacgaagaaagacgtgatggttctacagcgggagggcatcctggacaacctgctgtcgaacgaggaagaggtggcctccttcttcaacaggctcggcagatgcgccttggtggatgtcagcaaccaccgttacactggcatgttcgaagatgtcaacaggtactggaggtacggatgttgctgcaagcattttgtcacctttcgcatgaagcattgcaggaacccgtggacttgcctctcgctgatgggtgctattttgctcttgtttatctcattgatctccatgatctacaccatcctccaatactacaaccgtcggcagtaggattggcacttcgtgtgtctatgatcgcagcaatgcatccatggtgggagaatttactatttgccactctatcaaaataccagtgctcaaatgtcactctctcaaattttcattcccaaacgccaatgcgatccctacctgttgtgttatttattgccgttaattaaatgtctagctagtttgatcaagagacgacacgtacagaggagaactctcaaaattcagtagccatggaggaagaatcagctgattaatttgatcgagattgctacttggttcatcgcatgttcctattttaatttgtaatccatgtgtgagaatgtatttttaattcctgtttttacagccatgtatacatgttctatctgcttgtataaaagttgctcagttatggatcattaataaaagagattttctactttccatgcctaaaattttgtaaattattagtcacctagaattgcacattgcgaaatctaagttgcagcaatgtgcaattttattgatatacatatatgtttttactttattttttaatctaagtttgatttttgttcatgctattttgtaaattttcatgagttataagtttatttcatgtaatgttgtaattttttatgtgttaaagtatttattgttaagccattggggagagataagtaataaataataggggagttatgagaaaaattaaattatcatccagggaaaaaaataatgaaactctttaaattttcaagcgcctgaaaatttggcacccccatctgcatatatatgcctggtcggctgcgatcttttaagatcattctcgaattaatgagaattggtggattatctatttatttattgactgtaaggaagaattaaatactatctgccctatgaaaaataagtgatctaaaatcatatttttaaaagtctgggggtatataatctgataaataaataaaaaagtaagaacagtgacttaattattatgctaggctgattttaattattccctctgtccaaaatataggaacctgcgttcgaatagtttttttagtttttagacttttttattttttaattttattaatagacattttccaaaagtatttttaaatatgaactttttggccataccagcctatctggcgtggtcaaatagctttgtcacgccacgcgcagctagcatgtcggctggggtggccaaaaggttaagtttttgaaaataatttttgaaaatgtatgttaataaaattaaaaaatgaaaagtctaaaaaataaaaaaatttctgttcgaataagacatatcctagtaatatgaatcagacaaactatctagctagattcataatagaaaataatcagaaaagtaagaatggtgacttaattattacagtaggcttattttaattactccctatgtccaaaatataagaacctacgatcaaatgggatatatctagtaatatgaatttagacagactgtctgtccagattcataatagaaatgttccatctgattttaaatttttatattttgagatggatatagtaagctactcgcggcatgccaattttgtaaagggagtatcaaattcgacatatatggcacaaatgttccatgatcaatgcctgcaaattttgcttacgttggtttatcaaaataattgaccaatatgtgacgtcacatagatatagcgtcttaattctgtcagctaataatcgttcaccaatgtgtgagaggatacatgttcttatttatttttatttttctcactatggttgcttatttcggacaaaacaacaaaaacttagtattcaaaaacgttatatatatacatgctgacatgttgtgctctgcagcaccattcctggcaaacaaatttactatacgtatcaagtacgaacgtacggtcagcaaattattgtcgaatgtattaatttgactattgcagcacctggttttgcctcttaattttatcaaaagcaacaatgtactcgacgccgtgttgtcgttgttactcaacgcttgttgtttcgattattgcacaggacacaccacaacaacatttcttattcttctttcaattacacgtaagtgtgtaagacatatacatgtatacaaaccctgttaaggcgtgcacacatccatggagcgatccctaacacacgttgaaaaaagacaacaacaaaggaacaaatccttgatctcactaaataactattaaaagtatatccacatgcagtagtgaacacaatatgattaatttttaggaggtgccaatgcaaacataatatatatgtggtgggcaaactatatataagaaaaatataaaaaagataaatatatgaaagtatctgtttagaaaaaaagaatagaaaaataatggtttttttttacttctttatctttttcttccatcttgcaaacattctatttacaaaactgaagtgtgtaaagaatatacagtgggtttatccaacagtaggaggggctcaagcccaccttgctccttctttgggatcgtcacttcccatctacacgtgtgtaatattttggatatcagaattgaaatcaaagtaggtaaagttataacatatggttaattgcagaccccatgcatgcaacttatatgcttcactagcaaacattttaatcatatacaaatttacaattagcaaaatgaaaaacctcattcaattcaagtcctatcatgtacggttggggcaacttggccgcttatcgataagaggaaggatcagttgaccatacgcttgagtatgtactttctccaatggtatatactacctccatattttaatgtatgacgctgttgattttttatccaacgtttaatcattcgtcttattcaaaaaatttatataattattatttattttaatgtgacttgatttatcattaaatattctttaagtatgatataagtacttttatatttacacaaaaattttaaataaaaagaatggtcaaacgttgatcgaaaagtcaacagcgtcatacattaaaatacggagggagtattaatcaatacccgaacacatccagtggcgagcttcagggtctacagctgggaaaatatatattccttaacaaatttaatttgactgacttttgtagcactatcacgccataaattctattttcctctatgacacacacgattatgtaagtaacatgcagctctagccgtgtagcaccatgcagtgaacattaatccatcaaccaagcacatgttgcctgtttggctagctacctgggtacgtaagtttttagttatccaccattgcgatgaatcgagaccaagatctgaatgatgctgtcactacaacagaaataatttttccgggcgatgacccctgtacattgtagacaggccataattatgtaaatcgttccacgggagatggctcaaggacgcatacgaaataggcaagcgataataagtgcatcatcacaagctagagggaccaattaacggggctgtacgtgaaaatatattttcacaaagcgggcacatggaaggcacgtgggccccatgctttttctcgcaccatttttcttctctccatctttctctccccctttttctctctctcttctcacgcggtcatgccataactccttcgatctctcccactccctatcctcatgtctgcacccttcccttatcttctccggtgaccgaggtggaggcggcaatgacgaagactacgacaatggcaggcctcgagagtggtggatccaacaccgccaccatcgggaggggcggatctattgtcctcggcctcggtaggggcgatgatgatggggagcggtgacagtgaagctcgagggtggtggatcgagcaccacatccatcgggaggggtggatccatcaccctcggccctgggagaggtgacgacagcggcgagcaatgatggtgatcctcgaagtcggtggattcgaaaccgccgccctcgggaggggcggatccaccgcccttggacccgggaggggcgaagatgactgcatcgacgaagtcaagggggatgggaagctagagtttcggccgaattttgttttttgattttatttgccaaaaatatttttagttggctggcttaagcacccacatgcgaaaatccaattttcgcagacacctgggtacacctaggccacccgcacgcgtgcgaaaattgattttgaccgtatgaaaaaattgtttttgtagtagtgtatccaagcgcatcctgtggaggagattgctgtccaagtgaaggagcacatcaataccatcgtcaaggttcttcaaaggctaattttaaaaagtatgtactgggatgtaccacctttttcattataaaatttggtatctccaggtattaggtgccaattttttttataaaattaagatatcttaatatgctttctcaatgatcataaaatttctcctccaaatacatgcggaggcaataattagatctcttcgatctgagtctagggtgatctgcatcggcccctatcaccgcagtaatgagggtacccttggcatcgaagattacaaggagcgctttctccagggcttcttccagcggtttggcaatgtgaattttgttcactacactgaaaatattgctgcatattatattagcccatgcgtggatataaatggccaaacaggccgcccggcccggcacgaccctggcacggcctaataaaactcgaaccgtgccgggccgcctcgaaggcacgacagcccattggactccaccatggattaagtctatttatcatctctcaactctttgggatgtgttttatatggctgaaaataagcatattttgtatttctcttgtctatggcctttcttatatggttgattaagtctatctttgatccctctactatttttcttcgaccatgccgtgccaggccagcccaccgtgccaaggcatcggcccaggcacggcccaactatcgggttgtgccgtgcttgggccgggccaaatagtcatgcctttggccgggccatcgggcgttatgaccatctatacgtgtgggcgacacggggtctcaatattgaaagtttgatgctaatttacactttttatattggttatttatatattttgcgagaaataattgttttataattaacttttggccctttcgtcgttggcgaaaagccaaaatcaggtcctttcacataggacaatagccaaaatctaatgtaagtatgtaacgtaggaaattagaagtgcatattatatctctgaactttaagtaaagtctaaaattcaaccaattaaaagcttctagtccgtatactgcatgcaacatcaaacttctgttgaagtgcccggccatcgaaccatcagagtgataaacaaagtgcaaacggtttgactggcgacccaattagctagattttggcatcacctaacacgtttcttatatttcgaaacagacgtaatagtagtttataaggttcatgcgttgactggtcacaataacgtatcctttccaactctagtaaataacgtatcctttccaactctagtaaactactccatattaggttacttcatccgtctcaaaaaataaatttatttttcacctatctcacatatgccaataaaaaaaaatccctactttaccaaatcctaataaaactactttttactttatctatttttaatataattacctatactttcatagactctgatgtaatgattactctaaaaataaacttattttgaaacaaatggaagcagctaaaaataaacatattaaacagaggtagttggatttagggtgtgcatgtgtgttgactgttgactgcaagagcaaatctcccccattttaatttaattagagggaggatagagacaacaatggatatatataaggtaggtagggtggttaggtgacgaaagagctacctcagctttagagacttgagatcctaacttaatatcaacaagaagctagtaattaacaagatgaaaggggaagcaacaaaaacaaacttgactgttatcaacctagtttcccgtcacgttagcacgggcactaatagagtcggaaaagacgatgaaatgaagaggttggaatgtgaccgatcgcgaggtagggagagagtggg

SEQ ID NO: 73322 - DNA, 13896 bp, Oryza sativa
  unsure (1)..(13896): unsure at all n locations
ctgacatgtgggaccacaggggcatctccttttcttattatttttgtgtagctgacatgtaggtttcatgttttttattatttttctgagatcctattgccacgtaagcgccacgtcaatgtcacgtgggacgaggaccaagttaaagggagccacgtaggtgtcacgtcatacaaaaccggacacaatactaccaagggatctcttttgcacggttttataagttgagggacccgtcatacccggttttgcaactgagggacgaaaatcggactggacgacaaatagagggacctaatgtgaacttattccttattctgaggccaccaggcagcccatcatcttgggctccgcaggccaaattgacttctgtcgttgtccgatgcgccgccgcgcccggcctccctcaactcctcccggctgcctggcgacctcaccttccaaaacacgttcccttcttccttctcttgggcaaaacaccgctgaactcgatgccggcatattcgacaccggcaagctcaacaattgcctcctgctcggcgagcttgtctcgacgatcaggttaattatgaattgtcccttcatttcctacggatggcgatgccaccgctacctcactgtaccaccacctgccccctaccgcccactatcgttggatgaacggttggaatcagtagcatccattcaaaaacgactctcgttattaataactaacaatacttatcagtttaattattcaatatcgatatcaatacaacgctgagacaaaatataaaaatcaagttttatatatggttggaatcgataactaaatgaaatagtatcatttatatggaacgatgctcagtcgaccgtgactattttcattccctttcctaggccaacccaaccagtgcatcatttaaattagagtaaatttcactttagatcaccttttattaccgatgtttcgctttagactatttcttaaccgatgtattttggattgggtaatcttacctacgtggcactttggactaccactaacttttttatccatttacacccaacttgacatatatcaatgttatacacacaaccatagaaattcattgattagtaggagccgacatactcgaaattgttcatatgcttaagtagagagttggggtggttcaaagtacaacaaaggtaagattacctggtctaaagtgaaaacatcggttaaaggtggtacaaagcaaaacttgacaagggtgaccaaagtgaaatttaatctttaatttatagacttgacaagggttcttatatttacggctaattatttttttattggtggcgacgtactcatcgatagcatggtgacttcatcaatatgaaaatatgccaactcaattttcaaaggtactcatcaggatatgatgtacgcgtgtgttatgagagtctatgtttaagtcaatttgtaccgtgcttcagaaaagaaatgagaaaaaaaaagagctagtgagcacgagggccttctaaaattcgagatctagacctatctacttaaaacggtggataataacctagctcggctcgtttgggctcatctattatctatatatctattatatactaaaagtccataaatcttcctacaaacgctcctaaaaacgctcctaggtttataatctcaccgtcgattttcatttaaattgatgggtctgttattttagtccattagattaaatctattgctttctcttaatattcggtagatacgagtgaaaccgttcacacacaaaaaaacttacgtacttactatggaaagaaacgaaaccttcagcatacgtacgcacgtacgatggcatcgtgtgatcgcacgtacagtactgttcatttgaaaaaagtacctacttacgataaatagctatttaaaaaaagatactgttcgcttgaaaaaaaattacttccatatgcacgagtaaaaataaaagctataaaaactaaaaaaacatatgtacgtcggtacaagaaaatagacgattttttaaaatagtattttctatactatagaaataaaatttattactccacaaataataagatcatgtgacgtttctacaagcactcttacaccaccacatgcatggctctctataattttgctatcaattttcatttaaaatgatagaacattagattagcccatttcctcttaatttccagggtatacaagagaaacgatttagggaatgtttgattgaaaaaaaatacaaagaaacatacatatatacgataataaagcccaaaaaactacaaaacaaaataagactttagatactgtccctaaaaaagtacgtacggatacatgagtaaaaataaaagctataaaccctaaaaatgtatatacgtcagtaggaaaaaaaatgacggtcttttaaaaatacgattttctatactataaaaacaaaatttattactccacaaatatgatcatgtggagtttctgcaagcactcttagaatgccatgtggcactctataatttcgctatcaattttcatccaaaatgatggatccattattttagatcattaaattaactcacttcctattaatctcctacgtatataggagaaaccatttactgaatgtttgattgaaaaaaaaatacaaagaaacatacgtacatacgagaaaaaaatatttatcagagtacgtactacgataaaaaaagctataaaacaaaataaacctttagatatattgttcccttaaaaaagtacgtaatagacagtctttttaaaatatgatttgctatactataaaaataaaatttatcactccacaaatatggtcacgtggcgtttcaccaagcactcttagaatgccatgtagcactctataatttcattgtctattttcattcaaaatgatggacccattattttgaatcgttagattagcccgcttccttttaatctcctgtgtatacgagagaaaccatttaccggatgttcgattggaaaaaaaacaaagaaacatacgaacacacgacaataaagctataaagcccaaataatactaatataagttggcagaaccatcgaaaaaatatagacggttttcaaaataggattttctatacgataaaataaaatttatcactccaaaaaataaatatgcaagttaaactagatcaatataaaaaacaaattaaatgtgtttaaacgctaagcttttagattttttttaaattttatagtcaacttataatcaggtgtaatatcatagttatattatagtgctaaatacattacaacacttggagctaacatataataataagtaatatcataacacttttttaaataatttaggcggcatataataattaatgtcatgataatcttagaaataatttcacatcatattttatggtcaaatataacactaactgaaatctacatgcatggaaaatgaaacaacattatgtttttaaattatatctgatttaattttagtttgtctgagattgagattctcaaagttttttttcataactactggattggtatgctcaggcaatgatcttgctataatacgaccccttaatccaatataacggtcataaaccacagtgacgtaactataagtgcacctcaataaattagttattataaataatttcataaaataaatacaattttagaattagtaaaggtgtctcatgttataggtgacgaaaacaaacaagatgctaaaaatatagatctttgtcaaaatatacaatgatataatactctgaagattgtcacagtttgtttagctatatatatttttagtgattaacttcactcatttctaaatattacattatatttgtaccataaaaaattaagcagttttgattaacaccataaacaaaattttgtctaaacaaaacataaagaaactatattttatattttataggaagaactaaagaactatttgcatcatatccatcttctctttgttcccctagagggcaccgagcatggataccacaagtatagcatggagcacatatatggttgagttgaggcaggcccaatggaggccaccattgataatagtgctcaacttcctacttactaatggaattatctctgagggtgccgatagtgaactaggattaattaaaattgtgctccacactggtcgtgagactgtgagaggcatgactatgttgacccatgcttgaaggaatcttgatggttccacccattagaggggcatgtctatttttttaacggtgctatgctaataaccaatagaagcgttagttttagaatatttattcgtagatttagaaataagtgttgacataaacatttaggtacatagttgaaagaatgttttatgcattaatgatgtattagacttattttggtggtttagatggagttccatttattaaaatcatatctatcttttaataacaatgataatggtgataataggagagtttacacttacctggacaaaagtgaattttgtttgaatctaagagacatccttattatttatattaaagtttgcggtctatttcacaacatattgttttgttactatgaggcaagatctatgatttgttatatgtatatggtaagatatgacttaattctcttagtagtatttatataaacaataaataagatgcccgcgcatctgcgtgggcttcctttctagttatcttaatgagccaactcggattggcttattaaccttaacgagctaaaacactagctccactcgcaagttagttcattaagctcattaggctcgttaacgaggtctatctcattaatatcaacttatataaatttgaatttttaattttatcatatattaacaaaataataaccactaattaataaagaacttaataaatacattttagtttgcatgtagttaaaagactaaacactagttcttatgtgttaaaatcctagctcgatttaacttgttatgattttgagttaagagatccgaactgaattcaatgcaagctgattcgagtgacaaagcttctaagtaccaccttgacctctgtcctataataattttatttctatgatttaaatttgttctaaaatagttgtcacaatagaatatactaatgatcacattaatcacttctagttcaaatttctccctattatgatcaactactctcctactttaacttatatttcgtacatcatttaataaggagtatcatagtacttcttttcaaatattaacatatgctaaacaatctaattaaaattataactattttgagacagaagtagtaactttttttcccccacccctaccacccacacctttgagaccaaaagacagtgagagtgcttctgccagtcatccggggtactggatcgggctatacaggatttgttcaatctcaccgtcacgcgcgttgtcgagagaatttgtacttgtttatagtttcttcttcacacttatacattgagcgcatcacagcggatttgatttgcatgtactgataacgattccttcttttgatctggaatatcttttaaaaaagaacagagtatattatccaaattatataatcccatgagtgtcatgcgtgtgtggcagtaggggcacacataggccccgcacggtgctgcccaatccaatcatttgaccattcgtacagacccataccatggacatactttcctcgtaattaaaaaaaatcaattatctacgtatatagttaggattaatttttttagacgaagatagtaaatacacacgtgaggtggcggtaggtctccagcaagcaaacaacggtgagggtggactccactactccaacgtcccatccacggcgagagcgggccaacaatcagcttggtggctaacagctccaagaagaaagtggcacggctaggtgtgtgggtataagtataactatcttttcgcccttaaattaacaccatcaaactaaccgtcgaaaccagggtaaaactctgcttcgttttcaaaaaataagagaaaaatgaaaccccataaagtggaaacaaaacataagttaaggttgaaagtagtcagcatggtgtaatcgccccaaaaattaaaggacagtactgtagaacatggtttaatttttcggtttggtcgattctacacgaggtctccgatattccgaaattttgaacaaatgtcggtcaaatttgaacaaaatattactaaattcataaaaaaaattgaaaatttaaaaatttcagccaaaataatatcataccgggagggtcagaaatgactgaaatttcattccggaattttgagccctgcagcagaatccgtttccgtggacagttggtgtgcgttttccccacggagcatctgcgaaccgcgaccaacatccagcttcagcctgtcacgctgcggatgggaatggttaggttctggattgaacctaaaccatttcacgtgaccactctgatccatggttcaatagggacaacccttaatgatcccattaaataaataggttatccaatggagcaaaaggttaacctattgaacctagcagacaacatttaattcacatgttcatggggccacacatatacaacacaatatatcacagacgcaaaggcatcccagggctacatttaagatatatgcaaagcagtacatccaatggctaatttttcggcgtacggccgtgtgactcacctatttttcggccgtggccgtaccggaaattattttctccacggcggcgaacgatcctgacgtcgcgcgtgctgtcacccacacgtaaagaaacggaaccctttgagcgtcgtcgtcgtcaccggattcaggatcacacgtcgggagggagaagggtagagataggagaacgagctggaaaaggaaacggagttaaaagtgagctccgcttctcgcttgaccctcaaaaaagggtaaaaaagaagaaagcgcggatgggccccgccggctttgcaccacttcaacccggtcaaatcttatccagatccagttggagtgtaattcgtattttttttctttaattaataattacatattatgaacaaattttatatgaatgaataaaatatactataaattaaaataacttagagcaacttatataattaatgctagcatcgaaagtttttagaaaagaaatttaaaaacatggcgtgaataatacatagtaaatccataatgaaaagacgtagcatgcgaattggcgtcagctggttaggatatttgtggtggaaccttcccacctggatttaatttgtagacttgaaacgggtgtttatgtttgcggctaactattcttacaatgctagcaacgtactcatcgacaacataatgacttcatcaatctcaagatatgccacctcaatttcaaaggtgcttataaaaatgctgtgtgcaagagtgtttatgagtgtccatgtttatagtcaatttgtgatgtgcttcgaaaaagaaaactagaaaaaagagggagctagttggcaaagggccatctaaaattctaggtctagccctacctccttaaagtggtggataatgagcaagttaggctcatttgagcttattacattaacgagatagctcggatcggcttgtgaaccttaacgagctaaaacactagttctgcttgtaagctaattaggctcgttaacaagatttatttcatttataaacctttagaaatttgaatttacaatgttatcatatattaacataataatacactaactaataaagaactaaataaatacaatgagtttgtatgtagttaaaagactaaacaatactccctccgtccttaaaaaaatgaatctaaaactggatgtgatatattttagtacaacaaatctagacagatgtatatctagattcatcgtactctaactttttttcctctcacccctaccacccacaccttccagaccatagaagatagggagagtgcttatgccagtcatccgtactagatcgagctgtacggattcgttgcgctaggatgtgttatatttggtactagattggtttttgtcgaatggaggaagtaatttttttcctcacacttctacattgagcgcatcacagcggattgatttgctggtactaatcgttcctagccttgttcaacgattctttcttttgatctggaatatcttttcagaaaagaacagtatattatccgaattactccgtatctattcccatgagtgtcatgcgtgcatggcagtaggggcacacacttaggccccgcatggtgccatcatttgcccattcgcatggaccagacaaatataagtctactaattccctgacaaaattttgagtattaaatatagataaaaaaaataactaattacacagattacgtgtaaattgtgagatgaatcttttaagccgaattgtgacatgatctgacaatatggtgctacagtaaatatttgctaatattgaattaattaggctaaataaattcatctcgcagtttacaggcagattctgtaaattgttttattactagtctacgtttaatacttcaaatatgtgtccatatatcatatgtgacatgccaaaactttacacccctgaatctaaacacagcctatgtaagggcaagtgctatggtagatgtgactatcacctccaaatttatctattttattcactcatgaactaagaggcaacccatataatgtatcacctctagtacacaaataccaatatatctaatactctcacacctttcttgaaatttttgtggaggttgcctcttgatttaggggtggctcatcatctctctcctcacttcttttcaggggcggaggcagcattttagcaagagtagggctgaaccatatagctataaattttttgtgcaaattctacgtaaatttcagtgtttctccattaaaaatttttgccacgtgtggggcccaagcccaagctgccccacacatggctccgcccctgcttctcttctccacctcatcactcaatccaatgtgacacttttaaaggcaatatatggggtattatagtatttgccctaattctacctgctgaactggatcagtgacgtatgaattctcttgctataggattgagccaccatctaagggcccctttgaatcgcagggtagaaaaaacggaggaataggaaaaacacaggattctgacaggaattgaagtgtaaaacagaggattgcaaaatacaggaaaaacacaggaatgatcgtttgattggagcgcaggaaatacgtaggaattagatgagagagatagactcaaaggaaattttccaagaggttggagctcttgctaaatttcttccaaaatccacatgcagtatgccattccataggaattttataggatttggaaagcttcaatcctttgaatcaaatagccaaataggaaaattttctataggatttaaatcctatgaaatttctacataaatcctttgattcaaataggccttaaaattagagtaaaatagagagtagtaatattaatcgcagatgatctagtatttcccacggagcatctgcgaacagcgatcaacatccagcttcagcttgtgataggcccatgcagaagctgaagccgcatgctgcgcgagaaacccctcgtacgagtggacgacgtgcggccgtgtggctcactcatttttttttcgcccgcgtggccgtgccggaaatcattaatttattccacgtcggcggtctcggctgcgaacgatcctgacgtcgcgcgtgctgtcacccacacgtaaaaaaaaaaaacggaaccccctccctctggcaggaggcgtcgtcggcatcgtcgtcaccggattcggaatcacacgtcgggactcgggagacgagaagggctgtgtttagttcttctaaagttgaacgttttggttaaaattggtacgacatgattgaaaagttatgtgtatatgacagattgatgtgatgaaaaaagttaaaagtttggatctaaatacagctaagggcagagagatagaagaacgagcttgaaaaggaaacgaaattaaaagcgagctccgcttctcgcttgaccctcaaaaaaaaaaaagaagaaagcgtaggtgggccccgccggctttgcaccaggtcggctcggtcaaatctcatccagatccagtggctctcgcgcggggcatcgtcatcgctcgcggcagccgggctcttctctttttttcctttggtctttgccttgccctgattgggggagtgggggatccggtctccgagacggcgacttatcgggtgggtgccttggcgtggcgacccgtgcccgggaacgaatccaacacacttggctagctgagctttggtttgttacgtgcgtttttttggggcggctaactaatgaataatgacacgtgatgatgcactatttcaacctagtaatcattaagtacgatccgtattaaattatgaggttagtggctagtatctttgattgatccaatttgtcgctaataaagagactctatactactttgttttatctatctatatttttataaaattataatcactacacacctaaaactcaacgtgtaagcatagtactccgtccgtcccagaataaagcaacttaggactcaatgtccagatacgtagtaataggatacgaaacatgccagcttgccgcatcaacccactaagcacctaaacttcaacatacaagtatagactatagtaattaaatttataatttattacattctaaaactcaaaatacacatgctaaatcattttcaaaatatttcaatccaaattcatccgttattatacaacatttaacatatatccatttatatatcccacaacaaaacgtggggtgccatctagtttataaggattgtatgcagacatgttaggactacaaatttgtacgcaacaaagtccataatgtgcacaaataagttaatgttaatattgtatttcaaaattattaggttaagaaaatatgaaaattaagactatcaaagtatgcccgtatttgccaattcaaattttggtaacggaagaaagccaatattaaaattcgaaggaaagtaaaactttgtatttatttgtttcggatttcctaacaaaaagctaaaatcaacaaaaacgattcgataatggtttaatattagttatgcaaatgtatgcaacattagcccttaattaatgccacgtaggtgtatcgatcgctatattgccataatcttttcatccacttggtatgaatagttattgaaaagtattttagttgatagattctcttttcgttctaaaatatatactccctctatttctaaatatttgacaccgttaaccttttagcacatatttaattgttcgtcttattaaaaacttttgtgaaatatgaaaaactatatgtatacatataagtatatttaacaatgaatcaaatgataggaaaaaattaataattacttaaattttttaaataagacgaacggtcaaacatatttaaaaagtcaacggcgtcaagtatttaaaaacggagggagtagcaatttagaattggatggaagatattctagtattaagcttatgtttagatttgcattaggatatatcttatctaagcttaggttactatatatattttagaacggaggtagactacacatatcatactcatcatgttcacaaagaaatcaatgataaaatactttgatctcactaatttccactaggaacttttccttgttgtaatgcgctatgcgcacaataactttggtagtacaccaattttttaatcatgttttatttgtacatgcatgcattagcgagctttaaaatattttttctcttaaactatatccgatctacgacctgatcacatagttgtattaattataattaaatctttaaaacaatatatcatatgattatattccgatgaaataaaaacaaatatttcaaaccgttaatactcaatattttatagacgaacataatgtttaaaaaaaataaatgtttcattgactgtttattttatttcactatatatagcataatgttttattgtgatcaactaaaatatttgaccgtcttatacttaaggtttgtttagcacatctccaactccacctttcatagagctcagccaaatagtttcagttccatttaaaatagaagcaaagctaagtagggctctctcatagagtgagtggaactgggtttagtcagctccacaactccactccagatccaattcctttatttaagggcctgtttggtatagctccaactcctaaatttaactcttggagttgggcctggagtggaattgtggagctgtctaaacctagctccacaactctagttcattttgtgagagagctccacccagcttaactcccaatttaggtggagctgaaactgtttggctgaactggggtggagctggagctgaagctgtgtcaacatgccctaattttatgagttagagctctacgtgctcttattatacagccttaaaagaaaatcgaaatcgtacacttgttctgtagcggatccgggctggatggacgcaaacccaccaccaccaggactgtaccggtgtagccgttaattaattaacacacgagacgagagtacgagacgagaccgccgcgaacctgcgtgccctgtgtgcgtgtgctgnnncgcccgtggccgtgcgtttataaaattacgcgctccgcctcgccttctttttccacacccacaccaaccccagccctaatcaccaccacccccccatcccaccatcgaaccgccaccaaaaaaagccgaagctcgctcgccgccgccgccgccgccggggacttcgccggagggaggagaagccaacccgcccgcccgcgcgcgcgtacgtacgaggtgaggcattccctcccgtccctctcgcgacgtgtcgggttgggttcggcctcttgtgggtggagggctcgagatcagggagctcgtcgtccccgggtgcccccctgtttcggccgggatgttccagatcttagcgttgctgggttggaaatttttgagtggttcggggatggtgatgtgcggtttgctgatttttttggtgctctccggcgtttgattgcaggcctgctccttccgtcggaagggaagcatcgggatggcgtcgatttcgccgacgtcttcatcggtcgccgccctccgcggccacccgtgagttctctgcttcctctctctctcgctgctacgccttgattgtgcttgcccgctgcctttggagctggttacacttccggattctttccggctcgattatgccttttgctaaggcctcacttttttcttttagtgttttggttgatttgacgactggtacactagtttcatgtcagaatctgtttgaagtgaattagtaacgagcgagctgttgagcgaactacataatacagttgaaatccggtcgtaagaacctttgaggaatgactgtaaaatatactagttttactcattcctttttaatgagaatatataggggtacttaaaataagagtttatatatattaattgctgaatctgattgattctactcacttctgtttgtgtaaatgcagggtgcagttcgtgaaaggcggtgcagtctccaaggaagcaaagggatcaatttccttctcacccgttgcgaattcaaataatgccaatgtgaaatttacgggcttgagggtagcagcatcattgaaaagggatggtgcttttccaggcgacggttactcagggaatgataacacggtgttaccaaagagcacttctgttcgtggccaggactatccaactgctgactctgtactcccaacggaatccatcatcgtgccagaaatcagtaa

SEQ ID NO: 73323 - DNA, 684 bp, Oryza sativa
taatatgaaaaacgacttatatagcacgaaacaggaagaacatacagcgcattgttgcttacaatgaagcacacagttacactatcctgagcccacatatatatatccgccttcactttatgtacatatatggagtacctacagactacagttatcaaaccaattgcttttgcacctatagagtcagagatcaggatgagtagcaaatttctcgccatgtatctcctgcttgctctcctcagccatggcacctacagctacagtgccaccacagcttcaggctgggaagaccaagacttcttcaggcattgcccagtgtcccggtgcagcgacggtggaccagagatccggttccctcacggcctgcaatccagcaacacatcatcagcatgcggcgcttcatgcgccaagctagcatgctccggccaagacaccatcctacatcacccatttctggggccttgcaaggtcacctccatagattacaaggaggccatcatgagcatcatcccgcttgtgtactcctcgtctccatgcccgcttcagaagctcatctttgacaatctacagccttacgactaccatagatgtaaattatacagctgggctcctgcaaaaatagtacgctgttcaaaagagttcacaccaaatggtacttctccagtcgatgggggctgcaggaat

SEQ ID NO: 73324 - DNA, 23272 bp, Oryza sativa
tccaccgttcaaattaatctgatggataggttctcttcccttatttctttgagtaaatttcacaatatggttcaaaatccagaaaaccacacacattttgatatttggcacttaagtattttggtagtttagtttcacaaaaccacaccatcgatgaatggattcacccgtgagatgacgtggttgttctatctaggttgaggacgtggcatcctattaatttttcgtgcgatggctggtaataggatgtcatgtcctcgtcctaggtgaaacagccatgttatcccgtgggtgaatccattcatcgatagtgtggttttatgaaaccacacaactaaggccatgtttgatttagcttagaattattataatctggattattaagagtaagctgaaacaaacaaatagattattatactagattattataatatataagctagattagtataattcaataatctcctctagaggagctttttccagattattgagtggctaaagatctactacccttagatgcctctaataatccagagaaacaaacaacacgtagcttattttttgttagcttattataatccagcttagagtaatctgatttaataatctagattacaataatcttaagctgaaacaaacagggcctaaaatatgtgtacttaagtgccaagtgtcaaagtgtgtgtggttttctacaacttgaaccacaaaacgtgtagttttgtgaaatttactctatttctttcaataaaatcaagagtaaattacactggcggcctttataaacttataagcaggtttcacgtaggtccacgaatttgataaataaatatgttgcaggatcaacacatttatttattttgttagttgcaggatctccgtcccgccattctctgcctcgagcttctcctctgtggacttctcttccatgcgcttctccaccaagctcccagacgtccccacaccaccgacccgggaaagagccatccggtgaggaggaggagattgtggaagaaatcccctgtcgatagtgtgcgctgccgtcgacccattatgtccttccccctcaagccgcatggttccagggtggcaaggaggaggccatgaaggttgggtttgacgatgccgccgacaaggccgactcgatggccatgtacaaggcggggctggtttctcctagagaaaatgtaggttaatagttgtatcctctagccccagacttcaggacaggatgtaggtagtcattgtgccctgaagtggagtagagagttgaacttatcttgtttttgagccgaatagcccctgactttattttggaatgacagtaggagttgtggcatggagttgacttgattattgcgttgattcttgcagaagattgtcgatcgctctagtgccaagagagaggctctacagagcatcttcgacaacgtgacggagattgagtgcagcgggtcgagctccagcagcagcagaaggaggcgaaggagtggcacatctggagaaggagctatgggtctcctgacgaaaaatccgcgctcagccgatggtgccagatctatgtagacgcgacctaagtcaacgaacacaaaggcctgggagatctgcttacctttagtgtaagtccaaaatattgatgaggtgcgggcgtgccagtcagttcgatcctacaactaacaagataaataaatgtgttgatcaccaaagagtcgattggctgacaagccgatggaggaattctagccgatgccgatatcagtcgacgtcgatagggttatgagcaatcggctatatgtccaatgtagataatgatataaagacaatcggctgataataatataataaaacaacaatataatctagtagaaatcaatcggctaataatgatatgacaaaatgagtgttgatctaatggttacagcatatatcggttggaggtccgacgtcataaaatctaaatgattagataatcaataaaacctctgttgtaatcagctaaaaccaacttgtacataatccttataagccgatgcaacatccagataacccaacggctaaaactccgatgaaacccttcttggcaatcaagaagcaggctagagattatggttctaagcacgacttagtagatcaaacttaactgatgcaacactaagtatgaaaagaaacataatatccaaacaatcaagcctttgactgattttcagggtggtgaatacattagttaatctaatcttgcaagatgatttagccgatatcggcataaaccctaaaaaggatctcaatcgatatgatcaaattaagatgctaagctagattaactaagatatatgataaccagcggctgtagaagatagattagaacatctaaagcgacgccctaatccaccaacgcaaaccgctgagacaagtcatacctcttgttagaagaacgaagccgatgcccttactcgaagcaagaactcgtcaaaaaagtagaaaggtaaaaggtggcgatgtgccaaagttgtatcgatcgagacaaaaattacaatgaccccgggtgtacacatttatacccatgggtagatactagtccttattagacaaaaaaataaacttttctaaagataaaaggaaaacataaagtccttatcgaacgctaaacacacgttcctaaagataaaaggaaactaacaaactcttcctaattaatagataaactaccatgccacatcctacttgaactcggtctcttttggataaacttcttttaattgataaatttccttaaccgaacccatgaagaattcgactactgacaactgatggtgtccatcggccgattccatgactctgaagctgatacttactataggctgatgataacttcgggacttaccaaattttggcgttaagagggtccaaatttcccagctgaggagggatggtaagatgctctggccaagtgatttggtcttcgtgttagtctttgtgatgatgtgtgcctatctgctgttgtggatgaacaggggagatgcgcacgtgaagcgaccgagtggaagaagctggtggaccagcctaaggcagctagcgggcgagctctgatcattgagctggagacgtagttgcaggaggcccaggaaggagcgcacgattttcaggccaagctggatggtgagtcttgtaaatgttgcttctggctattctcgtgttctgctgctgttgatgtctgtcatcttgacaccatcgttagccgcgtccgagtcaatctctgccgagaaggcgaccctgtcggatgagttggtgaagaaggacaccacacagcgcaatctctaggcggatgttgagctgcgtgcgaaaaatactcagacacattatgagcacttccagcgggaattggacgccgccaagggtcttcatgaggagctggtgaagtcagtggagcccaccctggagctgtttttcccttcccggtgtaagggcaaagatcttgtgcaactggcaacagagctggttcctgaggggccaactgctgttcgtcggctgtctgagggtggtggcagggaatgtggcggtcgccgcgaaggtgactccgtgagtttccatctcctcaagaaaaatgatcgagcgaccccacctagcgtgctaactgtcggtttttaatatcggcaatattatttatgggtgcactagatctaggagagatggtgacatagatgtttatattggttgaaaccctcaaagcgaggtaataccctagtccagttgtgagtagattggatctgtataagtgcgcatctgttgacgagaaatccgcgctcggccgatggtgtcgggtctgtgttggcgcaaactaagtcgacgaacacaatggcctaggagatctgcttaactccagtgcaggtccaaaagttgatgagatgcgggcgtgccagtcagtttgatccggcaactgacaagatatacaaataacagatcaaagagccgatcggctgacaagacaatggagtaattccagccgatgccgatagggttttgagttatcggctatatatttgatgtagaatctgacacttgatataaacaatgatataaagacaattagctgatggtaatataacaaaacaaccatataatccagtaaaaccaatcggctaacaatatgatagaataagcactgatccgaaggttaaagcatacatcagctggaggttcgatgttattgaatccacaagattagataaacagtgaaactttggttgcgatcggctaaatccaacttgtatgtaatccttataagccaatgcaacatccagataactcatcggctaaaaccctgatgaaacccttattggcaatcaaaaagcaggctagaggttatggttctaacttctaagcacgactagggctgatgcagcgcaaagtatgaaaagaaacataatgtctagataatcaagcctttgacttattttcagggtagtggataccttagctaatctaatttggtaaagcaattcagccgataccagcataaaccctaaagagaatcccagccgatacaagtaaattgaactaccaaaatagattaactaagatatatgatagatatgtgtttacattgacaagatcggagtgtcgaagccttggccccggcgatgcaaatagccatgacaagtataaacttgtcaaaaaaagtagaaaagtaaaaagggtggcgacgcgtcgaatttgtattgatcgtggagatagtttacaatgaccccgggtgtacatatttatacccataggtagatacgagtccttattggacaagaaagaaacttttctaaagataaaaggaaaacataaagtccttatgggacactaaacacactttcctaaagataaaaggaaactaacaaatactacctaattaatagataacttgccatgtctcttcctccttgaactcggtcacttatggataagcttctgttaatagattaatttccttaactgaatatagcaagaatctgactattggcaacttgataattctcattggccaattccagaactctgaagccgataatggttttaggccgatgactgttggtatttcttagcgacactgccggaaatataattcccagcaatagcactagaaataatcctggtatattatagttacagatatgatccgcaagcatacggatataccattgtagcatttcacccgggagtattccaaggtatcgtatttattttatcccaagggaagatatgataagagattactatgctaacaattcatatattacttatatacatcaagtctatgcaggggttaatttagttcaaagggtagggtgacacacagaagaaagaactaagaactactctcactaaaatatagtctaagctaaatggagaaagaataataaaagtatcattcctgtacttctagtatatatacatctttaatctatacttactagtatacaatcatgcaaccaatacctcgtacccagtgtcctcctagtgtttcgagagaccgcccctggttgccgagttccttacgacaacctgtcatggccatccaaccggggctaaatacggaggagtaccctccccaggaaattgcacttaggataatatacacatgtagaggacacctgcactaatccttcaccatcagcggccggcctctgatccactgtatattaccccaattaatggtatctaataatctaagcaccgtgcttacattactaaatattactccaattaatggtatctaataatcaacatgctcaaggggaatgtgtgacttgcccttcttcttcacttcgatcttctgaactcttttcctcacgaccgcggacttctgaaacggcgcaatatactcactagcacgcaaaacgagaaaaaactctaataaataccaagtaaacagtacaagaaaagtaaacaaacatgtagatcttggttttagatgaattttgcaacttgaatggctcaatttggagttcgtatgaattagatatgaattttagaagttttgagccatttaaataaatttctagaatcaataccaatttattgcgcaattattatttatttttacaaaggaaaaatcaaggattattgcgtcagcgaggggcgggtgtggaccgagtccaccaaaggcgggcccacgcatcagccaaaaggggagggacggtgcaccgtggaccgggaccacggggtggtccacggcgaccaacagtaggctggccacgcgggcacacatgggaccgaggaggggaaaaaagagaggagcaggagggaggtggctcaccgagcgccgaagcagcgaggaggcgacgcgggaaggcggccgacgacgaggagaggcagcggcgccccgcggaaaaacagcgcgagcgaagcaccgacgacgaccggcaggtgaggaagggcggccgagcacctcctcgacctgtagaatgatgaggaggggttaggggaggatggggtggctcaaggcagcgtgaaccaccgaccggaggggattggaaaaggggtagctcaccggtgcgcgaggggaaatggattccagtggttgggacgcgagctgggcggtggccgagggtctcctcgtccttgcagaaccaagggaggcgacgacgcagtgcggggtcggccggagaggtggcgcggtgcggctgtagttggcgatggtggcggagagagatggtgaacgtggtggcggcgtttcggaaatggattggggaagaggagcagtggacggggtgcggtggggcgtggcggcgctgtgggtggcggcgacatggccgggcgaggcgacgctcgccggcgggaggcggcggtggctcgggttggtggtggcggcggggtttcagcggcggtttggggaggggaagtggtggccggtcttgccctccggcggtgaagccggtggtggtggcgtcacaatgcggcgagggttagggcggcggtgacaggcggttggaacgcgccggcgggcggcggagggaggtgcgacggtagcggggtggtttccgggcacgggagagctcgggaaaatggggaaacagatgagaagggcacgagggtgctttatataggctcggggagctttgatacggccgggatgggacgaattttgggcggcaacgaccggcgacatggggtggcgacgtgggctcgtggcgggtcaatccggcgccatttttttgggggaaagtggggggaatggtggaggagtgggcggcgaccacatcccgacggttagacgcgagcgcgagggacaggaggtggcggattttgcagtggagtgggcggccatggcgggcggctgctctggctcgagttggctgggggttggggacccacttgtcggcctgaggagaggggaggccggtttgagggagggggaacaaacttggaggtggcgggaagcgagctgggccagcccgagagaagtaggcgagcggcctggccgggaagagggaggagggcttggaccgaaaatggcccaaggggaacgaaggagaattaaatttgtttttctttttatttaattgattaaatgatctttgtgatattaaaattacttcttgagctccaaaaattcgcgagaaattttaaagagtattttagggcataaagaacattacaaaatattcatggccatgatttttaaaggaaatttttaattccctcattattttacttaacttttaacataactagaaacaatgcccgtgcgttgcaacgggttaaaactattttaatcttattattgttatatggttgagttaggatgaattcattgtgtggattcgcttggatttttatttttagaaaatcatgagctgcaattaggagtttgacttttatctcaagttagcatccatgttttttaaagagattccttatacgattagttttgtatttccagaagcaatgaacttaaaacccaactgaaacaaaaataacgtaccaaagtactaataaaagcatatttaatttttataatagtagagatagaggtatgccacgctattgtctcccgttaataattttcagtttttatttcttttcacgataataggaggtgatcagatatatttgcagtttttatttcttttcgcaataataggaggtcaacagatatatttactcgttaggatctacttaattatacttgattaggccaaaaaagcaacgatgcagccatgcacatgcaggccatctccatcggtatttccttccaatctaaccaggcgcacatctcttccaatctctacggagtacagagacaagtccatctcgcttgatcgtgggctcgtggcaatagtaaaactgaatcggagtgggtgcttcggatgaagcgaaagggaaacgcatgtgaacgcttaaaaaaaaggcaacgggagcatttggattcgatggcgatgtacaagggaatcggatgtggacgcgtcattgcttccctcggatcacgtcagtagtttttgaatcagagatagcggatgacaattagtctcggatacagacgacttaccaaactgcaaaaacatcttaaacttttataatagtagagaagagatagagatttttaaaaatgcatatttaatgatttttaaatcccgaacaaaaatcggggcgttacagtgcaatagtggcattttgtgtagcgacgatgccataggtcttggtggcgatggcggtggtgttggcagagttggcgagtggtagtgttggcaggccagctcggtgtcacgctaggagcaaagtcgagcgtagcgagcagtgccaagggcaatggtggaggtctgcggtgaaggtggcgtggctgcgacaagacagtcattgatggcatcatggtggagtttgtggtcgacgatgataagctaaggaggctcgacggaggttctggttcgcagcgaggaagacgtggcagtagtggttttccggtgagataagtttcggcagcttagcggaggtgaggttctatagcaatgccggtggggtagcgtgatggtttgctcgcagtgtggcaatggcatagcaatgcaaacttttggcgaaataagctacgacagctcaatggaggtagtagagacaacgacctggcagtgatggttgagttgacactgaggggggcatagattgtccggcggtatatttgccttcttggtgttgttttagctaaatgatgagatagcgatggttgtgttgacattgagggggcatagattgtccgggcggtatatttaccttcttggtgttgttttagctaaatgatgagatagcgatggttgtgttgacattgagggggcatagattgtccgggcggtatattttgcaaattttggtgctgagggggcatagattgtctggagggtgtattttgcaaattttggtgggtcttggttcttgaggtatattttatgtgctctatatttaatcggatatatgcagcctttttaaagtaggaacttagcctatcgaatagggaacttagcccttaaataacccaatttgaaattcgctcctatggagatttaaactcaggaccttaaggtactactcaggtcattgtaaccactaggctacatgccggttatgggtcttggttcagattgttgtattttaaggaaaatgatatgatgcgttctaccatttctgttgtggttatgattgttctacggagaaaaaaaaatgagtaccaataatatgtgttgttgcactagctttagtagtcactaatctgagttccttcaaaatcctcgatcccttcgtggaattggttcatatgtatagaatttatttaccactttggaacgaatatttggtgccttgaataaattaactttggaaaattagtaatttaaaccattaaatttgagataacttgtgagatatggtacgcttcagattgtaatccaatgccacaatctgtttcagaacctagcaccgcaacgagtaaaagttttctgtatctggtactgtgtacatgttgctggatgtgctgaactctgaagcaaattgacaagagttttgcagttttgctcatcagattggtatgcccaaagcataaggctcttagattttagagggaacgggaagaaacataattttaagttttcattgttagacccttgagtaaatttagtagcttgtctaggtcaactccatagagctagatgtcactttctctgttccaaaatattagtatttttaaggtttatacatgtattaaggaaagagttagaaaaaactgaagaaatattatgattggttgaaagagaaagtagatgaaaaaagtaaatggaaaatgattgtattggttgagaggaggtggcaggtgtagaaataattttatttttaagtcatagttatactttggaacggatgtagttagatagaaatgactgaaagaatatcgtgattagttggaaagagaaagtagatgaaaaaagcaaatggaaaatagttgtgattggttaagtgtagatggtaggtgtagaaataactttattttagataagttatagctatattttgagatattttgagatgaatatagtaatagtatgataaaaaatgtaatcacctctttcttttttttcttcactcgcctataacgaacgtgtatcattgggaaaaaaaaaacttacctacaacttcgctgaaataaaaaaggttaaaactcccctactaaagtacctacaactgataatattggacgaggcggattttttttcccttttcacttaggccgtgttgtattcttcaactccaaccttcaacttccacgttttctattagcatactttttaaactgctaaatgatatttttttaaaaaaaaagtttctatatagaagttgttaaaaaagcaaataaatccatatatcaaatttataatagttaatacttaattaatcatatgctaatgatgtttgttgttttacgtgcaacaaaaatctatctctaggttgggagatcgaacagggccctacctgatacatctgacaaagttacaccgcaatatttattaaggttaattatatccataccattaaaaaaagtactaattttaaaatatgccattattatttatttaattggaatcatgccattatagttttacacatgtttaaagatataccactgcttacccctagatgtatttaaaaaaaatagaccaaattacccttttccccttcttccttcttcccctttctcccatcttttcccggcatcggcggtggcaggcatgacccaaagggggccaccgcagtcgccgcctcttccctctctagctcttcttaggctaggacatttgtgtctccctctacaccaacgaagaagtcagcgtggggccctcgatcatcactgtcgctgacatctctccttcctcccccaatccctctctacggctgggcaaggcattgacggggcagagggaagccagtgtgtgatgcagaaggtaggagtgggcattcagtctaaccgaaaattttggtctcgatcttcggtctttcagtcttttcgatctttgaaaagtgaacaccgaatttcagcgaaaaatgttaggagcgaaaaatgttaggaccgacaaattcggtctcggtcttttcggtcttggactcggtcctaaccgaaattcaacaacatttcatatatgcaaagaaataatggaaattttcaacacaaaaatcacaaaaaaaattcgtaagcacttatgagtaaaagtctcttattaggttgcatgcctagaaaaagtaggatgtgaaaattagagtttaatcctattaaacatagtggattgtaggttatatttagacatttttgatatttcggtcttttcggtctattcggttacccgaggagactaaccgaattgaccgaacaaaattcggtctttcactacataggaccgaattgatgaccgaatttctcggtctcggtcttttcggttcggtctttttctgcccacccctagcagaaggcaacaccgacgtcctagatctgctcgcctctgctcttcagcctagatccatccgtctctcctcgccgcgaggagtcttgggcgatgatgatgccaaagcagcaaggaccgaggaaagaacgggcgtttctcctctttgacaagctcgtgcacctccctaacagcctccctcatcgcactcgcagctgcttgacgtgtcttcaccgcctccgagtagttgcccggtgatccacctcgccaccgatggccaccttggcacccaacacagtgaggacaactttcgtgaggagccccaggtggagctgcccgacgtcccgagctcccacagcggagcggacgggttaaagtcggggagcagtgagtaggcactgccggtagtgagattcggatggagcatgcagccaagagaaaggggagaatgagggaagagtgaggtagaaatgagggctattttgtcgaatacatataaaatacacatgttagtggcaccattgagttctcaactcatcaccctcgttttccacatgcacacttcttaaattgctaaacggtacgcgttttggaaaaattttatatatgaaagttgctttagaaaatcatatgaatccatttttcaagtttttttagctaataattaattagtcacgtgttaatctatcgttccgttttccgtgcgaaggggagggaatccctccaaaagatcataggctgagagtacaaacaagtatagacctaattaagacaactccattgtttgggttattcgtggaataagccaaatgacatattcgcaaacgagaagtaatttatgaataaaatttttatatacatgtttttagcgacctaaaagcaaagacagaaagataaatttcgatgaaaaaacttaaaatcggttttaaatttaaggttgaaaatttaaattttggctgataagcaaaagcataagtgaaaagatgagtcacacacagatgaaaaaaaaaagaagagaaaaagctaaccaaatcttcctcggccggcgtcccgactcccgagcgcgccagtgcggggcggggcgtcgttgctggccgcgccgcctcctcctcctcctcctccccccaccaccagtccaccacctccctgatcgaatcgaatcgaatcggaatcgaagcgggcgcccacttgaccaaaaaaattatccgttcgaatcgcgcggagctcgtgcttctcttctcgagtcgaagccttgcctaccttaacctcgcgacggctgcgctgcctgccacccccaccacccccagatccggagatcccgcgcggcgcggagcacactggagcggagcgagctggtgctgcaatggcggcccgcccctgatccgatccacaccaccccgccccatggactccgcccgtagctggctccagaagcttcagccgcgggacaaggacaggggcaagccggcgtcgcccaccgccgcgaggaaggacggagcggcggcgatggccgaggatggggaggaggcgatctcgagcaccaccgccaccaaggtggcggccgccaagcagttcatcgagaaccactacaaggaccagatgaggtcgctcgaggagcgcaaggagaggtcagtccccccgctcgctcactcagcctgttatagatcggctaatcgatcggggattgctattgttcggaaatgcgcgtgcgcgttgttcctgggttggaattcgtagggtgatcttcgaactggagctcctcaaggtcgatttgctgtgctcttttattaaacaattattattatgatctgggttccgagttacttgttaggtggtcactatagtagaatacttgcaattttatgacggcgcattagttacgtgttaataacgctaaaataaaccaggagtatattgggtggatggcaatacagtaatgggaatatgtaggattgtggagggtaaaatgattctatttttggcatgatgttaaatgaggtaaggagatgtgccacttggactagaatattccctccgactcaaaaaaaaacccaacctaggataggatagaatctattgacaacgaatctggataagcgcttgtccggattcgttgtcctaggatagatcacatcctatcctaggctgggtttttcttttgagacggatggagtaacttggaaggaggtaataaaggggtccattatctccaattttttttacttccgtggcctggatatataaccatacgatgtatgtgctactgctttgctgattgacctgctccacaacgaagtttcgcctgagtgttctttcataatgatatctcaattgtaataatttacagcttggacttgcattttgttaatatacttaactgctagtcttcattctttgttgttattttatctcttttgagaaaacggcatatgtaggactatttgtatctcatctatttgcaaaggttgacaaactgcaagccttcttttgtaatgtggcatacaccaaccaaatagggtaggaagaaactatgcttattaataaaacctaaaagtaccaaagttttggcaagaacaagggtaaggctcaatactagaaatgtaaacttgaactatatagccaacagcttctttaaattgcttttagtacccatattatatctctggactgcttgtagccatgcactctgttaaactagtttataccccgcactttgctgtgggatatgtggatgaatgcatgttatacattatagaaatgatagatgtatatgtttaaataatgtgaaaaatgatctggagataatgatttaacattgcttgtatattgagttctaaaaatacaacaaaattgttaatgatatgtcatgtttgcatgatatttaaaatactctagataataattgctagtggatgataatgtggtacacttgcatgtgattgaaaatactctagataataattgctagtgggtgatgatgtgacacacttacatgttgagatttatgagttagtgggcatcaactatatagatagtatagatgtgtaccatttcatatggaactatcacatgactatacaacctatcttcttaggtttctgaataatgaaatataggtgttggattgaacttactataaatcttcttggggcttgactgggaagcattcagtgttattctctgccttaaattgttaaacacaatgcatgtgcaatccttgaattttattaatgaactgtattaatattctgtcattttcggaagtgttctctaagggaagatggtatgcataaataaaaatatgtagcataaagcgcttaactattgcattacagcatcataagaggctattcacagttctcttattgccattttttgtgattgatatttgataactctccaatttcaatctttttgtatgtttcagtaagatgctatatattagttttggatatacatttctggcgtagtttagatatcatcgaacacccattcttatttggtggtaaagatattatgccaaattatattataggcgtcggatgctggagagtaagcttgcagatcctgatgtatctgaagaggagcaaaacaatattctgaaggacttcgaaaatagggagagagaaatcatgcgctcaaggaggcacaaaatgggtgttgatgattttgaattgcttaccattattggcagaggtgcatttggggaggtaagaagggcactgtttctactccctatattcgatgcagatatagttgactgttgtgtcatgcgtaataaacatcagtttctgcagtaccttgagaaaccttttattatacatggagaaaagaaatctatttttagaggcaatatatatgttctctgtttctcctgcagcttgcctccagtttacatttttattcttcaggtgaggctctgtagagagaaagctacatccaatgtatatgcaatgaaaaagcttaagaagtctgaaatgttacgaaggggccaggtaattcatgtgtgtttaagtaattaaatcagcttgtccagcaaacttttggttttctaatgtgttcttttcaggttgagcatgtgagagctgaaaggaatcttcttgcagaggttgacagtgcctacattgttaagctttattgctcatttcaagacgaagagtttctataccttgttatggaataccttcctggtggtgacatgatgactctactaatgcgcaaggatacacttacagatgatgaatctagattttatgttgcggagacaattctagcaattgaatccatacacaagcacaattatattcataggtaattcattgataataaaaattgcatggcattcggtagcaaatttgccactccatctttgctatacattttcagggatatcaagcctgacaatttgctgttagaccgaactgggcacctgaagctttcagattttggcttatgcaaacctctagatagtagtagctttccaaatctgagtgagtttgactatgcagtggggaaaaacattaatccgtcaatggatggtgataaactattaagtagctctgctgctcccaggaggacacaacaggaacagctattgcattggcagaagaatcggcggatgctggtatgttaaaatgctttatagtagcattttgcctcttgtctaattgcttaattctatatgcattccctagccagggcaaatcctaggcccaaacacgtacagaggacattctgtatgcatcacaatcatttgggcccttttggattagaggactttaagatagaccccttcagtgtggtagggatataagttcagtttctatacctatctgaacagaattgattaaattcaatctatccaatctaggcctaaacatgcatgcctgatgtgaaagtattccacatgtttgctagaagaagtcaagtatatttacgtaattttagctattatatgtaaagcaaatgcatgacgagatgattgactgtacagtcaaacagttcccattagttcatgatgaaaacgattacactgcattctgcataagatgaaaatgaacacatccaaaatgtcgatagaaaattgtagaaaaaatggcatggtaatcatttgtttgccaaagagccttggcagtgtgttttttatgtatttactttcatgataattgcaggcttattcaacagttggtacacctgattacattgctccggaggtactattgaagaaaggatatggaatggagtgtgacttgttagtacactttaatgaacttttgcagttcatgtcctaatgttttatatctctctcatatttgtactttataggtggtcacttggagccattatgtatgagatgcttgtgggttatccaccattttattcggaagatccaatgtccacatgtaggaaggtaactttaaatgctatagctaagccatgtcccttcaaagacttgtggatttgtatgtgaattctttctattaacttttgagttcaactttacagatagtgaactggagaagtcatctaaaattccctgaagaggccaaactgtcaccagaagctaaagatcttattagcaaactattatgtaacgcggatttgaggcttggaacaaaaggagcacatgagataaaggtgaaagtggttcacatgatctgttacatccttcatgtttgtaagtttggtaatttatagcatgatgtgttcttacaggcacacccgtggttcaaaggtcttgagtgggagaagctatatcagatggaggctgcttttattcctgaggttaatgacgagttggacacacaaaattttgagaaatttgaggaggtgaggtgtcattacgaagctattttggccagttaatggttccaactttttctctatacatattagagtacatgtctcaagtcaactttaaaaactttgaacatcaatatcttatagaatatttagaccgtatgtttagaaaatatatgcatagatttgtccaaaagcactatattatttttattgttattattttatttagtttttcaaatattttgcaagcaaatagttgtcaaagttgaattctgaagacatatttgatgtccaaaatgacatgtttcatgactggagggagcactaatttactgatagcagaagtttcacattgtgtgaagtcctgaatgtttctgcttatcctgctagattttatttgcatggtcacacaagacagtactaggatagctagcacatttgctttcataacctcgctatcgcatgattaaaaataatatcttgatgcagcagccaacaaaagaaatagtgttcatatcactaaagccctctggccagaatgggaagcaccatcttattattacatattccaaaagcagaagccacgcatcgttatattaagaagaagaaaatgaatctagaagactcaaacatgcccattagggcaaggtgtaatacatgacgacttgccaaagaaatagaaagggccatggccggtggcctatacaaacaacatgtactgccaaatgttagcaaggcctttagccccagctatacaccacaacctggccaacctaatgtagcagcagccatcgttgatgagagaaaccaaagcacatcagccaccattttagttggtaaatgctactaagttatcagggatctgacaagagggaaatgagctttttagccattcagtacactctgggatattatcattagttcatttggccttgtttgtttgactatgtcacaccctttattgcatctagtgttgtgtgaagaaaatatacactgaggcggcagatatttgtacattggcaagtccaatatattgtggctcttgtaacctgacttatttcatcagtgcttacctagtgacctttgtgtgtttggtgtcttgcagattgctccaatgcaaacttcatcaaaggcaggtccttggagaaaggtgcacttttttgcagagatcaggcgaccatttgcttttagttttttgtattgtcaatatattggaggatacatttttatttcaaaattactaagggtcgcttcaggctagcgatattttctcttactcttcctgtaggacaatgtttgcatttgaaataaaagtgtgattcgtcatattttaattaccttgtgaccttttttttttctgactctaggtcctgactaaatgtttctattgtgcagatgctttcctccaaggacacgaattttctcaattttacctacaaaaaccttgaactatcagatgatcctgaacatccaggaataggttggttcctttcctagtctactggcatttattccttgcaaaaccttgtaaaaattgtcttggacatagttttgtgctttacacattatttgtaaccatttatcttttggctctgcagctcaagtaaagaaaaagaataacaagccaacgaggcggacctttaaatcaatattgcatggtaaaaggctgtaacacagactcagatatgggatattgtcataatatttacgttgctttccctgacattttacagaatttgctgatactgaagaggaacctcaaagcagttccttgaactcaacgccatcacaattggatcagttgcccgagagccttgagccttctcctcactctagtatctcctcagaagattcacagtcgcggcatagatagcagttgtaatctgaagtggcaaaaagggtacataatgctatccgcagaacttaacggctattcagaagacaaatttggatgtatagaaaagctcctataaatttgcttttagataggcggtggggtgttccaatagccattttcttatattggagcctttagcatttgtttaccgacaatgccgtgcaatttggtttacattggggaggggtatccgtattcttctggtctgtaaattcctggattctgtcattctatacagggttgagattcattctttggagggaacgtgtcatgcgtatgccgctagtcctttttttttgggggtggggaggtggcagaaatctgcatgtccaccttgtcatcacatttgctgcaacgcaaatttctgagaaacaaagaaaacatgtactatcaagatgcatcataaaacaattgtttccccttctgtgcagttaatttccaatctaccaatactgatatcacgcgggacagctggagtaaatcctttactacctgttcaaaaatagttttcttttattttatgcgagaaaaacatagttttctatataattaaagtatactaatacagacagtaattcctttacaacctattcaaaataatttcttcatcaaatcagcagtctgacaaatagtagtaaatgatttagtgatttatggtactggtttcctatcagtaacggtttttggagagggccaaaaaaaagagaattacggattaacaggacggcccaacagaaaaacaagaaaagaggaacgggctgccgcgtgtattagctaccgattttaaccctttgccacggtaacagccgccaacagaaacccaaaaacaaattttttttggggggaatattatacctatgcatcaccaacagtcctcctatattgtccccaaaactgatgcagcatcaccaacggttctactgtattatcccaaaactgattttgagggctattagtgaaatattggatccaacagatcccaaaactatttttgagagctattaggtgaaatattagatctaactgatcctcaatggtcccgcacgttttggagttcccttcccgtatttgtcgctgagggtccctcccaactcccaatcgtgcgatgcttcgtcaaatcgagccggtcgtccatggcctccaccatcattagctgctagctggtgaccaccatcgtcgctcccactctgcctaggccgtgtttagttttccccctattcctaactttccatcacatcatatcacatcaaaaacttttctacacacgtaaactttcaacttttttttcaaactttcaacttttttcaaacttacaacttttttcaggaactaaacacacccctagtttcgttgacagcctcgtcggtagtctcgtactctcatgcgaagtactatcaccaacgtcgtcttcctcgtactaatcttcctccataagacacccaaaacgagaaccaccgaccacgtactagagaggaaactggagccaaggtgaggtgccagcgcgatcaccgtcgacccgcctctcgtagaacctcacacccagctcatctcgtggatgggcatggagcagagcaaatagagagacctgagccagccgcttctactcgatacgaagctaaaatgagcgaatgtttgccgtctgaaatacacgcagggtaggagtgccgtcgcagacgatggaagtgtggtggtgcgacgtgtgcgtggaggcggaattaggggtgaaaacaaacgggtacttactaaccgcctgcccaacccaaagcttgctggaataatatagagaaaataggatacccgatagtatccgagttcaaacccgaatccgtaaaaaatatgagttaggatagggaagggttgtatccacccgtatgtcccatgctataaaacatatgtgaatatctattataaattcacctataaatatgataaaagattagttaatcactatctttatgagctcacatgtaatattatataatttaatcattgatgtatctcttttagcacttcaattatcttatattaaatatctatcaattagtgatataaattaaatatccgttcctgaatctaattcgaagaatattgggtatgatacgggatgagtgatatgttatccaacgctacccgtatccgattctaaatttaaaggaagatactccctctgttttaggttataagacgttttaactttggtcaaagtcaaactactttaaatttgactaggtttatacacaaatatactaatatttatattaccaaattagtttcattaaatcaataattgaatatatttttacaataaatttgtgttgagttaaaaatattattattatttttacaaatttgaagcggtttgactttgaccagagtcaaaacattttaaactgaaacggagaaagtataagttagaatatagaaatattgtgatccgatcgtaccctaccagttttcaccccataggcggaatgccaggtggtctccggcaagccactcccgacgctcggaacttgtgttttcctgaaaagaccttgttacttggtttcggctttctccaaaaagccgggtaatagtaattaactgatgtctaaaaaaaagttcactaagtgtttcgagtgtacttttaatcaactttcaccttttcaaaccaccgcagtccagctccgaggctccaaacactactggtttcggttacataccggtgctgtttttactatcggtctcatgcaacacacaaaatgtcaaaattgttgtacatcgcaagtgtactctagcacttacacatatccgccaattttcagctcaatgttatctaaccttgcaaattctggtttcccttttttccaccagtagcaaagccatgaacagggatatctcatcatcggccacaaagttggtagttgcactcttgagctgaaggttgcattcagtcggggtaactgtggtgttttccgtaaccaggtggacgaaattaatagagctccaggaacatctatgatgtaggttctcctttaccatggataacatggtgcacgagcttgtctggtaatctctttgttgcctgaaatgtatgtagattggcttgtcaataattaattagtgcctatatatgaagtctagtaaaatacaaacgaacataggcagaactgaaacataaacagaaaatggaatcaaagattactcaatccagtttcataattcttgacgttttggatgatgcacaaataaatacatgtttactttaattatataactttaaaagacaaatccatatatgttgttctagatcttttaaactaaatacttttaaagttattgattgttaaagttacaaaagtttgacctcaaccttatccaaaacgtcaagaactatatatttcttttaaaaaaatattactatcttaatatggaagcaaaaccaatacatggcctgcatcaggttatatatagtcctagagagaaggatgcccttgtctctgaggtgtagaaagagtactaaatgagagagaaggatgcatattacacgagggaccatattggacgagggttatagttctatgtgctttttgaactgctatgtaggaaaaacgttggatgcatttttttaaca

SEQ ID NO: 73325 - DNA, 25152 bp, Oryza sativa
aaagtactagcgtatgtgatgttacatgatagctgcttgattctgccatctcataaatcatatgtaatgtccagttcatcccgtgggaaacacacgtgtttttgttaactttttattggagactaggccctgttgttgcttatttcagaataacaaaacctgttcaaacaattggcaaatatttgtcgaggccctaagatgtctgtcagcatctacttagctgtgcttcttataggatcgaatatggtatttcccaccttaaaagctagccaataactaccagacttagcagctaccatgtaggcacgaaacccacaggaaaatacgttttaccgtcagagattattaacctgtagaaaaatgaccatggagaaattccattttccttgtagttttccctacagaaaaacaatgagatgagggattccccacttatgtattactccaggtcctctgtgcccttccacaactaatatgggactattcaacacttcttttctgagaatcaacaaacatattcgataccctaccgaatttcgccgttgttattttgaaaaaataataatcaaatgctagttaactgttcttattgaagttgcatggcacattagatggtttaattatagtatagctaaatgctagctacaataattgacatgcacatatataatcatctacaaccaatgtagtagctcatctatacaatagttataaatatatatacttacgccattagtacatggcacacctcattgttgtctcacaaagtgtgtgttacagccgaggcctgtgttgtagccaggtacaaatttgttgcccgtttctcttctcttcaacttatcacaaatatgatatgcaattcttatagtccgcttttacatacttgctctaacaacaaacattttgatcaactacaaatgtaaaatcagcaaagaaaacatttaaatcctaaaatgtgaaataggtataggttggccacataaagtgagagactgggagttactctaaggaaaatctgttaagcctatgtttggttggagggaattgttaggagagaataaaagtttgagaggtgggaactgttaagtttactatctattggttagtaggcataggagttttagaaggtatttagaagtgaagtttaagagcaaatgtataactttttaataattaggtaggaggagagaataaaagtttgagagctatttagaagtgaagtttaagagcagattctaccttttcaattaggtaggggtggtagttagcagggaatttccatgacgaattaatctaagccatacattattacttataattcaactcccacccgaatttttcataattctcgtttgtattaccagacaagggatgacggggagtaaaactaaaactccgatgaccaatcactccaccaactccctcgtctaagagcatgccgaagagaagtctaaaaattcatcccaaaattatgatattgggattccaaatcatattttaagatcgataaaattgatttttctctccgacaaatatatcaaaactgactcttaataacaaaaagtgagctcattctaccaacaaaaacaaaaatccatctcccctctcatgggcgcacgccacatgtttttcttcccccctcccataggggaacacagtaggattgggagcgaacatatcccttagtagaagtagagggcgaaaattccagagttggggattccaagttctgctttctatatatgggtacttttggatttgatattttccaccagagatcaaataatttggtattgaggttgatgtcctcttactaaaagttgccaaacgcacgctaagattaagtacttccccaatgggtagtagtaatattaacaccgtgaactaccaatgctgcagttgaacaaacattccttacttttttagcagcatgcacttgcacgccatcaattttaatttccactgtgatgcgtaagtaacatgcagcaacacttagcagcactgtatatataaagcacaacacagtggtactaatccatcaaattaaagcagtgcgaaaagttatagctatagcttgtctatctatccctaaaagacacaattgtctgcctgtacgtctagctagctctagttactagactatggcaatggagatgatgaccaacaccaccatcgtgcggctgcccgcgtacatgcgggaggcgaacaaaggcctctttgagcctagggtgatctccattggcccctatcaccgcagcaacgagagcacccacgacatggaagcttacaaggagcgcttcctccggcagtgttttgccccgcctctaggtcatatgaatcttgaacaatgcattcaagacattgctcgtaattctcttgcagaagctctcgagaattatagtggcaatgttggcgactacaccgcggagatgctcaccctggacgggtgcttcatcattgagctcctcatccggtggaacatgggaagactcaaccatgacagttacgtgcggtcgatgcggaacagcatatactacgacctcctcctggtcgataaccagatacctttcttcattctctctaggctttttcacaagttgaagggggatgaagagctcgacaacgccgatgttgagaatgagttgctcacacttgctaagaaattcttcaaccacgagggtcaattctcttgggctaagtctccaggcctgttagatctttctaatgcaagtgaggttcgtcatttgcttgaccttcagtacaagcttatcatcagcaccaatgacacgacgattagtattgaccagacggacaatagttacctgcgaggaatccctggggcaaatgagctcgaagactatggtgttaaattctaccaggatgaggatgaacacaccaaaatgtttgacgtgaaatttgagggtacaaacatgatgatccctcgctttgaaatcaactttggctccaagatactattggcaaacctcttcgcttatgaccaatcaagggacaacgtacgacctcatcaaggggaccaaactgaggaccaaccggacaacacagttggactcgtgacgagctatgtggtgctcatgaacgctctcatcaacaccaaacgtgacgtcatggttctccagcgtgagggcatcctcgacaacctgctgtcaagtgaggaagaggtagcatccttcttcaacaatctcggcaggtgtgccttggtggatgtgacaaagcatcactacactaccatgttcaacaatgtgaacaggtactgtaggaacccattcagtcttggaaggcacttagtgatcttacgcaggaagcatttcagcaacccgtggactttcttctctctggtgggtgcacttatgctcctaggcttttcattcacctccatgctcttcaccatcctcaagtataaacatcgctagacactagcgttacacctcacgtgttcagtgttctcacgttattttatgatctcgcaccaaatgaatatgtgaccgtgctatctatttatgttattactataatattttgtataatgtcaccaaaaaatatcgttccatcaggagacagaaggatctaaaaaatcagtggccaaccactcgtacacatgagtggatataggaagaatccaatcgagatgactacttggttaatctgttctctcatgtaattttttttttcatttcatacattccctgatcatgttacttcttttagtttgtaatccttgtgtgtggattttatttcctgccttaattcctgtcatgtttgtacttctacttgtgtaaaagttgttccccatctttatcatgaataaaatctgtgttactgtcgtgtactgttttgcaagagcacttatctccctaaatattttttgaggggttcactgcactacacaaatcctatatacttatatagttcatccccactaagtgtagttaatgttatttctctcttatctcattaagccacatcatcccaattatttctagcctttgaatgataaatttatggtctaaattgtctcttctttcttctcttataaaacatgtaatcccaattatttttgggcccaaaattgtatcaaattattttagttttgataatcaaattacattttatttgtacatattatgcaaattaattttccgcagcaacgcggtggggtattcatctagttacaaatacaaacaagctcagttaacattctccttattttttctccatgtatatataagtcatgtttcattgaatttttgtgaggtggtggatggcgtggtaaagtacattacaaaatattaccagaaatataatgtatctgttttttttttgtcttttacggtaacttttacaagtggtatatatagtacatacaacagtatagttaataaatccaaccactcattaacagggtaatttgggcctttaatccgacaacgatattaggctattctagggttagggtgtgtttgcaagaggaagttgggaacctatctcacacggaaaatgaaacgatccattagcgcgtgataattaagtattagctattttttttaaaaaaatagattaatttaaattttttaagcaactttcatatagaaactttttgcaaaaaacgcaccgtttagtagtttgaaaaatgtacgtgtagaaaacgagggagttgggttgggaagcaagaggtccgaacacacctagcagtttgacatgctccttccatccactcggcctcttgggactagctccgctaccgccacttcactgccagctatagcagttgcgaaatttggcccatacgaactcctaaattcggcctaaacatgtgcaaatttcacccgaaaatgttgctgcgtggatatatattatgacagcgtgcggcgccgctggcctcctcctccatcgctgctcgccgcggccaggcttgggagcagcggatatgccgccgacggcgctcccgggcctagggcggccagatcacgtggcggcggtccccaggtggctcggcgatggcgtgcggctgcgtcgacggcttgcagcggcggccccggggtggcttggcgacggcgtgccacagcgtcgacggcttgcgcagcgccagccttctccgccgcggcaggcctagtacggctcggtggcagcggtgcagcgacgacggcggaggcgtcagctgcgtcattcgtgagcctgagttcttgagcaccgaggtaatggtcagcctgctcccctttgatcgggtctcatccttcgcgagcctaagttcttgagcatagaggaatgaacagcagcagtacttggtttggctgggttgagagcagatcttggaattgcatgatttgtagagggatggggagcaacagtctcatccattttgctatgcctgagtgcctgactcaactttctatgcctaatccaacaatcttgctatgtagaagtcttactgttttgctatgggttacattatgattttattgtgcctaactcatgaattttgctatgcctataccttagttaatttcatgaataatatgctattgcaagcactaattgagatgtggtcagatccaaggcgcaaaggtatagacttggaatgttgttgaaatcatgatactgttccaaaatcttactactttatgtttaagatccatgtattatatatgtagtcgtgcttacatggtattgcctactataagatccatatattatgtatgtttaagatccatgctgcatttgatttcgtttagttctacacgttctttctcttctcttcaattctcaacttatgctttgtaggtgttgatccgaccatgttggttgtctactccaataggtgatggtaagagcagatgagaatggtgaaggtaaagctggcctaggtgagacctatgcaattcattcttcaataatccgaaacttcttgtgttgttttttcttaatcctggtcacatgaacatatagcatttttatccattaaaggggaaatttaagtctagtagttagcagtcattttgtcatgcgatttaaagtcagttttgtggttttgtttgaagaagagtacttagcagttacttgctaaaatcgactctgttatgcatagtattaaagtagaattggtatatggatggtttttgttcaacgttagtacaaaactagtaaagctcaggggataagagagctgttgacgcaggaaagttgtgtgttgcgcaattaacaggtgtcggtttaaatttaaatttatgttctataaactggggcttaattcctaaattttgttgtctcacagatgcctaagaggactacatttgaggttgttgcagagtatggttggctgagttggacattgattttttgctgagttacatgtgggtggaactagtgtggacttagtgaatctagtttgctcttgtggtcaggggcgcagctgtggggggtgccggagggggccaacaccccctatccgaaccatccccacaccccctcctctcattcctgttgttgtatggctgtacttacaatgttacttctaaaaaaacattagcaagaaacatgattacaaatttagtttatgatttctcatcttttttcaaagtaaaatagaagatacttatttgtgtgattattcagtagtttagattgaaaggatttagcaatagagcctagttccaaaatgtaaaggactagtttacgcattgatttttattgatggtgactatttggtctcctttgctatcttttgagattagcggggtatggagtggttgttcgttcttatagcttatcctcaccccacacccccctaatatcaaatcctggcttcaccactgcttgtggttgtatttggtaagttaacctaggaacttattttgatatctaggatttagtgaagatgtactaaacttattattttgctatggtctatacagagatcacctgtatatgtgaatgagctttgattgtatgagactaggctttacctgtatgcggctgggatgataaatggacttgtgctatattgaataataattgggcttatatatattatgatatatgggttctttacatctcgagcttatatgggcttttgtaatgggcttatatggtcattcctctatcttatcggacctacaattatgcttagcccataaacatattgctccatacatggaccttaacagcccataagaaatttcatgatgattcaggttgtcacaattaacatgccatgtcagctccatgtggcattgtactacaattttatgatgtttcttgtcctacatggaaactgcatagtcatccaggctttgtgatttgtgacgttttccggcttcataatgacgaacatgagcgtcataactcaatgacgaaagaaggatcgtcactagtttaatgatgaaaagatatgattttgtcacagaacatgattagagacacatgataggtgacgattgacttttgatcacgcgatcgtcatagaatttgaaatgtgacatattttgtagtttttgtgacataaatgaaacgctatcataagatcttttgtagtgtacacacatgctaaatcatcattttcaaatatttcaatccaaatcatttcatcatttctccaatatctaatatatagcccgtactaaagcgcggggcatggcagctcgggatcttggggttcctggcccaactaccctagggagaaagcctgctggggaaacttccacgggataaactgtgcctttggaagcccgcgaggaggggaaaacctgggccaatcaacgtcgtttccatgggaaacaatcctggcctcacagggtcggaaatattttctccgtcgcttcctcggttggttcctccacctcctgccctctcataaagtcgcaaggccatcaccgcctctcctctggcgagacgccactactgccgccatgccttcccctctggtgagatgcatgctacctccgcgcttctccctctcctgagacgccactgccaagtctcccttcttgataccccctcgcgatttcaactactgtcctcttctgttccaaattgtttgtgaattttctgaacttttattgaattctgtatgtattttccatatgcacacttaaatatcccgaaaaaaatgttgatattctgaattttctatgaactttcagatttctttgtcacctgattttttcctgctaattagttattctaatttttgttttactatactacaaggcatttctatcatgcgagaaatcagtgggtttcctgggaagctaggtcgtgcgagcaatccaaatgacgcagtggattttccctggaagcggaggggcttcatatgtcacagggaaaatccctgtgggggagctatttccctcggtttttttatttccccttagctcccaaaggagtcctaaagagacgatgcgaatatgtgatgtgaactacccaacgtcaaatacaaaatactggagagagtaaaaatagtgaaagaggttgtcgggtgatgtttcttgagcctctaggtttagtaaactaggtcaaatcacgcgcgttgttgtcagagtttcatatgataatagtagaaaaaataatgtgtaaaatagctagacgatatgagcttatataatttgcttatctaatcaattatttcaaatgctataaatcattaggtttatgataatttaaataatatgtaaattgatgatccaaatataaaaataaggtggtatgagtttaggagagaaggaaaaatgaacaagacaatttggcccatggattaataataacaattgatgtggtgtggtttaatgacagaagaaacattaagtaagtaaggaagaactatttggatatatatatatatatatatatatatatatatatatatatatatatattaaatttgtttggtgctccatggtgcccgggcaccatggttgaaattgagtatatacccaattcaaatgagtatgaaactttttcaaatatttaggtattaacattaactactttactaactagttcaaagcaagtttgaactgaatttgaacttgtttttgttagattttgattctaggtatatagcatccaaatatataattagttagttatgtaatcatggattgtgaaataaagttaaatttgagttatttgttgataggtataggtatgaatcgaattcttataactaggtatatactcacaatttgaaaattttaaaaaatttaagtgattttgtgcatttgataccatggtgccccatatgagtgtcatatatatatatatatgatatatgatataataaaaaaataatggatatgtatatagtaaaatactatgtaagttatgggggataatgattcaacatttttacattttaaagctctgaaacatagtaaagtattcataatatagcatgtaagaatgaggtttaatatgatggtgtgatatttttgtattttgagttttagaatgtagtgcgctgtaataactatataaaaataatatatgttaggggatcaatgaccacactctgttttttctttaaaggaaaagaccgcactctgttttcactctttgaatcagtttgttttacacacaaaaaaacacacacacctggttttgcttcttttcaattgaaagtaacatcgtatgtgacgccctgtcgttattttcaaggccatgtttagttgttttggaaaaaaaaattgacgtatacggacacacatttgaaatattaaacgtagactaataacaaaacaaattatagattccgcatgtaaactgcgagatgaatctattaagcctaattaatccatcattagcaaatgtttattgtagtaccacattatcaaatcatggcgtaattaggctcaaaagattcgtctcgcaatttatatgtaaactgtgcaattggctttttttttccacatttaatgctccatgcatgtgtctaaacatttgatgtgacggaaaagttggaagtttgaatggaactaaacacagcccaattcaatcactttctatgcttactgtagacaagttacattaagcatttttaatcaaagcaaaactggcaaattctcattcaaatcctaaaatacaaagttgtgcaagttgactgcaccaagtgggaggcaaggagttgctctatgagggaaatccgttgaccttaagatcaagtatttcctcaacagtagtaataaatacaaaaaactacaggtcctgcagctgggtaaacatttccttaactgatttaaacttaaactaaatttagcaacacttgcacgccatcaattttaatttctgctgtgatgtgtatgactacgtaagtaacatgccgctagccatatatcacgtatcaccatgtatatgtgataactatatatataaggcaccatgcactagtattaatccatcaagttatacaagaaatacacagtcgtttataaaaaaatacaagaaatacacaagttctacgattgtcttgtctgccgctattgctatggagatcaacaacttggtgcagctcccgacatacatgcgggaggccaataggggtttgttcgagcctagagtggtctccatcggcccctatcaccatggcaacaagagcaccagcaatatggaagttcacaagaaccgattctgccgtagcttcttgcagcggctgggcaatgtgagccatcaagatgcaattgaccactgtatcgaaggagctttccggtgctacagcggcaatgttggcttgtacaccgcggacatgctcacgcgtgacgggtgcttcatcgtcgagctcctcctccagtggagagagggagaccatgcccatgtcgacaatcacatgcagttgatgtcgaacagcatatactacgacctcctcctggtcgataaccaaataccgttcttcgttctcgacaggcttttcaatgaattcaggaggcacatgggtgcaaatcctgtcttcaacaatgactcccagttggttgacctagtaaccgaattcttcaacaacaggcagggtcagttttcctgggctaatttggaccagttgaggctgccagatgcgacgaatcagcagattcgtcatttgcttgatcttcagtacaagcttgtcatcaacaacaacatggggattgaaccaaataatcgtaattgtccatttagcctgtgcatcaacatctgtcccaatacgattgtgccacgaggaatcccagcggcaagcgagctacaagacaacggtgtgagattccgagtgaggggattgagtgagcaggtcaaaatgtttgacgcgacatttcagggtaagatcattaggatccctcgttttcagataaatttcggctccaagatcctactggcaaacctcttcgcttacgatcaaatcaagggagaaccagctgacaacggtgctgctgtcggacctgtgacaagctacgtggtgctcatgaacgcgctcatcaacaccagagaagacgtcgcggttctccagaggaagggcatcctggacaacctgctgtcgaacgaggacgaggtggcctccttcttcaacgagctcggcaggtgtgcgttggtggatgtgagcaatcaccggtacactagcatgttcgaagatgtcaacaggtactggaggaatgggttttgctgcaagtacttcgcgatctgctgcatgaggcattgcaaaaacccgttgacttgcctctcgttactggctgcattcctactcttgagcttttcttgtacctccatggtcttcgccattctcaagtactatacacgtggctagcatatgcattaccacctcagaccattaatttcattcctcctgaatcagatgcatgggagtgccagtgctagcgtacgtattgtgtagtgtaattactgttagataatgttacccggccacaataatagcattcaaaaatcagttgccgtaatcctatccatgaacaaattaaagaatccgatcaagatattgctacttggttcagcatattctctatgtgcatgtaaagtttgttttatttcacatatttcctggtcatgttcctgtttttaatttgtaatccttgtttgcgagtatatttttatttctgagtttcatgtcatgcgcgcatgaatgtgcaagcattgttatgtacgaactgcttctgtaaaagttgttactatatatgtatgaatttgtgcttttgtgaactatggtagtattttgcaagggcacttagctcgcgctaattaaactttttacgactcactttaccagaactaataaaacaaaattgctcacttaacatttctcaatgaacaattccaacaaaatctttttatttcttgtttaattattttgaattttaaagtattcccctatccgatctacattttcagaccaaaataggcttatttgggaccgaatggatgtggcctcctaagccaagttaacaagcactattgggaggctactgcaaatcaggcactcgattttaaaaattgtacgttgtttcggtatttgtagaaaaatatttcaccactaacttaacacatgtttcagactattaaaataatgaaacacggttaaatcatgcatcggaacactttgttctgaaacacaaaacataaataaactattaaaagtttttatgtgaacttatgcttttgtaagagttctctgtttcactctcatagactattttgcaagggcacttattagctccctaattaaacattttagggctcactttaacagaaaccaaaacaaaattgcccacttaacggctgaacctctgattaaataaagatagacatttgcttctcttcaatctattgaacaagttaagcgctcccttcgtcccgttctactcgctaagatttaaatatatcatatactatgatatttgtagcaacaaaattataatcatataataataaattaatttataataaactgtttatggatcaaatatttaaagagttaaatattaaaatacgtgcgcgtcgagtgaacggagggagtactttacgcaaactgttggtctcaattgagccgcacgttcgacccaatttacccaaattgttgggccgaaataaagcagacttgtggaccggattgaagcgtcgtacattgcttacgtacaggccgaatttgctcttaccattaggctgaacttacgaaaaatttcagggtgaatttattcatcacatattcaaatgaacaaaagtatatagtatataaaaaagggtgtagttttgaacggagggagtatatttttgggctgtgcagacgccgtgctcggcacactgctgcgcatgaatgatagaaaaaaaggtggttggtgaaaaaaaactattcatgcatcttcctgcagctgactccaagaaaacgatttccttcatactccactacagcatgctcaccaagaccagttgttttacattaagaccataaacaaccttgacgactgctgaaacattttcttcacttgttttcaagcctctcgtgggagaatcggcataacaattcaaatggtcaagcagacgtattagaggggtttggacgactatcgatcctacctacgattatacaaacctgttacatgaatcttcgatgcaacctctctctcctttgtatatttctttcttgactacgttgaggggctagattcctgaatcagaactaagaaatattaatgtaattacgcacgagatcgctaattagcgatcgatagcctgagacgatcaatttttttttcgccatatagtttttttcttttcgagtaagtttatatatctaaagtttacacacctaaaaattataggtcaaaagtttatatacccgattcaaattcgaattcggattcaaatattttatatatagaatatttctatacataaagtttatacgtgcattattttcctcttttagtaagtttatacacctaaagttacacatataaagtttatccacgtaaagtttgtagagcgaatgtttataagtcaaaagtttatatacccgattcaaattcaaattcggattcaaatattttatatatagaatatttctatacataaaatatttctatacataaagtttatgcgtgcaaagtttacagtataaagtctatgcacatgaatgagagtattagattttttaaaattttttttactaactttgttttttttttaaatttatgatgaaaagagagaagggactggagtatagtggagaggggcgggttgatcgtagggagcgatcacccgcccattgggggcgcccaattacgcagcagctgagtggtcgaccaagtcatcaatcggtcctgcattttatattacctctattttctaatatataataccattgattttttataaacgtgtaatcatttggctcccgataaaaaaaagtttaaccatttatcttattcaattttttttcaaacataaaaaaatttaagctgtgcttaaagaacatttgataataaattaagtcacaataaaataaataataattacatatttttaaataagacaaatggttaaacgtatcttaaaaaatcaataacatcatattgaaaaatggagaagtactatggtgcagacccagtatcgcgcgccccctcatttgatgttgctctctccccgcgttggctctcctttatataccttgacaagcctagaggcgagaggctagtggatctggacatgcactttaccgtcctttatttgctatataaatttattggattttttgaaacaaatatgaacttgttggaaaatcacatagacttccacaaagtgcactgctggctagtacaaggatatatgtgtacttgtgaccaataatataacaatgggcctgttaggtgtgactagataacagccagcagctacagtagcaccatataatttttaccatagtcgcagcagcagcgccgcacaaccactgcaattggacagccgaacacacccaatgtaacccatggagacaagtacagccatgtcactcaattactgtaacagtaaaacaacatgcacctcaccttcatccgaagagatcagaaatagcacctaataagctcatcaacgacacatgtgacatatattcttgttcaactctatgttctacatccgctccagcatggttgatgcccctttgattcaaaagaaaattcatagtaattttagaggatttcacttttatatgattttttttctacatagccctttgaatgaaaggaatgaacctcatggaatcctatgaaattccaatggaatgcctctttccacgtaagttttggagaaaatttaacaagaggtagaacctcatggaaagaatcctttgagtctttatctcttttcaaatttctgtgtttttcttgcggcccgatcaaacaatcattcatatgttttttctatgtgttctaatcatttgttttatacttgtatttctatcggaatcccatattttttctattctttttttttcattcctgtgatttaaaatagccacaagtcttgggccaagaacatgtcgccatcaaggtactacgtacctgactcatcacatactcaggccctgtttatttcgcgaaaagaaaatttttgggtgacgtttcaccggatgtcggaaggagttttcggacacgaatgaaaaaactaattaaggctaattaatctgtcattaacatatatgggatactatattacttatggctaatcatggactaattaggctcaaaaaatttgtctcgagatttccatgcaaactatgcaattagttttttcttttgatctatatttaatgcttaatgcatgtgtcaaagattcgatgtgatgtttttgggaaaaaaattgggaaccgggcagtgttccgtgcactggaagcatggtcccacacacagtaatctaacgacgtggtgtgaggcggacctcattgcgttaactgacgtgagaagtggccgttgcgagacaccttttccgtctggaggcagcgcatccaatgcgctttccctttcttcctcctctcgctgctgctctcccagtgcttcggcggtcgtcgatgcgacccaggcctgtggcggagaatcgattcccctcgcctgcagcccccatgctcccccatcgattctcgctcgcgtgtcatcttgcggcaacggtcaggtaaatgtgccggaaacgggcggaagtggagaagccacactgctctcgagttgtctacgtcatcctcgagggcggtaaaagccggccggcgtgctcgatgtgtgcatcacgcatcggcgctcgtcaggccgcccagctttggcagactggccatgtttgtgctcatactctcggcctctcgggtgacacagcgctggcgtgaagagtcgcatcaaggcgtccaagctggcggagttgaggagccacctctatttgaggccgagtgtgtgcatggtcggatagagatgagagcgaagaagcggaagcgagagcgggagctcttgcggatcgcattggagggggcgattgttgaatcccctcaagccgtgccgatctctgtccgtggcgccgatctggagtccggcgagggttcctccgactctgtcacctccgacgctggcagcgctaaggctgcagctgacgacgtggttcatatcgcgcatgccctttgtaaggtttgcgccaagtctcctaaagccgtcaacgagtttgttcgaagagtgagccctgccaccgtcggccgttcaattgattgggacctcgtccgcgacaacgactcatcgaaggtattgtggcttgtctacattttttctttccgattcaatttgggttgacttgcatgtagtagatgtccgataggcgtcaccgctggaccgatatggaggttcgtgtgtttcttgagagttgcttggaggagatggcagcttacaacatcacctccaactcccccaagccctaggcatgggagaatctggcgaaaaaaatgtacagcaagtgtaggaagagggtgaacaaggctcaattggagtacatttgggggcagtgtaagaagcggttccacatgtgggtgtggttagaatcgcaggctaccgggctgggtcgtgatccccttacttcagccattgtcgctaatgattcatggtgggaaagcaagaatgcggtatgtacactacatgaccgctggagcaggtcgccggagggtgcaggtccgctgggttggcggcaaggcttcctcctcagtccccttcctagagagggggcggcacggtgggtctcgcctggctccggcgagcgacgcagtggaggtgatgccgacggcggtagcggtcgcgcccggtggcagtcggcaaggcaggcgcctatggcgtcggttggccggggggtggtggcaacggtggaggttgccggttagtggggcgctccggtgatgggcatggttgctgtgtggcggcaagttctccatcaccggtggtctcaatgggcggcggtgataggggctagcacaccgttccttcctttgtcatcgacggcgtcgcggacttggtgggtagctgtgctggatggagatggagctaatcctctatcccctccttcgtcactggcagactcggtgggcgacagcggcagacttggtgggcgacagcggcgcaaaggtggcagcgggttgggagtccaagaacggaggaggattctgaagtcaacggcagccctatgggcggcggaggcttaggaatccggcgaagcaaacacaattgctttcaactagcgtctggtcggctagttttgaccggaggacgatggatgagggtgggcttcctggcggccgtggcatcggttcacttgaagcggatgaagatgacatctatggagattcgcagagacaacacactaggggtggtggcgtctagatgatttccacttgttgtttttggccgtttcagttgaggatgtcaggatgcagggatgtaccgaggttgtaggttttcttgtttttttggtttgttatctcctctttgttgaggtgtgagtttaagtactcttgtatccttttggctgtgtatatcccttgtggatatagaggccggattaatgaaaatccattatctaaaaaaaatggtatgaactgcaatttattatatgcatatagttatattttcagtttgtcaggacaaaaatcagtttctctccttgtgtttgtcgaaacaaatgaccagctgtagtaatggaagcattgtgctcatatatgctttatagttagaactgtgcatacatgttgtagccagttgtgccattcccttttatttagagcagttggtaagttaaaaaatgtttaattcatcaatggtcgagcataactatgaattcagttgatgggcactgattgcaaaaagttatcagtaattgatattgtacatgtgacagttgaggaacatgttcaatttataattgagtgcatttcacattgcaccatgtattatgtgtttgcactagttggcagtagtttgaaccatgcattatgtattagatgttcaatttaaaaggtccacagcaatcttttaacttacaacatagatgtttgcactagttggcactttggactagggttgatcacatgaaatgaagttgtcagagataacatagttgacatcatcaattctactgccatagtaataagaacaatatatttagaaacaagtagatgttatgtttctaaagagatgtatagtttagaaacaagtagaagttttgtttctaacaagtagatgtttagaaagtaaaaacttatgtaagatttatagtttgtagttactacattgacttaaccctagttcattgtacaacgtacctttgtcaaaatctgtggcccattgtaaaatgtactctttattataaaaatttgtagcaatatacacttggactgctagcattttggtagtaatgcacttggacttcatagctgctatggtttaaacattcatcgatgaatgtttgccctagattaatacacctgcacacgctagttatgtttatatggatcggaaacttaatgttgtgacctgtctccagcaatctcatgctgttcatgtgaaatgttttcaatcaacaaacaagtgcagtttcatgtatggcatcaaatcacataaatcatgacagtttaatttcaaaagggaccatgacttttttttagaacatatggctgtaagatattcatggagatttttgtcaaatgtgacttactacctgatccctttttcttcttcagaatctagataaattatgttggtacgatttcactgatcaccattaattgataatgttgacaaggtttatgtccagatgactatttcagcatagcttgtcacttcatatcccctttatctgttttaaacaacttacctttttgttttgggtgtagagtgttggaattgaaaattgatttgacttgaacttgtacaataagtggttttggttcactcatgtttgcatgatttttccccttcagtacaagttgccttaatagtccatatggtagtaatgcacctggactgctagcattgtaaaacagaaagtagtaatgcacttggactcttctggttcccagtaaaaacacactgttgaagtattcatgcatgggattatgggtgtgttgtttctgaacaaacagagttgattgcatactctgttcttcctttataccttcctgtaaacagaacgttatgccctgtccagtgccattttttgttccactgaccaatctgtactctgcaaattggccctgttttgtcatgcataatctgcctatgttcactagtacaagtagtgcatttgtgtgactgcttccttgctgaaatttgctactcaaaatctgggtaacttcactctgaaactatgcatattgtgttgagataaatatgtattgtgtctgaaattgcagcagcaggtgttgtatttcacagctgcactatatatttgctgtcatcatccagaaaataattcattttgtttgtaacaaggctttgcttgcatcagtacatatcatctgtgcattatgtaacttcttggtgtccacttctgtcaccggtcaagaaaggtgtgatcagcttcaaaaatgatcctctcaagcacattgaccttcaccacgtggtattcagcaggcgcaccgttgtcggaaaccactcggccatcgtggcggctgcaccagccacaccgcaaggagcagttcagtggtagaccattgacgtgacgcagctcgcagcagcttaggccattcacagtgcgccaccaagttttagcgttcttcgcatgccacatagaccaagaactgtataagctacatgcttcacagtgcaagccacagctcaagttgcatccaacggggcctaccatgtctcctttactccactctctcttctctctctctttaccttttcaccttttcatctcaacgctctctctctcttctggcatggatgaccagcttttctgacctttttctgaccgagtgcgaggaggttctcgtggccaaacttggtcacgcgaagcaatggaaagaacggtccccactgccctctctcctccacgtaagcgatttgtctagctggtcaaacattgccacacgccacgtgtgtgcactgtgaatgcccttatagaccaccaatgccatctccaccaccactggctgcagataagggtaagggaaagaggggagaaagaaacagacagtgttgtctcagggagttcttccaagaagtcctgaagcgactccgctaggcgggcactggagaggcttgcggacctccgagagctgtccatgcagagccgtgcaatggaggcagaggcagctaaggctacagggcttgaggcttgcttggagttggtggaaaatgatgggcaccctactggaggcccggtgtcgtcttttccgtgacccattccactaccgttgtttcgttcacctcaaggacgccgccgctcgcctggaatatagtatcaccactcgtggaaatggagctgattcctcttctggtggcacacagtagtttgtacactacacttcaatttgagtcctgttgtgtgttgtttttacaaataaacctattttgatgtttataacctcatgtgtgctaacatttggtacgatgtgctgagtttatgcaacagttgcggctttggctttattactccatttgtgcaaatttatatatcattgcatagcaggctttattactccatttgtgcaaatttatatttcattacattgctatgttgtttgccgacatatagtagtatggttacatttttcattgcaattaattttttttgatgcattcgataatgacaatgtcttgtcatcttttcgggttgtgctggtggatcgagctggacgggaggtcacacaagcagcgacgaggacgatgccatcattgagatagtagctactagttttgatattaatgagagagcaccaaggagaatactggtgtaaaccggaatcagttggacagtggaaacgttggtgaatcaaagccaatgtcgggaaatgttcagactcactgcaaaacaaatacacaatttacatgatctcctggtcacgtcgtgcagactccgaggaatagccagggtatgttcactagaaaagtttaggattttcttgtacactatgggtggaaatcgtccatgcagaggcgcgaacaatcggtgggtttgctacaactcaacagtgtcgattcacttccaccaagttttgttggctatgaacgacctggcttggaaaatatcgaaaccagtggatcccaacttcattgaatatcacccttcaattctgaatcaaaatcctttcaaaccattttaccagtcagtgggtgttgttgatggcacgcatgtttcagttcttactaattcagctagcgctatccaacacaggaaccggcaccacataacaacaaaaaatgttctagtgatatatgatcacgaggggagaattattttctgcgatactggatggccagatcagtttacgaccaaaggattctgaacgagacagtgcagtattaccccgatgattttccatgggtaccgtttggtgacttcaatttttccatacaatatttgtgtggcatatgtcattacatttgaagcctgacgtgtgaactaaaatttattttatcacattaaccagacaggtacctacttgtagactctggatttcctagtaggatgggatttcttgcaccgtacccacatgtacggtaccacagagatcaacttgctgtcaacggagcgctgccacccataggacgtgaagagacttctaaccatcgacactcgtcgttgcgaggtgtcgttgaaagacaatttggcatcgtcaaaaaaatgtggaaaataataaaagaaatagaggaggagatccccacacgcatcatacatgctccttttcctattcacaatttcaggttggatagttatgatgagaactaccgtcaaactaatcctctgtacaacggctatcccgtgccgctgcagaacgattcgctcgatcaaatgtactattcaacaaatagcgaggcagctatgagcatgttgcgtgactgcattgcttatgaggtctactatcactatcactagatgctgtgatccagccatgttagccataatgcgtgtggcatatgttgtttattaaattctttgagtctgtatagtttaaccagtactgatttatatacgatttacattaatatgtatggatttcgccagcactgattgaagagagtctgtacggttttacttattatgcatgtatttcgcattttataacttagttatcttattagttgggagttgtattactctgcgcaatttttttccatattattagcaaaattacagtacgacctcaattttgtgcggtgattttcatagtaccaccggaagagagggtacaaatttatgccatcactttcacgataaatttgattcactcattattgtatgaattgtttgataattcatttcttcttaatggtcaccctagtaatatttctggcaacgaaaataatcatcttcttctcaatatattcctagaactcatcaaatcttatgaaaaataatttcttaacaaatacctcctactaatgaaatggtttaagattttacatcgcacaattacgaaactgaatctatataaaatcgatgaaattaaatgaattttcaattttattacttatttcttctcattattttacgacccgagtgtgatgccttgtgtgcgtgtagcatttcctggcttgcatttataccctggtgcaacccaaggctgcttggtgcttgccgcgccgtctcgcctgcgcccgccggaaagtgtcggtagcccaacggcgccgtcggcgccatcccgcccatctgcttctacagtgcacagtttcctaactcccaaaatcgattcccatctgccacatacgaacagagcggcctcacatggctttgccttgcgttgggaagtggatgcgagcgcagaagtcttggcaaggctaaacttgtttaataatacagtcgacttgtaattagttatttatagtattatattagttcacccgtataatagttagctctttactattaatactagaaaaaataccattacattgcaatgggtgcgaacagtggcgaacctagaacaaaaattacccggggtacactacataatagttatctaattattcacaagtatactaatcaaaatagcataaattagttagaatttaacaattttacccggtgtcctgtgacaccggtaagttgtatgtgtgcacgccactgggtgcgaaggctattttaatcatattactgttagattttttttctaaaaaaatatatatatatgggatttttattttgatagtattgatatctaatttggaattcttattaggatgaggattataaagcaattgggagtccgactttcgtcccaagttagtatgtgagatttttaaaagaatttcttatacgattccttatgtatttccaaaagtgaacgaacttaaaaacagactcaaatatatggacgaagtatcaaagtattggcggaaatatgcatctttaatttttataattaatagtagaatgaaaatattttcaacttttataatataagtagagatagagataatacaagtagagatagagatagagaaatatatataaattcttttcttgtagattctgttgagatgttcatatggccacgattttatctcccacagtccatctatctagtgtctcatcatgtgcggcctattgcctggttctgtcgctgccgaaataaaaaaaccagcatgaacaacaaactgaatcggacgtggataaaatcatgccaaagtaaaaaaatcacgtgctctacgggatcgaactgaactgctcgccgacagacgaaaatctgaaaaaacctttatttttatctattatttttataatagataaaaataaagataggacatacttatctctctcacagagtttcttggttcttctcctctctctcttctcttctctcctccaccttagcatttagtcaacttacagcctactgttacgttgccgccggctgcatttgatcgatggtcaaaagatcctcatatccgttgccagcggctgcgtttcaatggacaaagattgtttggctaaattttttttacgtatacggacacatatttaaagtattaaacgtagcctaataacaaaataaattatagattccgcctgtaaactgcgagacgaatctattaagcctaattaatccgtcattagcaaatgtttacggtagcaccacattatcaaatcatagcgtaattaggctcaaaatattcgtctcgcaatttacatgcaaactgtgcaatttatttttttctacatttaatgctctatacatgtgtccaaatatttgatatgatggaatttttggaagtttaacgggaactaaacatggctaaaagagagaagatcgatttctctcattcttcacccgcaccacacgattcttgaattattaaacgcactgctacatgattgattttcttggacgcctcccccttttgtttccatgcggtccataagtggaaccgcacaggaaaatgggagggaccggcgccagaccatcgcccgcacaggaaaatcaattttcgtgtgcag

SEQ ID NO: 73326 - DNA, 3639 bp, Oryza sativa
ttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttttggcttataggatgctaaagagggaacaacaactggggtatctgcaaaggatagggcaaagacagttatgactcttgcatcccctgactctaagcctgaagacttcaatcggcctggtcatattttccctctgaaatacagagagggtggtgttctgaaacgagctggacatactgaagcatctgtagatcttgctatgttagctgggttacctcctgctgcggtcttatgtgagattgtggatgaggatgggtccatggctcgcctaccaaagctgcgcgtgtttgctgaaagggagaatttgaagattgtatccattgctgacttgattaggtgagtctagtacacaaacctgagctcctaatactgcatgtgcaaccaggatatatatcaataactttatcatttaaactgttataatataggccaatttggcctattaatcatgagtagttgctatcagtgggaacatatatacgctctaacttccctgagatataaatgctattatttttctccttgaaattgtcgtgatgtcctatctattggtgtgaacacatatgtcatggaattagtaataaaagattcttcttgcaattagtattgccatcgtatctgttatcctagataataacacaaactaatctcgaattgtgttgattgtagtagcccctgggttgcaactgtgcctgccctgctatttgatattcctctatgcccttgaaatgattattgacatgccaattagtgtactgagactctgagagttcttatctttctgttctgcagatataggagaaaaagagacaggctagttgaacgttcatctgttgcacgcttacctttgagatggggtaatgtccgcgcttactgctacagatctgttattgatgggatagagcatattgcaatggtgaaagtaagttgctgaaatattataaaatacttgtgttggaattagctgctgaatcagttttttttttcttgtcataagcctgacttttaagttactcatccaatcactgacagggggagattggagatggtcaaggcgttttagtgagggtgcactccgaatgcctcacaggggacatttttggatcagcaagatgtgattgtggtgatcagcttgccatggcaatggagatgattgagaaggctggaaggggtgtactagtttatcttcgtggacatgaagggaggggtattggtctcggtcacaagctccgtgcttataacctgcaagatgacgggcgcgacactgtggaggctaatgaagacctaggactgcctgtggattcacgggaatatggcattggtgcacaggtaaggaattcatggtatcatacggcattcgaatatagggggtgtttagatccaagggtttaaagttttggtgtgtcacatcagatattatatagggtgttgcatggggtgtttgggcactaataaaaaaactaattacagaatccatcagtaaaccgcgagacgaatttattaagtctaattaatccgtcattagcaaatgtttactgtagcaccatgtagtcaaatcatggagcaattaggcttaaaagattcgtctcgcaaattagttgcaatctgtgcaattaattatttttttagcctatatttaatacttcatgcaggtattcaaatgttcaatgtgacggggtgaaaaattttggggtgggatctaaacagggccatagaaaacaaaatgtcataccctgcttatagccttgtacaccagcttaataaagaaccatgtggtttatatatctgttcatagcatatgtttcaacttgcttacgttgaggcctgaggggctgtaaaggcatatgttcagaatctgatgcatacaaccaacaagtgtagatgaaataaaaaattattcccaactgaaccaaaatatattttctactttaatggacttggccgccttgcttagcgctttcctttcttgtcatgaatttgatgctgccaacaatttcatggagacaatttaagaattaccatgcattcatttcatttgttcaatggattgacatttgtactgttgctttgtagatattacgtgatctgggggtccgttcaatgaagttgatgactaataacccagcaaagtatggtggtctcaagggttatggattgagcattgtgggcagggttcccttggtaactccaatcacctcagagaatcggagatacctggaaacaaagagaacaaagatggggcatgtatatggattggccaatggccaagctagccatcagacgggcagcaatggtgccaaaggggagcattaggccaatcggactcaggttcacattctaatccacgacaatcttatgtgatggagtttgtcaaattatgctacaacatatgttcgtggtgaaccaatttttttttagctgacagtaggttgaaagatgggcgtaataaaagtatccctttatttgttgtaatccacagccacacaactgggttattactgtaaatatatacacacacataaactgctccctagcgggtacagactccagccttacctgaattgagaagactggcgataaaaatatcgactgagatccaaggcaatactagtatgaatctaactcccaatattgaaagaatttttgttctgggaagcctttggatccttacattatttcttgcactacgcatatgctgccagagtctttgtcaagcgatctgttcttgtgtttggctgcctttttctcgctggaatatgaacatcgactattcgactgatgctagtctgagctaaaaatgttgtactgactactgctaatacatacggcccctgttattttttttattaagatactgatttcatcttagtttttattaacatgcttttcaaactatcaaacggtatatatttcatgcgaaaactttctatatagaagttacttaaaaatatcagatacatttttcaattttaaaataactaaatttcaattaatcaagtattaatattttttttacatgcccggtatttaatcatcctcttaagcaaagctaaacttaaacgggggcaataataagctctcaaagaacctcgccggataagccgtggcaaggaacataaccttgtctcggtttctttggtttgctcagtgggcgatgggaagttggtacggttctaggaggattattgcctacagggctcttcaattcggtcgctggcgcccgcggtctacgcagctgttcccgctcggttccggaacagacgaacggtagctgaggctttgcaagacaagaggtggattcgagacatctgttcggcattggggattcaggcaatcctggaatatctcaagctttgggacattctgcgattggtttagctaggtgaggaaccggacacgatctcttggcgttgggaaagctcggggt

SEQ ID NO: 73327 - DNA, 1524 bp, Oryza sativa
atttaaatgaagaaattcgtaaatattcatttaaagagcatataaacttcaaatggccataacttggccatttgaactcggaattggaccgttcaagtctctaattttttcttaagaagtcaagaacccatttttgtgctttgttcttgcttgttatatggagtttattagagtaaaagcccttttcttttccgttggtcgtgtagacgctgcagcttcgaaagatccgctcttcgtggaggttgaagccgacgtttgggaaagcgagcaaggcaagtcacatcattctttgaacatattggatcccactttatgaaattactttgatttaaattattgcattatcactttatttaaattcccgcgttatcactgttttatttagccatgcctatttacctttgttatgaccttattattgctattgtattattaccttgttcaccctagaataaacaaaacccctactagtgggcactctactcatggttcccctggtatgaatttaggtagatgcttcgctgattaataagacaacattaggtggtttttataactttagactttgggaacattcatatctcttggactttatggaatggttggactattgtggaattggatgcacacctctccctctattcaaaactctcaaaatggttttacgctgggcttggggtgcatggttttgatagtagcacctcgaccacataaggaccggacttcgggcctctgttgcaaagcactaccgtacttccacatgtctagtgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggctcgtgagggttcacggccttgtttaataatactgtgtagctctaggatcgtctttacaaaatggctttgggcaactaagtgacttttaaatgctgtttactgcaaaacctaacccctattattattcccttgtacccccccttgcattaatcatgcatctgccggtgtggcttgctgagtactgtggttgtactcattcttgctcaatccttcc

SEQ ID NO: 73328 - DNA, 670 bp, Oryza sativa
aatggaggtagagtgtctgatagtgaagattcagatcaagtctcctcagatgatgaagatgaagtagaacttaaggcatgccctcgttgtggagaaatcggtcatgttgccagctcgtgtgcctctacatgcgttcattgtgaggaagacatctacccgacaggtgtccaacgagcaggatcacttgtttcttttgtgaaggaactgatcatgtaccaaaagattgtcaattcagttttctgctgacaaagaagatggccaaccaacccgccagttccaacggagagaagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagcctgacaagacaggggccagtatctgcgttgtacctttgg

SEQ ID NO: 73329 - DNA, 7141 bp, Oryza sativa
acaactcttcgtctcttcccagttatcatgaagtagattaatatttttttatagttgaggaaagcataaacttcctacactagtttatataatcaaactgatacatattaatgataaacaaaaaattaacattatccattgctggcctgctgagcctatatgctcgtttttatacacatttcataccgtgctgtaaaatttttcatacttgcgcccattaaatatataaacaaaccatcgaaccaccggttcactggttgaatcactagtttgagataataacaaaatgtaatattccttaccagtttggttgaaaattcaaaatatacaataattttgcccttccgaacacaataattcttttcaattagagcatgactcgcaacaacttggccctgttctttattgttccagtgcaaaactatctgtccaattggtatttgctggttcataagttggaacagacttggatgcaaaccaaccaaaccaagcaccagcactggattttccagtttactggtccagttttttggactataagataaggaaacacagcacgtttgattgaacaaatttataaaatatcctaaaatgtgttgcttgtgaaataaattgtttttcattagattttagaaacaacaaatagaatcataaaagggacagatgtcaaaatgagtcaaggtagatgttatggaagaaaacttttatctgcccatctaaactattgcgatatatccactttactcccgaagtaaaatggctatataaagaataaaccaataaaccatctaaataaacccctaaggatagctccaaaagtggttgtcaccatggcacatcacaaggcagatgatgtggtgccggtaacaaattttcaaaaaaaaaaaaaactgttaatcaataaacactcctccgtgtgtacacatctttctcttccctgctgctgcccttctctatatatctgcagcaccgactagctacgtgtcattgattttgatcttgctttcttagtaacaaatttgttggttaccatgttatgaattatgtcccatagtagcaaaatcattatagagagttacctaggaaattttgcacagttccaaatagttggttcatgaaaaatagaaaagacgacgattgatgttttcttacttcacggttttgaagttgagtgggtaaaactaggcaaaccctagtagttcaaacttaaaaggggtcaaatagacatttttctattttaaaaggataaaatatgaaataaaaggttaaaaaacatgtgaaattggataaattagtactaacacaaaaatatagaaggatcacaaggtcagaaaatagcataaaaccaaacatttagaaaaagctcatatagtggaaatatttaaagataactttcaacgaaaattatatatgagtaaggcacgatatattaatatataagattaggacatccagtctcattaggttgttttttttttgcaggaaaagtatactgcagagaactattctttacaacaattaagttgaaaatctgtaactcaaaatcattgagaattaactaaaagcacatagaaggatcagaaccacataaacctggtagtaatgtaggcgtggcaacaaggcatttatagattttttgttgtgacttggatgtcttctgcaatttcctcatctgacatgacagccattctctgaaatagatccgcaatgtttgcacccatataagaatccgggccataccagacattaagacctggtatttgggcaaatgcctgaaagattaacggataagagtaaacaaaataaaatgagttaatgtagtgaacaataattaatgtccattctcaaaaaaccattcatggttggctagagtttgtagtagacaagaaaaacacctacctgtaatatagttgctacaacgtttgaagaagtgcatgttattgtaggtacaagttcatgagcatgagcttttgtttccaaagaagtattgatataaataacatgtaaagaaggaggagatcttgatgcttctttcaaaaaatgtgtatatgcagaacttgaagcagcgtctgccaatgaacagccaatttgatcacttgacattctataaacaccaacctgcataaatatacactagtcaggactcaggagtagaaactcagaaaagtacagaaatgtctaataaaatttatatcagatagctgtggattgtaaccatcaataaatggatacactgaaaatgctaatatgtttgactccaaccaatactttgtaacttttatttagctgcaagaccaacagaatgctgcaccataaagtctaaaattattaaatacaaataaaaagtagatgcatgtacctgttataattaccgatagcatggcataattttcataacaaaaaaacttgtgttgttacattttcattctaatgtctgacaaataacacgtagatattatttttgtagtttcttcatggcaaactgtaaaacagagctggttcttaatgcaaattatagttcacaattgcataaacattcattgggactatgtgaacaagggtgtcaattaggagaagggatctagaacagctaacctaaaggagagaagttcatcagagacttgggactcttaagacttttttggtccattacatgaaccactacaaggataggtattgcacccaattcaagctgtttgatgggccgaaatccaggcccatccacttgtatgggccagggttttagttcaatccatcggcctgtacatgggtagggccagattgaggcccatgcaaacaaggccttcaaagggattggccccactaattatctgtcaaacaatatagaaataaaatgacataacaaaaatgaaacaaaccaacctaacaagcaagtaaggagttcctggtaacattctatggtgtcacagacagacaagtgttcctattttctgttgatgaagaaacttgacaatgtgtctaaataattctcctggcacattcactccatattttgcaagtcataactaatagatcgaccacagaaccatggaattcttcaaatgttaaatgtaaacaagttggaattgtagaactaagatataagtcataactagtagatcaaccattgaaccataaaattcttaaaatattaaatgtaaacaagttggaattgtggaactaagatacatatgcttactcccaatatctctgacacaattgagtataagaaagcttgtggttagtgttctcttaaatgcacatgctcccatcatccttggctatagtttcatatgtaaaacttcaaacttatattactgctgcagaacaatttcatactttttaacgtgcataactagggaaaaaccaagtttggattatgcaatgaggacttcaaaatcaaaatcaactaacgattgtggatgaaaggatctttatagttataactagtggataccccgcgtgttgcagcagaaaatttgaaaatatttcaaagataactcgaaaaaaataatttgtaaatcatgtacacgtaatatctaaatgaacaatatttgttttatagtaattgatgtgaaactacaattctacatgacatatggatgattatgtatcaaacatgagagggatccaatggctattcatttctaggtgtcatggtttaatgtacattaagctttatagcaataactacatttagtgggttgtaaatgcatatggtaaatgaatggttgagatcaaagcatgagagagatccagaggccactattttctagataatgtggctcaatgcatgttaagcttttggtctcaactatataggatatatagatactcacagatgcatctgtctgtttgatctactcatttatggcatggttgtagatttgaaaaacatagctactgatctacagctctacgcatctatcaatcgggtccaatgagttctgtaacttagtccttccagtaaacaatggagacagtagaatagaaattcttcaaacttaatgacaatcagtgatataaacacataaataccttgctatatccagcttgatcaagtattgcacgaacattttctgacataaaatcaacacctaagacagtgatatattcgcatcctgcttcagccatcttcactgcactatctgccattaccaatgaatcagaaatgtggatgtgaggccaatgcttctttgaagcagttaatatgccttgcacctccggatccatataaaagtgtgcgacaatccctatttttttctccctaagggattttacaagctctgaagtcttggattcattaggagacaagaacattgcctgcacttctcaaaataaaatcagtcagtttcaagactacatggtggaaatgaagggaatttatggtatttctattttacatttgttgaaatacatagctttacaggaggtatttctattatgtacaacaaagtcacaaccgtaattattcagggtatctaacatattggagcatccccaggagatcctccatcatatgatggtgtacgggaggtgaaaatgggcctccagcagatacggcatgtttccgccaaatatggatgatgcgccaaagcgagcatgtttcagccaaatatagcgattctctctcctcacaccatatctcaacgcccacatctggatcgagctcccgcccccatccggacttccgtcgcgacgtccccttcgtcgtcgtcatcgccgttgccggccacaagccgccgacgccaagccgtcaaaagccacaagccgccgcagccgcttacgagcttgccggccacctgcgtcgctcgccacctcagcatctgccgtcgttgcctgtgtgccttcgcgcccgccagccattgccgtcatttcctcaccctccggccaccaccttcacttctgcgcccgctggccgcctgcccgcctgagggcgttgtcgcctgctcggctccgcgcctgctggcctccgccaccgcttccacggctgtcggccgcctgcgccacccgctcgcctcagcttccaccgccagccgcctgcacacatccactcctgctggccgacagccgtggaagctggagtagtctggacaggatagaagagaggaaaagacgaagaggatagaacgatagagaaggatagagaaagagagaaaaagaggaataggggttggaatagaatagaggaaagggcagagcatgggtagaaagttaaaattacccattaaaaaaatatccgttaaaatttactcattcgagagattatcaagataaataacactattaaaatttagtcattcaaaatatagcccttaaaatacaaatgtaaagttagttaaaagatattactaaaatataggagggtgtgatatggatgatctaatgaagtggagagggatatgaaggaggaatcatttttggatgctcatccatatgggcatatggaggatgaaatttggatgagctgctggggatgctctcaggtagtgtttgtgcaatcaatttttagttgtttaatcctttgaacaaagattttttaaaacatgtacaaacaaaaagtcccctacgaccataactacataagttgaaacatagaaactttgaactagcattaatatgaaactgagctgcttttgatgacatcaaagaataggttaacacatatcatagccccacagaaggtctctaaatataaatggatacaattgacgggtgtacttaaggtagttcaaaaactttattttcaaaatggtattaccagtgctggtaggatttgatgaagcaaattaaactgcgttgaaacattacaacactctattgttaaagtaggaaacagagacaactgctgccacaccccatgggcactaaaaccacatagggagaatgagctaagaatctgtaatactagaaagagagaaaaaataaaagaaaagaactagtagccttatggtccatttggcacaggtggccttgtggcccattcaggagtacaaggccatgaccatgagatcgatcagagcatgtgagcattttcacaaaatacaggaatgtatattacatattgcctttacgtagcatgaataggtgtttagggttactaactctttagtatagtttcctatatcaaaaggcagtattatatcccttgcacgcaacatatcctattgaagtaatattgttgttaggagtcatgactagtacagccttttcatgtatacttcccctcgcacaaggaatttgatatctttgcactagtagagaggcgatttcaagcaattgagtaagtaaattcctaaagcaaccggccaatgtggccacgcaaagtggaaaaagtaagaggtgatgttgacatcattaggttgacagttgagtctccattcttgaccatacacataaatatgaccactagtcattttctcatttacaaaaagggagaaatacactgaccaatagaaaagctaccttttctttgcaggtgcaactttgtggaaaatggaaatcggcatccaactttggcagattctatacgtcaaatatatccaagaaaaagcacttacatttttagccatatcctagtgaaaagcaacaaatcaaagatatacactactttctaatttgtagaggaaaccacgtcttttcagtcagagatcagtaatactggagtaactaataagaagagctgagtagctccgtgccgtactgttaacccttccgaagagaagcttggacaaatgatggagaacacggaacatggcaatacacaggaataaaatacagggaacggaaggaataaccaataaaagcaacggaatgaacataataaacaaacgagcaaaagatcacctgggcttcagcgtaggtgccttgagcgcggatggcgccgtcgcggccgatgataagcgacgggaacggctccccagcaggcctgccctcacgcgccgcgatggccgcccgcgcacgcttctgcatgccaatgagcacgttgtgccaggtgctggccctggaccgcgcccccgtccccgcggtggccccaccgagcggcgcgaggtcggccgggtccacgtcgagcacctcctccgggcgcgccccgtcgagcgcggagacgaggcaggcgcagtacccgcgggagagctccgag

SEQ ID NO: 73330 - DNA, 10867 bp, Oryza sativa
  unsure (1)..(10867): unsure at all n locations
gcggcgtagggggcgcgtgctttttcgtagggtggatcggtgcgggtggtgttgggaattggaaattctgaaggctcttggaaaaagggcaaacgcagcttcaccggtagtgcactgcagtggtagtgggcggtagcgtgtgaaacgttcggacgctgatggagtgggccagtggcgcagccgtccacctgtcccgccatgcgatccctctaccccggtcatccaatgatcgtgttagtttgagtactgccgggaggaaattcaattcatagcacagcttctcccagtagcagaaaatagcacaaaaaaatttatgcctctttaaaagcacagctccgtcatttttttccaatcttacagcacttccatcagtttggccgttagtcagaggaatcagaatgcagaaagacaaaaggaactttgtttcaccatcgtcctcctgctgtcttatttgcttctctccaagcgcggctgcacggcaccgtgtagcctacgcagccatgtctccatggctacgagctcgttcgaccgcgccgctattgtcggagcccgttcgccatgcttttggatccggacctcctcgctaccttctgcggcgctgttgacacttacgcctgggtgctcgaggaggccaagcaccacgacgatgacaacgttgttgttggattgggactgcgtcgtggctggttgctactgctattgcttgctcaaagccaaccaacgatatcgttgctttcgcatttcttctgttcttgctattttgggcgtcacagcgacatcggcatcagcgaggactccgtgggagacggtgccagccgggacgagctccgcgctactgggcctggacgccgcgttgccgcactcgtgctgccgcagttattcgtggatggccgatattcgggcagccgacgaggtggtcatgcgccaccgctgccgtagagagcacagagaggaagggaacgtacgaggccattggtttgacatttttttctacttcctccgtttcacaatataagtcatctagcatttcccatattcatattgatgttaatggatctagacatatatctatctagatacattaatataacttacattgtgaaacggagggagtatttttctaggattttggccctttttttgttagaataggaaaaccggttatattaactcgtcattcgctgaaccggttagagcatctccaaccgtctccccaaatgcctctccaagctaaattttagctagtcaagccaaaaaaaacatgctccaacgagttgctaaccggatggctaagccatccgactggccaaacacccacaccgcctggccaaatgtggagaggcaaactcactggccaaatggtgagccccacactgatttgtgtctccgactccgcctccttatccgggcgcaacaaaggcgtcaacctcggagcagcggcgcggacggggatggagctgaggatccaccgtcgctgtcgtcgttgccgccacatctcgatggcgtgagcagcagctgaggaccctcaatgtcgtcgtcgccgccgatttccgccgccaccgtcagatccacccgtccgccccccgcctcccttgccgacgcgagtagccgcagcccgcagcatcgcctctgcctctcattcgtgccaccagcagcaacgtcgtctccgccgcaagtagccgaagcccgcagcctccgcccgtccgctcgcctgcccacccacccccggaggatgcggcggtggggcggcacgacagcgagcgtcgccaaggcctcctgctcaccggccgctggcgttgagggcatgaagggagtggcaacggcgaggtgttgccgtcgcccctctccttgacggcgacgtacactgtacgtcgcctctgccccggccacatccggcactgccgcctccgaccccggccacatccgccgccgccgcctccgcgcccggccacaaccgccgccgccactgcctctgcgcccggccgcatctgtcgcgcgggaagagtgccgagggaagaggaagagagagaaagaaggtgtagtagaggctgatgtgtgggtcctagtgtcatagatggagagtatagatggagaggttgttggagcgaggaatgagtttggcttgacaaatcaattgaagagttggctatgggtgtgtttagttcacgccaaaattggaagtttgattgaaattggaatgatgtacagaaaagttggaagtttgtgtgtgtaggaaagttttgatgtgatggaaaagttggaaatttgaagaaaaagttaggaactaaaccaggcctatatgagtgtttggagagtccaatttgaagaagctgttggagatgctcttaggtttgacgaagatagcgaagcagttgaggaggagcccttgactgagaaaggtaagtcgctacacttgagctagggttgggtgctcgagatgcaactcgaggacaatagtacttaggctccgttcggtagtacaagttaccaactcctcctcctcgttttttgcgcgcaagcttttcaaactgctaaacggtgcattttttataaaaagtttctatgaaagttgcttaaaaaaatcatattaatccatttttgaaaaaaaaatagctaaaacttaattaatcacgcgctaaaacgctgcttcgtttagagccttaggggtagatgccgcaaaaagggaaactgacaaatcaggccatgatttcacatcccaaatttaccctaaaaagtatcttttaaattattcatagaaaaagtaaaaattggtttaaagcttccaacattaaaaatatacaatctaaaaaaatcaaatgaggcttagagaatttttgtatattttctcaaggcctaaaaggcttaacaaaattttaatggagttttcagagcacaaataataattataaagcaataaagaaattattatgaattttcttaaaagaaaaaccctaaaaacctccttctctctctaggccgaaagtcggcccacttcctcactctctcccctctcaccggcccggtctatctctccttcccccgcgagcacgctggtgggccggcccactcggccacgccctgggccactatcatccccgtcctctcgccgcttccgcctagcgcctccgccgctgccgcgagtcccgctgctcccggccgtttccgtccatgttggaaggggaatcactccccaagattccctctctcattccccccacttacccctctctctccctcatcaacgtggtcagatttagtccggcaaatctcgctggcaccattgatggcggcaaaatttgccgccatcgtttccctctctcctcggctctctctctctctctcccccgttgctacaaaaaccctcaccgcaacccctctctcgttttcgccaccttgcgcttcctctcatccatagaatcgagccaccgccatctctctctctctctccgtcatcaccgccgagctccagccaagcctcgccgccattcaggacacccctcgcctcggtgccaccaccactggcatcaccatcgccgccgacctcgtccaccccctccccgcgccagcgatcgctggaaccccgtccgcaccgttgacctgagtcgcgccatcgtcttcctcctctctggtcaccattttcgccacctgccgccgtttggggtgaaccacaaatgtaacatcccggcccagagcttaataggattaataaaatactcatatcaacaagttgcaacttcttttccggaagcccgtctccgaagaactctgaggactgattgaaaaaaagacttgtgttggtttgtgagggcagtcgatgacctataaaagctgccagatgtaagtgggcctggcctgggacaaggtgtgtcaacaagttgcaacttcttttccggaagcccgtctcaaaagaactctgtgacgtggccaaccttatcgacctataaaagctgccagatgtaagtgggcctggcctgggacaaggtgtgtcaacaagttgcaacttcttttccggaagcccgtctccaaagaactctgtgacgtggccaaccttcgggcgcaccgtgtggccgccgcgtgaggcctgcccgtcagccaccatcgcccctccggtggctgacgtgtggggcccacggcgccggtggagggcaaccctgtgagcccagtccacagttgaccgtgaggctgtcgtgtgggccccaccccatggacctggctcatgcgtcaccccggggtgctgatgcaataatcatttttaaattaaagataattcaagaaaatagtaaataatcacctaagcaacatataaacttgaaatggccataacttggtcgtttgaactcgggattggactgttcaagtctatatttttttcttaagaagtcaagaacccatttatgtgctttgttttggcctcttatgtggattttattagagtaatagtctttttcctttttatcggccgtgtagatgatgcagcttcggaagatccgctctacgtggaggttgaagccgacgtttgggaaagtgagcaaggcaagtcatatctccgttgaacatattgatgtcccatgttttaaaattattttattttaaattattgcattaccactttatttaaattcttgcgttatcactgttttatctagctttacctacccgtctttgttatagccttataattgatattgttatcataccttgttccccctaggaaaataaatccccaaactagtgtgtactctatctatggttccactagtatgattttagctagatgcttcgttgtttaactaggcaaccctatgaggttttataactttagactttgggaaagatcacatcacttgaacatattggattggttggcataatttggaattgggtatacacctccccctctactcaaaaccccccaaaatggttttaggttgggctcggggtgcaaggttttgatagtagcacctcggtcaccataaggaccggtcttcgggcctttgttgtaaagcactaccgtacttctacatgtctaagtgggtaaggcttagtttatagcccagtctggtcatgagcaaaaggacacaaatagagatggatgaagtagggtgatggatatctctgaggcaaatgaaggctatacgaggaggtgtccggtagtcaagatctcgtggcatgggatgggcatccagaaggccactcccgaaggatgttctaatgccgtggggctcgaccataacctacctgtcccaggaaccccggccgtaggtgggcgttgagttggtacttttgttcagggctagggtgagcgaagaagtatgttacgccctccgtccatataccgtggtggtatgtggcgtgtggcgacacgtgaggaaggcgtgtcttgtgggtaaagatgtacacctctgtattagtgatatgccctagaggcaatcatagagatgattgtatcacatactatgtttacatatttatctgactttattccttgaaatagataactcattattggttaatggatatgtgattctttcatgagactctttatgttgtttgttactatttctaaaggatccctgatcaaatatcatatgtggaacaaatatgtttaaataatcagcacatgtattaattgatgatcatgtctcatggatcatgatatagagataccaaattaataatgtggacacatgttggtgaacatgttgttggatagacccaacatgagacactgcaagagccatatgtgttgtgtcatcagtgatcttatttagtgttggtgttgaatccttagacctgagattatcatggttcccaacatgtgtagtagcttacttagggactactaaacgctactccgtaattgggtagttataaaagtagtttttgggtatgccatgaaacatgtagtgggatatgaataatcaagatgggatttgcccctcctatggaaagatatctctgggcccctcgatgttgtagattatggaagtgcatggccatgccaaaggtgattgaggagtcaatcacaagttatataatgtatcaataggttcgagtgaatgattgagctattagaggatggcacatatctagccttgagcttaatcgatatcatgaggcaaagtggttcatataagtatacactagaggttcaatcgatatgatctttatgtatgcccggtgggtcaatacgttctgctaggggccgctgttgacgcgtgaactgaaaaggagtttttgggtttcagccgagtgtacatgaacctacagggtcgcacgcttaatgggccggaataggtctcctacgtgccttggaggcctgagtgatggatcctatatattcgtgaggggtgtgaccagcggaggtattgcatcacatgagaaaccctagccgtcactcccctccccgagcaaaaccctagacgtgcgcgggtgctagcacatctgcacgtggcgttccgtccctgtacgtgtggataccggtagaggcgccgctggtttgcagtgctgatcggggtgggaatacggcgaggagaacgcacgaggaggagaaggtcgagctggtgcgatcgactacttcctctacatcgacgcgctacttcgcgagaattccttcgacttcttagagccttcttccgctgcgcagcgcgtcgagtggtaacgatctatgatctaataattgcatggttcctggtttacgcaatagaaaattttgatttatgctatcgtaccctacgcgtatcccaacactctgatcagagtataacctatttgaatagccataccctcggttatgggcaagcctagcaatgtacccaagttagtggtttcactcttaaaacttgttaatcaactaaaacctggaatggttttcctaggttggcttgggacgagctggggcccggctttaaggctgccagttcggtctgacttatcgtaggccttgggttaaggcaggttcgtgtaggttcacggccgtggataattgtaatattgtgtagacctaggtttgaatttattaaatggctttgagcaactaagtggtttaaaaggttgttttactgcaaaacctaactaattattattacacctttgtaccccttatatttattgtgcatttgtcagtgtgacttgttgattacggtggttgtactcaatcttgctcaatttttcccccatcccagaagaggaattcttggaggatgatggcttcggtgtctagctcatgcctgccatcaagtgcatatggtcttcgccctagtcttccgcgcttcttcttttatctctgtgtgttgggcctttggtcgcccatgtaataaaaatactatttacgcttcctcttgttaaactctaatattgtatcaacctttgtgtacctcgtctcctgggacaaggaataatgcacgcacgaatggaaaacctgtcacctgtcgggttatttccggtcgtgacacatgacaagtctcatgtgttgggcacgtcacgaagtgcatgtaaagcatacatccactgcaatgtaaataaataaatctattcaaatagccaagctcatggttaaaagagcaatggaattttcaatactcttgacaagcctcataatatttgaacttgcttagaataggttggataatgatgttggacaaccccggaaggcgggactggtcgttggttaagagaaatggtgattaattgaatggtgaagttaaactgaaccaaggtgggggtttggggaggtggatgaaccctctactattaactacaacttcaacaatatcattgatttaagttaaaaataggtaagtcgtaggtttgcaaactatttaaagaaaactagttttatgcaaaataaacccaggccgctccttaattccatgtgtgcattgtagtagtggcttgagagtacgttcgtactcatcgtggattatgcaatcataaacatgtaatccttaattcaatctttctcttagatgcaagcaatattatagatcgaacctaatcgagacagcatggattgctcgtaatttagacaagatgaattaaagtttacatgagtttatatcacaacctatgatacaatacttaggttaaaatatatatagtatcagctattactctgatacagccttatataagaatatcaatctaggaaatatagtttaaataaagtgatatacttatataaaggacaaatataacatgaaaaacatgattaaagaaattaaacatagcataacagttatatcaactaagattgactgaatccatgattctacccctattggcaatcaagaagcatgttagttttaatgatgttagtttttatgattctaagcaggacttagtaggtcaaactcaattgatgcagcataagtatgaaaaaaagcataaagtctaaacaatcaagcttttgaataattttcagggtggtggataccttagctaatctaaaccgacaaaatgataccggcaaaaccctaggtttggccgaaagaggtaaattgaatcatcaaattagattagctaagatatatgataaccaacaattacaaatattgttttctcccttatagcacatgaagtcttcatctgctaaagctatttgctccattttacaagtttggatatcatacttatagaacttttttaatgccaatagcaacatttttccatgaaaaacaactggtggacttgctacaggccgctgaataattgttggtggaccctgtatagtgcatcatcgtttactcgagtctattcagggttctgcttctgcccaacactccaaatctctagtgataacactggactgaaaatgaaacaaatagaattcatcctccacttgggttgaactggaagactttacattgtttgggttacatggaaacatactcgctgtgttcgtttgtggttgggaaccttccctcgtcacgcaaaagagagcgatggattagcgtgtgattaattcagtattggttaaaaatatttgaaatagattaatatggttttttaaagcaattaactttcctatagaaaatttttgctagaaacatactcttttcattttatattgatcatcatataagtattttcaccaagataaaggacttaactataccgtacaatttatttaatgtgagtatgtggtgacaacaatcaagaaacatgttgtcatgggcattgggcacaaaggcagaggccgtaggcagtccatatcaattaagttagagttaagattattagttaagttagagataatattagattgaatccttactcaggggtcaagctataccatctatataaggatgagattgtatctattatcattaagcaatgaatattaattagtctaatctctccctcccaacaatgtttttctctctagcctaaatctgcatcccttctctaggagccgacgccacccggctatctttccagcggtgtttatcccatcatgaccttgggtcatgacacatgtagactttttactccactacgaacaagaaacgagccattacctacccctgaatgcctgcatgcatgtatgcatactcaatttgcatgcacagatgtaatactattgcgtgtcaaagtcagggctatataatggtcaatttgaaatatctgatttttggttatatgataattaacatggaattataggagtattagtatttagtagtttgagaagcgtacgcgtgaaaatggaagttagcatagcttagtggagaagaaccttatacttgttgctacgagggtcaactccaaatctaagcgttgtaccatggttgtctttagttcacactgaagtttagaagtttggttgaaattggtacgatgtgatagaaaagttgtgtgtgtatgaaagtttgatgtgatggaaaataattctctgattgacaggttgtagaccatcttttttgtccttcatgttgcaaacgaggaataaatcatttcagtgcatagggacgcatctataatctgtggaaagtatgtgaacgtattgcattaccactcatacttatataggcccattaagaatgaccctttctcttcgaccattcaaggtgagcaatgatgaaaaatgggctggatatcctgcgatgctaagccttgcatacaagctttagctcttcctgaatcgtctacttactgaattatcagcagcaaccaaattttaatttatttttgaggtttttttcagcctaggctatcatcaaggattgacttttaaaccgtgaataatataaatataaaggttttatttattaattattttttgttgctacattgatatttctatagtccatcagccgtaggttgagcaaccgcactagtacgaaaatgatttttgtgtgtggacgaaaaggattttcgcgtgcagatcttgcgcccatctgcaacggggtgtctgcaaaaatacatttttttcgtgtgggtgacgcacccgctgttgatgcgaaaaacacacactagcctagaagatctgcttagctccagtacaggttatttgatgagatgcaggcataccagttagtttgatcctacaactgacaagatatataaacaatagatcaaatagccgatcggccgacaagccgatgaagtaattccagacgatgttgatacgcnncatgccgatagggtcttgattggctatatgtccaatgtagaatctggcgcatgaataaataatcatacaaagacaatcggctaatgataatcaatatagtaatataatccagtagaaaccaactgtctaataatgatatgataaaataagcacagattcaaaagttaaagcatacatcggctggaagaccgatgtcattaaatccagaagattagataaacagtggaaccttta

SEQ ID NO: 73331 - DNA, 716 bp, Oryza sativa
agtaggtgggtggaaaattcactgccaccaccattggaatctttttaaaggagtatagatacccatgcaagttttaaaattctatacagcaagccatataaaaatctggaatcagttttacttttattttaaaaaaacatcctttttatatacaaatcaagggaatactaattctctttctttctacatgcaggaccgcgggtcactcttgttgcaggtaaggaaataactcaatcttttgtccattctgcatgaaatttcaattaaatgccacccaatttatgaactttcaacaaagagagtgtatatattttctaatccaaataagaaatgccatgattatcttgacaataaaggcacatctggaaaataaattacagaattatgtcatctccaaatgcagctaactaactttcttatttttcaatcagctacatcatctgtagccacatttgtaattctttcattagttgtggccactgcattctacatctccttaaagtcaaggtacaacaaagagatacatttgaaagttgaaatgtttctcaagacatatggcacatccaagcccatgaggtacactttctccgatgttaagaaaataacaagacggttcaagaataaattaggccatggtggatttggaagtgtctacaaaggtgagctaccaaatggagttcctgtggcagtcaagatgctagaggggctgcaggaat

SEQ ID NO: 73332 - DNA, 4743 bp, Oryza sativa
caccaaccctcccaagtcccaaccgagctgagctgaccgcacgaaaagccaaccgaaaacggccgggaggaagaggcaaaaacgcggcgtggtgacgccaccccgcgctccgtttttctccacgcgacacttgacttcaccgcgacacatgacttcaccgcctgacgccgcctcaccacccactcccccctaatccctccttcgcttttctacctcaacacgcctcgttcttcttcttctctctctggttttacatttttactactcctcctagcttcccttcatctctctcttgatggcgaaacccttccccgatccgccgaaaccgccggtccccgagccgccgaaaccgggctccgatggcgcctgctacgactgtccctctcctcctcctcctcctcctccccactcgcgtgaccaccgccgcgtggtgatcgcgctcgccaccaccgcgtccctgctcttcgccatcctcctcgccttctccgtctactgcttcatccgccgcaggcgccagcagcgggcgcggcgtgaggcgcttctagcacctcccccttctgatgcggctggaggaggcggcgcaccgggtgcgccggtcgccgccggcgacggggcggtgggcggcgccggggagggggagggggagggggaggtgctgcaccacgcgtggcacatccgcaccgtcgggctcgacgaggcggcgatcgagtccatcgccctcgcgcggtaccgcgccggcgccggcatgctcggcgccaccgactgccccgtctgcctcggcgagttccgcgacggcgagctcctccgcctcctccccaagtgcggccacgcgttccacgtcccctgcatcgacgcctggctccgcgcccacgtcaactgcccgctctgccgcgcccacgtcctgcaccccgccgacgccgacgccgacgccggggacggggaacgcgtcccgccacccgccggcgctaacggcggcggcggcggcggcggcggcgcagccaccgaccaagcctcgagccccaccgatcaaaccgcggaccaagaaaaccctggtcaacagcagcagggggagcagcacgagctccgggtacaaatcgatcggcgcgaccagcccagctcgccggagccgccgcgccggagtcccgacccgcgcagcgcgcagagtttccggcgagtagcctccatgggctcgcgctcgccaccggcgccatccgaggatgctcctgaagacgagcagacgacgacgcagagcagcaaagagaaacaggggagcggcggtgactctgcctgctgcggcaaggcgccgtcgggctccggccgcttgcaccacatgaggaggtctttctccggcggcggaggccggcgatctctcccctcgcggcatggccgcacttctagctcgatgctgccgttgtgatcatctcgggggtaaaaagaaatacaaaacaaaaatatttactgaaatcgattgtgaactcggtatcctgtacagttgtgaacacccaaagagagattgcatcttacatgtcagatatatgaagaaatgaaccttgagctggagttgatttttaccttatattcctactatatttttgtgttgtgttcgttgcaattgcaaagatcgtacttaaaacttgcttgttctagccttctaggatgctaattactaatcagcacatcatacgcagcataactcaggtgtgacattaattgcatctcattatttattcgtagtctcacaagtagtcctatactcttaaactgacagtagtcaatgttgacctgaacatgaggatgccaagttgcctcttagagcacccgcaatggtaaagtaatgtgttatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaaataggaaaatatgctgatatggatctcttatagagagcctatagataaccattgtgggtgcccttaggacgcgtacggaagttttgctataggggctgtttggatgctatacttttcatgccaccattcaccatactttttatgctacacttgtctaagttgtggcttataaaaagtgagccacaccttagctagcaaaattggattgtgccacactttagtgagttgatgacatgtggggctccaatagatgagaaggaatcttgccacaagtgtggctatgaaccaaacaatatgctaacttggtcaaacttacctagcatgagatgtggcaacctttggcaaactttgagagcaaaccaaacaacccctcacgcgcacaattggcagataattttgaaaggtttatgatataaaatattaaaatttgatcggttgaggtaaaaggaacgctctgctgctatgctgctagccaacaaaccgagtgtcactagaggtcgacatatatacactcaccaaaccagttcagagctattcagaaagtgatgtgtccaagtcttaagccttctaggattctaggattattcctgtttgttcttggtttgcttatgtgaagaagaagctagagagaaaaccaactaaatgtgctgctaatttgatggaccaaagagaagaaattggatcattatatatatgtcgggtgacgtcacctaccaatttgattagtttaattagcccaggatcactagcattggccgagcatctccaagagcctaaccaaatggctctccaagttaaaatttggctaacttacacaaaaaaatctactacaacaaactagccaaatacctctccaagccattaggctggctaaattccccaccagactagctaaagttggccagccaaagccagctagctatatgtgggacccacgcctgttcccaccctctctctccacgctgcagtgcggcacgcaccgtgacgagggcgccgccgccctctcgtcgctgcggccagccaccgccgccccgtcgtcgcgcggccggccaccgtcccgccgagctccgccgccgccccctctagatccgccgtcgaggtcgtcgcccgccgctgccgccgccgccgagctctgccccgagcggcgtcgaggtcgtcgtcgcgagccgccggcgtctcgcctcccgcctccccgcgtcacggcagcaccgcgcgtggccgcccgcctccttgcgtcacctcctcgcgagcggcggtggggatggggatgggcggcagcgacggatgggagagggaaggggggtttggagagaaggggagaaagatgagggagaagaaggaggtgtagaggctgacatgtggacccaattgtcatagactcagaatagagaggacgaatggagaggctgttggggtaaaagacaatttgacttgctaaattgaatggagagttggccaaatagacatttggagagtcaaatttagagagactgttgaagatgctcttaagttatcatgtctactctgatctaacaccataataaactaaacagttactaaaatgactgtgtgcaccgtagggatggtgcaaagcccagagttatactcaattacacacgtgtaggttggctttagtaggatcttatagtgagactaaagcgatatgatgttggtcttcatttatttgtgcgtgagttagtgtatttgcgactgcgtgtgtctggtgttacttgtgtagtgatgtgtgggtgtgcaccatgaaataagaaaagaattaatatgtaatctttttcgctaggctagcgataggacatcggctaaatgcattaagatttaggaatgaaattacataaagcacacgccgattctacgtacagattgtggtcacagatctacataggtttcaaaacggccgtaaacactctacaacatgcacaaacctatacacatgtatatgcaagtttaatcaaagagcggcatcggtcggtccagccaagccagccgcttgttatgccatttcatattaatctatgttatccaaaaaaaatattttttttataaccagataggtaacaataacattcaaacagcgaggggacattttcttgagggatgaaaatatatgtccatagagggcgcacatcttggctttgtcggccacagcgatccagattgtcggaacgaaattaaatagatgccccttattgctaagaacatacaaaaaaaaaaaacttgcatcgggctagtatcttcggtttccaaaggaattcgccgcaggcggccttttctttcccaatgaagaacatcttgtatgcaacttgaggagtattgcacatctgtcgtgaatttccaccatagttcaaatctctgacatattatggcacaattccacttcatatttgtcgataattttttttctaaaattttaacatgtgtaaatatagtacaatcgtagtgtaattgcattgtaatttacatataacttacaatataattttgaaccgttcgattttctttaaaattcatgcaagagaggtagaaaaaaaatcacaacacatacatgagaggagattcggtaccattattacctccgttttcacggaattagcatgtcccaaggatttctgaaagttatatacaagttacactgtaattatattacaattatactatatttacatcagtagttaaaatttgacgataaatgtataaatactcccaaataggtaat

SEQ ID NO: 73333 - DNA, 1689 bp, Oryza sativa
ttatttgtttgtttacaaacgaaagaagctatatgttatagaaagtgctactgaatgatagctgaaaaaaggtgctacttaatccattcataatttgttctctgctttgctgtgacattcggatcaacacagccctggagctggaggtgttgactccagaggttagtgtggatagcggcaggagacagctgattgcctttgactgaccgggtaatttctttgccgtgaactagggggaagctttcgtttatcataactttgtgattgggatgccatcgttatgtgtggccattggccaaatgtgttgttggccggtgcatttctgtggtgtgcgtgctgcatgagcacgccagagctcattccgatagtgatgatcaagtctccgagacctagagatatatggacctgtttttgctgaaatgaaatgccacgatttggacagcctagtagcgcctgttgttatcgctgggagctgtaatccaaatatccaatatattcatgtatgactaacaaattcactgtacaccccctgtttatgtttgtctgacgactctgaccacaggaggaaagcatagcacgcgcagcggcacaggtacagagctgcaagcctcctccactaatcaataaaccaaacacacagtgtatcagtgtatcagaacttgagatgtgatgttacttcctttcgatctatttacgcatttctgtgcaaaaataaaaaataaaatttttctggaactgtttatccatttgtcaggtgatttctaaccaaaaatcacccaaattttttctacccttagatttacatccaattgactacaaaagagaataactaatacatatctacttacacaatatttttatcaaaattacagtgcacttacatatcatatcaactaaatttacaaatataattttagttatataggactgtaattttatattttaaagaaaataataaatacatatctacttacacaacatctttattaaaattacagtgcacttacatgtcatatcaactaaatttacaaatataattttagttatataggattataattttatattttaaagaattatcaaaattacagtgtacttacatgtcatatcaactaaatttacaaatgtaattttagttatatatgactataattttatattttaaagaaaataatcaatacatatctacttacacaatattttttatcaaaattacagtgtgcttacatgtcatatcaacctaatatgcacatgtaattttagttatataggactataattttgtattttattttttattttatagtttcaaaaatttgtaaagtgaaaagaaccaggcctaccatccgacgcatggtattatccacgtatgcagcctccaccaattattgcacaaatcctagcgagggatcctatggatagaaaaacatgaaatatcagtcaaaaaaaatcacccgtgagatgtatagcaaaatcgtaaaattagatatggtgtctatcatcgctgcgtttggatgatagtggctggatgaaggcccacggtaatgatcgggtcgtgcctgattaagcttgtgggtgggccgaatccttttgtaagaggagatcagtaaggcccacataaactgcaatgcagcccactatgggagaaggccttgcatgtatgcattgcaggcctgtccccgcggcgtc

SEQ ID NO: 73334 - DNA, 26822 bp, Oryza sativa
tctctcccacctcactctctcactctctcccttggcgccccttgcccctacgcacgcccactccttttctctcccactcctctcctctctctcccggccggcccgcggtgacagcaagtggcggcgggtgatacagcggcggtgctcggcccctccctccctctccctcggctgcgagcgggaagaagggcggcgacaacagcagcgcgcccctcccctccctcaccttgcagatccggtggaggggaggcatgggggcaatggatccggcggcgtgcggcccctcccctccctccccttgtagatccggtggaggggaggcaggggcccgacggatctggcaaagccaggcgagaggcggcaggagggatgcggcccacacccctcaacggcggtaggcggtcggacagaggttcggcggcggccggatctgaaggtgcggcggcatcagcggccggtgtggaggtgcgacagcagtgtgggccatcgatgcatgtgagttgatgcccctcccctccctctcccttggctcccctctcctcccctccccttgcagatccagcggaggggaggggcatcttcggccgacgactacggatttggtgctggcgacaggagcggccggcggatccatagttgtcgaccgcgggggcgacggcggcgggcctcggctagggcagcggcggcggcggattagggttagggttttgtttttcttttttttgtttcgattttttattttctcgtccagacggcttaagtgcccgcacgtgaaaatccgattttcgcgcgtgggtgaggcactcagtacacgaaaatcgcgattttcccagacccctgggtgcgtgcaggccgtccacccgcccgcaaaaatcgaattagccgcatgcaataatcggttgtgtagtagtgacggtgtattttttagaaaaaaaatctattgaaaagttattttaaaattcatattaataaatttttaactttaaaataattaatacttaattaatcatacactaatgactcaccttgttttacgtatttctcaatttttttctctctctcaaatacttttcctccagtgatcagacaattacatcaactaggaaggaagcccgcacagatgcgcggacaatttattttttgtttattaaagaactactgaaaaaagtcatatatcatcataactaaccatagattacctcgtaaccttaccgtaaaagaaggaaatatttttaccgtgaaatattcaaaggtgggtatgcacacgtttataagcccgcttaggattgccttttacactattagttaaaagaatattttcaagaaaattggcgagggtggcatgaagcagcgccatggcagcgtggcttcttcgtcaacctcgcaaagagtagtcactacatatatgtataatttgagaaaaaactttatggctacaaagaaagaaacaaaaaactgctagatggggtggaccatatatgcactcttcttttttgtttttgacatctcttgtgtatgtacgtgcatagagagggattaggtggttttaggagcgagggcttacctgaataaatctaatttaatggttaaaaataatggattccccggtttaagtgaaaatcgatagcttgatgttttatttttgccttataaattttcttacattttctctaatttattagagcatcacatggcatcttctaagtgtttgtaggagtataggaacactgttactcatactcacaatctacttgtagtcaactattatttgttgtgattttgtggcatcctctacttagtgtcatctttatctttggtgcttgatgacatacgtgcttactggatgtcaaataattattaggtgcattgtgcatgcatatatcataagcaatataacttgacgattagtgacactggtttgtatatagaacttactacataggatttatcaaggacatatgattgatatattatactattcttgattcacaaagtatattatatactacatatttaattttagtacataagtaataagtttatggtaaagttctaaagtgcttatcggattggctactctgttatttatcgtgaccatgtttaccgaattgctaaatggtgtgtgttttacaaaataattttattatataagttttatagaaacaaataaattcattttcaagtttgtaatatctaatactcgattaatcttgtcctaatgacttgtgtctttatgcgtacccagggtaagctacatcaataagctatatcaaatgaaggctaagtaggagaacgaaggctaagtaggagaaaaaagttattgatatggtgtgaaatgaatatatttgaccttcaattttctaataatatatgaatagagtaaacacataatacatgaaaatatatttatgacaaattcagtaacatccttttgccatatcaaggagtgagtaatttttgaaaattctgcacacagttgaagtgtttttattttggaaaatgtaagtctaatttaactatcacataatctatacttttaatttatttatattttttatggatgttttgatgacatgctaataatgtgtttaaattattattttggtttcccatctaatctaaatgagaaaaagaaaagaaaaaataaggatgtaggacccgacgtgtgtatgtaccgtacataggtacatgtttttttcttaaggaggaaacatgcgtacgtactgtacgtaggtatgtacttttcttaaggaggaatacctaggtagctatgtgcatatatattggttggtagtgacattacgacgtggtcctttttacagataaatttaattattaatttttaagatagatctaatggttgaatataatgggtctaccagattaaatgaaaaccgatggtaagatgttttttttcttacaatttctatgatttattagtgcactacgtggcggtctaggaacgcttatagggtactatatggcggattataagcgtttgtaggaagtttatcctcttgattacttttttctctttatgaaaatatttgcaacaataatttttaagcgtttgtaggaaggttatcctcttgattatttttctcccttttctctttatgaaaatatttgcaacaataatttttaaataaccacaaccttccaaattaaatatttatttgtaacaatattttttagatcgtaataatttttaactttgaaatcgtatgttcattctttatctatttggaccattgtgttatttatgataaaaatcacaattagaatttatgacattttctgtctacttcactcgtaaaaatgtatattcttctaagttctattcattcaatcacatatgaaaattatataaacttgtgagtacatattatttcatcatgtaccacttcacttgtatgcataaataaaatagaaagtgactatatatattgttagctagatcgactttttaaagtctcacctgtaagaacaatacccgtgcagctgaaaacatatatttttaaatcatactttttcttctatatttatggagtaataaattttattttctactatagaaaatactattttaaaaaaccatctttttttttctaccggcgtaaatatattttttagggtcttatagcttttcttttttactcgcatatgtacgtatctttttctaggaacagtaccttttttatagattttatcgtacgtacgtacgtttctttaaatgaacagtacatataggtattatttttcaagtctgcatacgtacgtgagatttttccttttttacattgtgcgtaagtataacatataaatcgatgataatagaatttagattgtccgtataaacggtttcacttaaaatgcgcatgatatcaagaggaagcaaatagatctaatctaatggtctgaaataatgggtccaccaatttaaatgaaaatcgacggtgagattgtaaaatgtcacgtggcaacataggagcgtttgtaggtggcttaggagcgttagtaggaagtttattttttttggttaagtaaatccgatggtagaaaatatgggtccactgtatattagtgaaaatcgatggctagatgttttggttttttctaatttgctagagtgagacatggtgagatgagagcatttgtagaatgccatatttttaatggtttaagagtgtttttaggatgtttaatagacttttaatatataatagattatcaaacaactaactattatatatcagccccatacgtcgtgatgtatttaggaacacaatataacttttataatttaattaaagtacaacggaatcacaaattggatatataatttaaaaataatttagaagatagttcaagcaacattgacaggatattttatattattattatagatcttagtttaactatatatatttatatttgtgctgtagtttttttagaaaacagatcatcgatttttatgatgtattattttattgtcttttctatgtacgtgcgtactgttttttcttttctttccagtgaacagtacgtaaactatttgttttgtttttttaggtaagtacgcatgggagaaggacgtggtttgcatcctatcaacttgtacgtacatggcaacaatagtagtgcttaaatcattaaaaaagagaaagttattattttttaataatagatctaattcaatggtgtaaaatggcgggtccactaatttattcgacagcctaatccacattttcccttctcttgctcaatcggcctccacccacaggcgacctctagaaggaatacccgaaaggcaaacaaaccggtaagtagatggggctcaagagtgatcgagtggaaaagctcaagaggcatggcttctgcatcaatttgctcagacgttgtagatagtgttgcgcaaggtcaggaaaatgccctgctttaatttggtaccagattaatttggatttctgaattgtactaaggtagtttaagcttttctttagctttttggtggcatgtaaacgagataattcatttgcacataaataattaaatattaactattataaacttttaaaatgactttatttgatttttaaaagattttttttgaaaaatgtgttaacggaaaatgagaaagctggcctaattaaataagatattttcgtttgattttcccttgcagtaacgcggtcaagggaaaactctcacttggctggtgtgtctagcccatttcaaactttttagtccatattacatcggatgtttggatgctaatttagagtattaaatatagactaataacaaaacaaatttcataaatgagagctaatctgcgagacgaatttttaagcctaattaatctataattatgaaaaatttactatagcatcatattgtcaaatcatggcgtaattagacttaaaagattcgtctcgtgaattagtccaaggttatggaatgagttttgtaattaggatatgtttaatactccaaattagtgtcaactgatgtgacaggaacttaaataagtccctcttttccaaacaggccagctaccaactggaaggaaggtatggatggaatggaatgtggtcaaggacgaggactttgttgcgctgaagtatggacctgactgctgactgaggagagtgatgaccggtaaattcttagactgtcaagttgttgtatttcctccgttgatttttctattagttaaatttctttaagtttgattaagtctatagcaaaatataataacattttcaatacaaaacaaacattgtatcaaaatatatatattcgactccctatggaagcgaattttccaggatttaacggcattgtactttcagtggtaggcggcgtacccgtcaacagcgaggcgcctgtagtgacttcgtcaatctctaggatttgccggcctagtcttcgaaaatactcataggggtagggtttgcatgcgtgtgttcacaggggtgagtacgcgtgcgttgtactgtataattctaaaaaaattcaatattaaatttaatgaaactaatttggcgcatatatgttgctattttttttataaacttagtcaaatctaataaactttgattaagaaaaaaaatcaaacaacttataataaaaaaatgaacgagtacttgacttaattagctatgtgttggatgtctcaacggtgagctcgtagcgatacgtgcctttaaatagttacgatgagatgtgtactcggcacgtcctctcttccgttgttccttttgcccaacatactttggaatataaatcacacatacacgggctaagctgaagaagttatatagttgtccaaaaaataatcaatggcgatctcactgatcacctccctgctcttctccctaccccaacaatggcagcccgtcgtcctcacagggctccttcctgtcatcgtttccctcgtgctgctggcgaggaaagggcgcctcaagatgccaccgggcccggagcaggttcccctcctgggaaacctgcaccagctagctggcccgcagccgcaccgggccctgcgggacctggcccgggtccacggcccggtgatgcggctgcggctcgggaaggcgtcggccgtggtgttgacttcggcggaggcggcgtgggaggcgctcaggggccacgacctcgactgctgcacgcggcccgtgtccgcggggacgaggcgggtgacgtacggcatgaagaacgtggccttcgcgccctacggcgcgtactggcgcgaggtgcgcaagcttctcatggtcgagctgctcagcgcgcgccgcgttaaggctgcatggtacgcacgtcatgagcaggtgagtgtaacaaaaccggttgtgaaattcgatttcatccattactgttgtatggttttatctagaggatggtttcttagtaaagttatcttttatatatgtcacgtaagtttgatatgtattaagaaattaatatgaggtatcagtacttcacggtaccaaatcaattttgatcgttggatctaataatgtccatcctgtttaggtagatctaacgattagaaacgatttagtactgttaggtactagtacctcgagatgcctttttgctagaccagagcaaatctcacgtattttactacttcataattaggtggagaaactcttaagcactctacgccgcgcggagggaaagccggtggcgttggacgagcacatcctgagcctctccgacgggatcatcggcacggtggcgttcggcaacatctacggcagcgacaagttctcccagaacaagaacttccagcacgcgctcgacgacgtcatggagatgctctccggcgaagggtcctccgccgaggacctccagctccccgccgccgtcggccgcctcgtcgaccgcctcaccggcttcgccgcccgccgcgagcggatcttccggcagctcgactccttcttcgagatggtgatcgagcagcacctggaccctaaccgcgcgccgccggagaacggcggcgacctcgtcgacgtcctcatcggccactggaagaagaacgagcctcgtggcacattcagcttcaccaaggacaacgtcaaggccataatctttgtatgttaccccttccattttaaaatataaggcgtattaggttttcacacgagctccaacattttactttgattattagttttccttttcataatatattataattttaaatttaacataaaaaatattttaaaatataacttatttttagatactagtacattcataacactatacatatatttttatgtttaactattagtaaaaaaaataatattaactttccataaagcaaggactttttatattttcaaacggaaatgtcaaggctatagtatatagaaattaattcaacacttatatgtacagttcatgcatgaatataggcattcttaaacaaaagaaaagagttatctaaggtatagctagtacgtatatacttctagattcattaacatcaatatcaatatgatgtgggaaatgctagaatgacttacattgtgaaacagagggagtatttgataatattaatcaccttatgatgtgcagtcgactttcgttgctggtattgacacgaacgcagcgacgatattgtgggcaatgtcggagctggcccggaagccgcgggtgctgaagaaggtgcaggcggagatcagggctgcggtgggtgtaaacgggagggtgcaacctgatgacattacgaagctcagctaccttaggaaggtcgtgaaggagaccctgcggctgcacccgcctaccccgctgctactaccaagagagaccatgcggcacatccagatcagcgggtacgatgtgccggccaagacgcggatctacgtcaatgcatgggcgatcggtagagatccggcgagctggcccgatgagccggaggagttcaaccccgagaggttcgaggcaaacgagatagacttcaagggggaacatcctgagctgatgccatttggcactgggcggcggatatgcccaggcatggccatggccatggccaatgttgaatttacgctcgccaatctgctcttcgccttccagtggtcactcccggaggggacgacgccggacaatgtgtgcctggaggaagaagggaggcttgtctgtcaccgcaagacacctctcgtgcttgtgcccaccgtataccgtcacggccttgaatagaaatcgagcgatcaattttgcaattatctacagatcctataaaaacaagttatctacggatcttacaatggttggtgtcagcacactgaaagaaaaaaaaaagagtcgtgtgcatccgcgatggaccaaccaaaatttggagattaatttaaactacatagaaaatgtaataatttggattgatatattgtgtgtgtaaaaacatatgaattatagtgtgtaacataccacgaaatataccttgcaaatttgtgaatcaaatgtttctatcaataaagcaaaatccccccctatgtgctttactcattgagatttgttttttctttcttgcatctcatagtaagttttatatgcattaaataaacttagcaaaatttacacaaaaatcttgattgtcaaaaactttggaaacatttccaaaaatactaaacatcgcacaaaacatactatatttgtttttcataattttatcacttgatctagtacctcaataaatccatatgcaatttaattaataaaaacaataaacctatttcacaatttcactacattttaatcctatctccttttctagtgcattttggcccaagtactaaccaagttttcatatactactagtaattttttgctcaatttgaatccagatgtaaccacatgaaatgacactgcaaaacccctaagtgataaaacacaacagctgaccttaacaattagagaactttacagtttcaccactaatcaaccctaacacctctgcctgtgcaatttttccataatgctaaccactgcaccagtaattttgtcacaattttaaccattttctaacttggtgaaaacgggcgaaaacaactaactgaccacatcatgacacttaggctgcgttcaaacattctgttcggccgagctgatctgtcctcgcaaaatgagacaactcattagcgagattgactaagtattaactattataaattttcaaatatatttatttgatgtttaagaaactctttgtttttgtacgaaagacaccattttaatttgaaaagcgtgctccatggaaaaaataaaaatagcccagccaagtagaagattcgatcaaacccagccttagcctctagtcccattccccactctctttctcactactactgggcccaagtagccatggaccccgccaatcaacctcagaatgcgcgcatgccaactcaccctccttcgtgggccgtgcacacccttgcgtcgatggtgctttgccgaagcaaccaaagtgtgtcccaccaagaccgcatggcagacttgatgttttaacctcctagcttcgccaaacagcctctcctgcacgccctctatctgttccaaatgtgaactgaggaattcatactctggttcaccgggaaatggatgcattgccctcaatgttgggatcaagaaaccccttgattggtgccgcgagattggagctcggtgtcatcttcttcctcccaaataatttgccgccgccgtcgactaattccacaatcatgagtagtttaatgcacatgttatattaatgatgtttttaatgctatagtcatttgttaccaaagctatttggcaaagagaaaaatgtaaatgagttttgaaaatagttttgaaattaatggattataagttgagtatatatgtaatctaaaaggggtgtttaagcacgtttgatttgatatttatattgatcaagtttaacttgcatatatctggagtaataatttttgttaaattttgttttatagtattgaaaatcctattttgaagaccaactatatctttttcgatggttctactttttggcttttatagcatctaaattaacccgcaaagctatgggattataggtgaactggcgacggtcgtactcattgtcgtctgacaatactatttggtacttcctccgtttcacaatgtaaatcattctagcatttcccatattcatttgatgttaatatgtctagattcattaacatcaatatgaatacagtgaatgctagaatgacttacattgttaaacggagggaatacttgcttgttttggatttctaaattataaggtaattatattttaagacagacaagaagagtctctttgttagcatcggaataacgcggtctaagaggccaagagaagaccttctttgttggcatctccggcagccgccggcagggaaaactctctcttggtccacggacctgtcgattggaagacatggggtcaaggacgaggactttggtgagctgcagtctgggcttgactgatcacttgtgagtagtgacaataatgcaatcaatgcatattgttttttttttccaaatttggattgttttttctccaaaattgttttttttctctccaacagatttgcgcgtcgacctgcagccggccggagaaaactagactatcaagtcgttgtcgttctacttgacttaattagctgtgtacttgtacactgtcaactgtcaagaatcgtcgttcgtccgtgtcgatttgttgaggaattccagctcagaaatattttagtcaaaaatgtatactactatagttgaaaattttggctacattttcaactgtaatagtagtatttttgagctgggcaaacgccgtgccctgcactgcaaaactgctccgccgctgtcacacagcgcatgcgtggtaaaagaaagatggttggtgaaagtaattaaccattcatcttcgtcctgctgactccatgaaaaaacgatttcatatcatgctagtcaccaagaccagttgtttacttgttttacgttaagaccataaatgttttgaccactgctgagacattttgcagtttttttcaagcatctcgttgagagtatcggcatatcaattctaatggtcaagcagacgtatcagaggggctgggctatatacgaccctgtacacatgatgcttcgatgcacctttctcctttgtatctttcttatgaatcgacatctggggttggattattcctggaccagcactttcagtcatcagtgctacttctaccgtcccataataacttcatttttatcatattacttgtcccaatataactttatcttttaaacaattattgtgtcggagtgattactcaacaactgcatgtgaaaattggacggtcggcgatgaagcatttgtatctagtcggccaaaggtgaaaacggtgcaaatagcgtgtcgctgtgcatggggggattaaatttgaaaaatatattgttcattttttttttctcataaatatcttggatgtaaatttttcgatacaaatataccatcaatgctgctgaatccagtggcgaagctatattatgttgggggtgcacatgaaccctaaattcctaatttttcacttaaaaacattagaatgtacagtgttgtactgaaaatttctagattcttaatggtagtgcaccccttattttgatgctagcttcgcccctggctgaatccttatgtaaaagtgacatgtgacatggatgtgatgacgtaggcggtctcgcacgatgaaaacgcgagaccgcacgatgtcgcgtggaaacggcgtaagaccgagtgctctcgtgcagtaagcgtgcgagaccgaactcgtgcgactaccgtgcgtttgaaattggatatttagcaactaattaatattacctccatattttaatgtatgacgccattgactttttaatcaacgtttgaccattcgttttattaatttttttgtgcaaatatgaaaatattcatgtcatgcttaaagaacatttgatgatgaatcaagtcacaataaaataaatgataattatataaattttttgaataagacgaatggtcaaacgttagataaaaagtcaatggcgtcatataattagtgattaattatattaattattaattaattaattaataatttctaattagcataattaatccctgattagcggcaggaggcagcatgatgctcggtctcgctcgttgggcatgcttggtctcgcagcctggccacgcgacaccgagcggtacgtcttgcgccgcaatattgatggtttatttgtgccaataaaattatatcccgcataaaaaataaatagtatatttttaaaaaataaatttaatagtatacccctgaaatttagctaatctcttttatgcccctgaattttgcttactttcttgtatacctcttgacggagcgtgggggctcctcaccgggagaccgcgcaggcccccctttgccggttcggccgggggctctgggtgaggttctaagctcctagtctgtggaaggttcgcgacaatggaaaaagcacaagacacgggcgatgtatacaggttcgggccgctgagaagcgtaataccctactcctgtgttctggtggatctgtgtatgaagaagctacaaagagctggagagccagagagctcttactctagaaaccctcttctcccttttttcctctcgtgggatcttctcctggatcctccgggagtccccaatcctaagtgggcaaggtcctccttttatatctcaaggggataccacatgcaccacttctacctatctctcttttgtgtcgggacttatcctatctttactcaaacttggcttgtcttctctagaaagctaaaaatactgcttgtttttgagtgtggccacgcgtcctcactcgtctgacctcggggatcaccctgtcatctcttcataaatgggcggagacttgcaatggctgctgtccgaatgaccttctgatgggacggcccatacctacctccacttccgccggaagcaggtgagacgtgggaacatggttgtctgccgatgacatgaccagtgtcagaccggtcataaatcggtcattcttgtccaccacgtgtcagtctagcaatctgcatgttcgcccttcttcatacaatatcttgcttgtaatggttgggatgaagcctggcatatatctgaccgggaccaacgtgccatctccaggagctaacacgccggctccggctagggacgagtgcttggaggctcttatcctgacgggatggggcgaggcgtgtgtcagaccgcctgttgccacctaacccacgatctgaccggcctgtgactggtcacagaccggataaacgagcgcgctgcactgcgttacatgcgacgtgacgctttcgtccaaaccgcaataaatgcggttaggtgagccccgccgtgctcacctaacctatacacgcggcgcaaaacccacaaggggtcggggcgcctcggccctcggggccgaaacgggagtggtccgatccctcggggagacaaagaggggggcggccacatcaccctcgggccagacccccccccccgagggggtcaggccacgtgggtgattgctcctgcccaagcctctagtcatgatactcccggtcccatgtcaccgacacctctaaattttaattttgatccctttcataccccttccgtcagttgaccatttaatttatataaaaatgactattctaccctttggataaacatagaaatttatgaattacattattaaagatgtaaaagcttctcgcatgaaactattatagttatgaatttattgtgcgatgcattatttatcccaaaaaatatttttagataatgaaataaaattgtcgacgtttgatgtcgcaattctggtatttgcatggtatggggatcgtcggtgctaggatatacgcgagactgaggtaaaagagatggagacagggatttttatacaggttcgggcccctaaattgtcgggtaatagccctacatcctgttggccggagccgatgttgctttttattcaccataatcataccagtacaatatgtggggtagcctatctaactgttgtcgacatgtcggtctgaaggtctgactcgtagtcgacaacagggtagccttcctcctcgagctcgtgcccgacggaatcagagacagtgctagatccctacggccggcctctgaaggtaccggatagggtcaatccaggcgtatctctgatgtcgatatccggcggcttgtcttggcgtatgttggcttctatgttgattgtgttgggagttgattgtctcgtggtgggtcttgatcgtggtgaccgtgttgatcgtgtcccctctcctcctagggggtcttgtattcatacccataggtgtccccttgtctgagtagaactagagagaccaatatggatacaatccgagtagtcctggtcgtttccatgtagaactctggttgtctttccttatccggaactcctcctatatccgcaggttgtttccgtataggacatggtatgtggtgggtcctgccaagatgtagtcgactactattaggtatgtggtatccataaccttgaaaaaatattatgtatttatttttcaaaaaaaggcataaaaataaggagcattcatttaaagataggactaccaattttcacaataattttatttatgaatgctcccgataaaaaatccattgtcctattaaaatttcaaataaaaattttaatttattatatttgttttatttctaaaatttatgtcaaaattttctgcactaattatttagtctctttagtttcataaaatacacatactgcgcactcaaacaaagttttcaatcgtttttaagcttacattgaaacctaaaacatcaaggacaaaaaagacatttgcaaccaaacgtaatagtgaaatgatagaaaatgtaacggtaggagcataaaagggataagttgaaatttcagggatatagaagggatcggataaatttcatgggtatgaaaggattaagtgagttttcatagataccaaggaatttactcgataaaaagagcccccaaagggaggcacagggggcagactgcattttttttctaactcccagacctcttcctctgtcagtttccttgtgtctttcattcctctgcctcggctgctccacctatcccatgatacccttccccaccaagctctggagcttggagacgaacccagagatgagcagccaccagatatggacctaccgtcctttacttgctttatccgaacttattggaaattttcaaaaataaatataaacttattggaaaacaacgcaaactttctcaaagtactggttacaaggatatacacttacttgtgatgaataccataacaacagaacccattagagacgagtacaaccgagtctaacacaaatatttcaacacaacatgtatttcaccttcgtctggagaaatcataaatgatatccaattaaacttgtcgatgacacatattacattatattattgtccaactcagtgatgtacatccgctccaacatgtttgagctaaggtatgccggtaacaagtttgggggtatggagcatgtttccgtcaaggtactacatgacctgttgcatgggtaaccttgcattaggaagtgggtatgaccatgtgagatagaagcccgagttttaacactagggaaacctagtcaagactacacctatttagaatcctcatgtctgctgccttagtgactagatcattacgccaatgttccacaacccaatctaggagaatgatgctgctgtttcccttatctggctcaattggcctccgctcaaggtgatccccagaaggaatacaccaaaggcgaacacattgatggatggggtagtcttgctggtctgtcctagttcaggagctacgtatcccagagtgcggaccatgtgtgtggtttgcatatctgtcccatgatcgtaaagttttgctaggacaaactcccattcatctggtcatcgaggagtacgttacctgctttaatatcttgacggaggacaatttgctcccaatcctcatggagtatgataaccctgaagctacttccctgatggccaatccaatgtacccttgctacaatcatataggtatttatccatgctaccatttggtatgtaactatagaccaagagaagtacttatccctttcgctagcaactgcacgaggtcgtggtggccagtggcgcagctatggggggtgtgaaagggtgccaacacccctatgcaaacactaccaccactaaacccccatgtttttactctatattaagattagctaagataagtatttatctagtttattttgtatagcttgaaagtattattagtttagttagttagcaagtctaaaaatattagcaagaaacatgatctacaaaattagtttgtgatttctcatctttttcaaagtaaaatagatgaatgtgagattattcaatagtttacattaaaagaattagcaataaagactagtttcaaacttccaatgatattattaaacagctaaaattcaagtttttcttaaaggactagtttacgtattgtttgttattgacggtgactatttgacctcctttgctatcaatattaattattcggtctcatggtttatcttcaccccacacccccctaatctcaaatcctggcttcgcccctggtggtggtgcaactgtcgcatgcttaacctctacaatgaactccttcatcccatctcccatgccatgattcatgtgacatcctctttacagcgaccttgatggcggacttgtggagcacaccctttgtagacgctacctcgattcaccaagatgtttaattttgtcttggagtaactcctatgtggtcaaggacgaggacttttttgttgcactgcagtatggacttgactgctgactggtgtacttagtagtgagagtccaatcaatccgttgtctacataagacatacagatgcttaattagactacgcaaggcaatttcgcaaaggcaagagagaggtagagatgagctcatcatcatcacaccatccagaatttgcctcttgtactgcaaatgatgatgagcaccatctcgatgagttcgagttagaattggtagtgcaagatgtgcagcggcagcagaataatggtagtgcaaacactgatcagcatgagcgtgagaacctgttgctgcttgatgacagcagcaagtcgggagctctgaagaggcgtttgttcttcgacaatctgctgaagaatgtccaggatgaccatatccgcttcctgcacagacagaaggaaagaattgacaggcacgtttttagttcttttttcagcacaccgtttatgtgtatgtctggatgaagataaaatctctgtttatacaactgttgttttccttttccgagatacagtacacactcaccttataaacatacatgcacaccgtgttccaatgagcatttttgaacactgcgccaacatattttgagattaatgaagtcacctcgtatatgtgtttctaactgttgtttttctatgattcatatccacagagttgatgtcaaattgccagcaatagaggtgaggtataataatctgtctgtggaagcagagtgcagaactgcgaatggagatcatctgccgtcgctatggaatagtaccaagggagctttctcagtaagacaattctgacatgattgattctgttatggatcaaatagcggcatctgaagcaataactattcattgaatatcatttaggaaattcatacacttttactcgctgtcaatccaagcgttgcatgggttattattatcaacactataaatattataattctaatattgtgtttgatatgttgattatatttgacattgtagttgttccacttaaaacaagagcctggatcagttacaacttgctaacattttttatattccttgttaaaatttatttaataaaataataaattaagagtatatgtactatacaatatttattaactacaaatttcgtaactattaattctcttcttaattgcatgatttcgttaacacggaatctcaacattctgctgtcactaatatgatcctttcagttacatgagagctattacaaaatgcccaattaccatatgtatatacataaatagattaacctaccttaccagcattttgtttgattcatatagggccttgtgaagttgctaggcttagaaacagaaagagcaaaaatcaacgttctagaagatgtgagtggaatcatcaaaccctgcaggtatgtgccatgtttcaaggattttagttaatggaaaaaaaagaccgtaaacataaaaaatgtgttaccagttaaggtgatccgacatgctcccatgtttgtagattgactcttctattgggacctccaggatgtggcaaaagcactctgttgcgagctctttctgggaaactagataagtctctaaaggtacccacatcatcttcctttcataaataagaagagagtaaatttcatcaatggtctgagttacacaaaactacagaggttttaagatgtgacacataaccccagaaattatgatcataaaatttcacaaaaccatactattgatcattttggtttacaatcataatatgtgggcttatatgccacgccacatcagcgaaatcactttataaaacatctagggagttattttgcattggttttaatagttgagggggtcaatatgtctggttttgtggttgacagatacaagtatatgacccatattgaggaagttaaattggactgcttccaaaaaggtttggattggatttttattattgtgaaatagaaatccctcaaatgtaggttgaatttgatttgtatctcttaatcgaagaatagatagaacaactcctccaactattaaaaccatgcaaaatgactccctcaacagtattgatgatagtatttgctgatgtggcatccacgtggcatcccagtcatcctctatccacgtggcacatacgtggggcttacttgtaaattacactcagaaacctcccctcccctcctgtactgtctcccgccctcctcactctcccctcgctctccctgcctcactcactggccacatgattattcccatccaccgccgacactatctccccgccgctgtcgcttccatcccctcactggccgctgctgctgcagcactagcagcccaagcccccctctcccaccccgtcgccaccaaccaccaccatagccccacgacacccatcttggacttggtcctccttggcacgatagcgagtgccgtggtgccatccatctcctgtaccactgggagcagcagtacgggggacaaggctcgtctacaccattgagcttgaatcgtcctccatcgtcgctgtgatagctatgtgggcggcaggcataggagcggggaaaaggattgaggcaggagctggagcgagtcgattggtgcggcggaggaggagcaacagtggacgccttgaccttgacctcctggatccagaagccaaagcaagagcagagaggcgcaacggctgcctcggcgggtactagcgagaagcaacgggatgccatcttggcagaggagcctcatcagggtagcgactgaggtttccgtgggtattggcagaggagggagggagagaagaaggtaggagccgccagtgcccttccctgctttggctcaccgttgccgatgccgccctccagacctctcgatgtactgtttgtgcccaaccgctagagctagaagtgtgtgaggggaggaacagggaagagaagaagcgaagggataggtggggaagaagatggggcaaggatttacatgtgggtcctatcgtctttttttttttccttaattataatccatgtagacgtcaacgtatgataaaggctaggccagtgtgtgccacatagaacaaaactactattcaaacagcttgaggagtcaaattaaattggtattgatagttgagggagtcgttatatccgattttacggttgagggatattaaatccgagctataacaagggagtccatttggaccttttacttgcgaaatcacagtcccaaattggattcagcccatgggctggattgtccccaaatcccttcgtacactttctccagccacagcgccgccgcaattcgctcgccgccgccgccgccgccggtgggcggtggcttgccacctccctctccgcctccggcagccttctacgctgcccgtctccgtctcttctcccttcacccaaatccccagacattcggccatggccccccctgactcttctctcttcttggccgcccgccgcggcgctgcctgacgaggatcggcggctcggggcggaggaaccccgagcttccggcgcgagggggtggcctcctcctcctcctcatcctcatcgtcgccgccgcccacgtcgtctcgccctcggccaacgcccgagctcgaccacaaactaaaaatcaagaacaagaaagttttatgttctgacaaactgaatgtgaagatgcaaagcttttacaggtaacaggggatatctcttacaatggctatcagcttgatgaatttgtgcctgagaaaacagccgcgtatatcagccaatacgatttacacattcctgagatgactgtgagggagactttggacttctcatcccggtgccaaggtgttggaagaagaccaagtaagtgtaatggacattcttcaccaaaattcttgatcagaaaaagaaaaagttcttgattaattgcaataatttcttactcactgattttgtttgctcaaagaaatactcaaggaggtgagcgcgagggagagcgcggcggggatcatacctgatgcggacatagatatatacatgaaggtaaaagatgtgttatccttttatgcactggctggcattattcttcctcacttcacaaaaaaaagcaacacctgattatttgaggtaatactaacaatgtaacctttcttgctagaataatattgggttgtagtaaaactaaggcaaagctttcagtaatcaacatttctatttctatttctataattaaacattttggttttcaaaagcaaagtggctactgcaggctatatcagttgaagcttcaaagagaagcctacagacagactatattttgaaggtacatttccccaaaacatacaagtttaactttcagatagtgaaaatataccaacaagaatcacagtgccgcttgaattgtagatcatggggctagagatatgcgcagacacgatggttggggatgcaatgataagaggactatcaggggggcagaagaaaagattaaccacaggtatggtaaagctgatcgatattacttggaaatacattcttccaaattaaggcgatcgatcgattaccttgtgtataatcttaaactttcaccttcttgcaccagctgagatgattgtggggcctgcaagagcatactttatggatgaaatatcaaatggtctggatagctctaccacttttcaaataataagttgtttccagcaactgacgaacatcagcgagtacaccatggttatttcacttcttcaaccaacacctgaggtatttgatctttttgatgacctgatattaatggcagaagggaaaattatataccatggccctcgaaatgaagctctgaatttttttgaggagtgtgggttcatatgcccagaaagaaaagaggtagctgactttctccaagaggtaattttcctcaatcacaagagcagctgcagcacctgatttatatataaattgcatgttcatgaaaacagttcttttttttctgattccgaaaccattagatcttgtcctgcaaggaccaacaacagtactggtctggtccaaatgaatcttacagatatatatcaccccatgaattatcaagcatgttcaaggaaaatcacagagggagaaaactagaagaaccaattgtttctccgaaaagcgagttgggcaaggaagctttagcattcaataaatattctctgcaaaaactggaaatgttcaaagcctgtggagcaagggaagcactcctaatgaaaaggagtatgtttgtttatgtcttcaaaacaggccaggttatacttcattctaaggccctctttcctgtacgaagtaaattttgagtcctaactgaggtttactccttactgcagcttgccattattgcactcgtaacaatgtctgtgttccttcgaactcgcatgacaacagatttcactcacgcaacttactatatgggagcattgtttttttccatcttaatgatcatgctaaatggcacaccagagataagcatgcagattaggagactcccaagtttttacaagcaaaagagctattatttctattcttcatgggcatatgcaataccagcttcagtcctaaaggtccctgtttccatattagattcacttgtatggatatgtatcacatattacggtattggttatacagctagtgtttcgaggtaaataatttattggagatttggcaagttttcaacgataagaacaaacattgagaaactctttaacacaatttatttatacccatttgtaggttcttctgccaatttctgatgctttgttttgtccatcaatcagtcacttcgctgtatcgatttattgcttcatacttccaaacacctactgcgtctttcttctacctttttctggctctaacattcttcctcatgtttggaggcttcactcttcccaagcgtaagataaccatcgctcattgtgcatataaacctagcaaaaataaacatattgtgttactttgtttttccagcctccatgccaggatggttaaactggggattttggatttctccaatgacatatgcagaaatcggcacagttattaatgaattccaagcgccaagatggcagaaggtgaaatatgtttttttttcaaataaaaaaaaatgagttatcagctgctttcaagcatttacatcattgctacttgtattattttcaggaaactattcaaaacataacaattgggaaccgaatcctgattaatcatggcctatattacagttggcacttttattggatatccattggagcattgttcggatcaatcattttattttatatcgcttttggattggcgctagattatattacatgtaagtttgctaccattgaacaaagtgcatatttctcagactcgagctccatggtactcaggcagcataatttgacatacagtgaacttggggtaatgcttttggaaatctctattttagggaatacacctggttgtgattactgggcgtaatttctgaaatatctactcgatttccgatgttttttgaatatattcacatagcagatttatatacataatctgcagatacctacaatccaataataaatgacaaaagaaaatacaatttgaaattttgttcaaacttgtttggagtggtttatgattaaattagaccccacaaaattccatgccatatatcgtgacaagactgcagatatggggatgtaagagctggggcactatggagcaccagttaatttgactttatatacgcatattatttacttgagaaacaaattataaatttgcctatttcagctatagaagaatatcatggaagtaggcctataaagaggttatgtcaagaacaggaaaaagattctaatatacgaaaagaatctgatggtcattcaaatatttccagaggtaaagacataaacatctcaatatcaagtaatagtaagaaatgaaggtcccacaaaaaaaagtaacaaaccaagttagcagagttgcgtttcgaaagcaaaatgcatgcttcttcaatgcattgatctttttgcagcaaagatgactatacctgttatggaacttccaattacgttccacaatctgaactactacattgataccccaccggtaattaagaaagctccctatgtatttgatttttacagtttttgtgtttctcgtctggttcatatttgaagataaaggtatgtaagaaatgtactctcttgtaggaaatgctgaaacaaggctatccaacaaaaagacttcaactacttaacaacataactggtgcattgcgtcccggtgttctttctgcactaatgggtgtcagtggagccgggaagacaactctgctagatgtattagcaggaaggaaaacaggaggatatattgaaggggacataagaataggtggatatcccaaggtgcaagaaacatttgttagaatcttaggttactgtgagcaagccgacatacattccccacagctcacagttgaagagtctgtaacttattctgcttggcttcgtctaccttctcatgtcgacaaaaaaacaagatctgtatgtcccttggaagttggaacaacacagacatatactgattttaataacagatagataaacaagaagcttacctaagaaactaacaatgttgtttttgttcctttgggtaggaatttgttgctgaagtccttgaaactgttgaactagatcaaataaaagatgtcttagtggggacaccacagaaaaatggattatccatggagcagcgaaagaggctaacaattgcagtcgagcttgtttcaaacccatcagtcatactaatggatgaaccaacaacaggattagatacaaggtcagcagcaattgttattcgtgctgttaaaaatatttgcaaaacaggaaggacagtagtgtgtacaatccatcagccgagcactaaaatttttgaggcgtttgatgaggtaatttaactttcgcaatgtgttatatatatcaaacataatcaacacaaatatttttttattgaacatatcaaacatgaagaacaaaaataaagttatcttttatgctggaaacatcaataaatctagtttcaaagctattaggattaaaaatagctcgttccttcaacacggacttgagctaaatttaattaagatgtacattttcagttactgaaaatttgaaacacctatgtgtttgttgcattctccgttgtcttttcagtaaagaaaaattacagaatacaatagtatagaaatttgtaaccttcaaccattttactttgcacaatcaaaccatcaaatttgcaattttgtccccttaaatgatcgattctgtgcaacaaagccctttatattaattttgcttattagaaattttaacacttcaattatttggttttttttcaagccctttttattgaaaatacctaatcaaaccctttgaataatatatctatgttatgatatagatgtttatttgatatataacaactatctactttctagccatttttttccattttgggagaaattttcttacccgaacatttggcttaaactttgtgtacagaaaaaaaaacattgtattagttagcatgaagaataaagtataaacgttcagtgacagtttgttttgatatcttttttgaactaaaatacagtataaaaacatcaatgacagtttatttttatctcttatctgaactaagagttcatactatcacaaatttttcatcgcactaacaaaattggacttaccgggcttaattaccaaactaaaatggtttgagggcttatactttaatgttaccaaacagaatattatgccattttttttgtttcctggactatgtatatcacaaaaagacgtgacgacagacggtttgtgttctgagttttctgattacgaacaaaaaaaaggcagaaagctactttcctacagtgctagtagaaagttatatttgatgcattgagtaaatcttcttgcagctcatactaatgaaaaatggtgggaaaataatctataacggaccaataggagagcgttccagcaaagtgattgagtactttgaggcaggtttcttgaacatatttcctcatatgtatctgtcatttcttgattattcattttcactggtttttctgaaagtgagataagattcatcacttcttgatgaattgatatgatccgaactgccaatgccatgtgcaatgtttatgctattttagagataaattttatctttagaaattgtagccaaaacaattaaatcaattctgagtcatttgtgttcaatatgcaactttgctaacaaatcatataagttgatcaaaatgtcaacgagagtcatgcaattcatatgcccaggttgaaattttggttcaaattctgcaatccccccct

SEQ ID NO: 73335 - DNA, 1443 bp, Oryza sativa
ttttcatttttggcctgtggatgtcctcgtttttcctttcttattccagaagacttgtaaatgccaaatggaacttatacattttgtgctaagatcaaatctactgaggtgacatggaaaggcagcatgtgctgaatcacgataagatttgccatgaactcttgatagctaagtgactgcagagggtgattccaccagtggatggaacttacatatggcgctgttccagttatctgcagcctattattactgagggtacgaaaaaattgggcaggaattgagtgctaaagtattgtagttttgtgaatcaaaacttccaagtcaacaacatctcaatctcgagtcaacagcatcacaatctcctcttaatacaaagatgcgctccttgcgtattcctgaaaaaaaaaacatcacaatcttgtagagtaatcgccctacttaatgtggcaaaatcttgttcatccctcccaagagtctatctgccatggcgattcctggagcatatgctcatgccgtgcaagctttagctactggtatcttatttgtggttgtgagtcttgtactggatcatgttgaaggaaggcatcacaagtgtccttctttctcttgcggccatcttaagggtgtatcggctccattccgtcgggcagctgatccacctgggtgcggcagcaaatcttacgagctggtctgcagtgataccaatgctacaattctcattgacaatgcaacataccatgtgaatgaaatcaactacgactacagacgcttttgggtcgtcgacgccaacatagccggtagcacttgccctcttccgcagtggaatcatcttcttgatcagtacaagcgcaaagtctcaggccacaggattgagatcgagttggctcctggtgcatataatcatgcttactttgttagatgctcacgggaggtgaaggacaatggtatatacaggcctgtcacttgcgcaagctccaactattcttttatctatgtgttattatcaagtgattcagacaaccctggttacatcgaaagcctggagccttcttgtggatacctggccatgactcttctgggtgattggagcacgacagtgcctaggaatgcgagctatgaagatgtcaaaaagttcatgagggaaggattcgccattagatttccgcgcatatatggggccgggagtatcaacgagtgcctaatggattcgataaggtgagttgatttgggatccattagatatgtcttatactcgtatatgtattgtgtactccctggctcccctctttgattcctttttctctacctgcagcgaattgcgcaatggaatagaaccaaggtctagtacaggcactgccatcagtgatcggcttattgtcatctctattattgacctccatttctggttctgcttgattggatatccatcaggcatcctaatag

SEQ ID NO: 73336 - DNA, 663 bp, Oryza sativa
tgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaaggaactttcgcaaataatttttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtataccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccagga

SEQ ID NO: 73337 - DNA, 6221 bp, Oryza sativa
cgccgcttcccccccgccctggacgccgccagcgccgccgcttccccaacctaccctggacaccgccgtcgccgccgccgccgctgccctagcccgccctgacgccgccgcttcccccacccaccctggacgccgccgccgcttccctggccgccctggacgccgccgtccggttccccctcctcgtctcacaccgcgcggcggcgtgcatcctccaccacgagatgacgagagagagaccgagagagattaggaagagagagatagaggaagagagatagagggggtatgacatgtgggtcccaccattttaaaaaaaataaaatgctgactggactgccacgtagaccaaaaccaccgcggattggatcgaggggggtaattcgtccggtttgcatagttgggggtgaagaatgtccggttttgtggttcaggggggtaattcggacgatcgcgatagttcggggggggggggtaattcgtactttttcgtaaggtttaactacatctattatctattaatctactagttaacacttaacactaatgatactagtagtaattaggaaagattctgaagattttttgagagatatttttagtaagaaattgaaaaaaatttaagttagatttgaaaacttttgatttaagtttcaaattttaaaaactttcaactcagattcaaaaactttcaattcgagatttgaaaactttcaactcagatttgaaaactttcaactcgagaatcgagattcgaaaactttcaagtctggatttgaaaattttgaaaacttttaacttgagatttgaaaattttcaactcgagatttgaaaactttcaactcaagattcgaaaactttcaagttcggatttgaaaattttgaaaactttcaatttgagatttgaaaattttcaactcgagatttaaaaattttcaactcgaggttcgaaaactttcaagtccagatttgaaaaatttgaaaactttcaactcagattcgaaaattttcacttgatatttgaaaatctcaaggccaaatttgaaaatttttaagtcaatatttaaaaactttcaactcaaaacatttgaaaaaacatgtgtgctaaaagattaaaaaaaaagcgcaaaaaaaaagcgaaaagaaacgccaaatgaaaaaacgcggaagaaaaaacgtaaaaaccggcgttagaaattggttagagaaaaaaaaaatctcgcgcgtgcgtgggccttgtgggccgggcgcgggcgccggcagcgatcgcgtgttagcaaaaccccacacacactacacatgcatctctcaagtgcgaacaattctagagaaaaggcagtgttagtgaagttgctcatcaattctccctttttcttcaatcccattaaaaacaattctcccttctctgcaatcccattaaaagcatctttcaagtgcgaacaattctagagaaaaggcaatattagtgaagtcgttcatcaattctcccttctctgcaatcccattaaaagtaccaaatcctgaattcctgataatacagcgaaaggagaaaggggcaagacaaagacaaagctccctgcttgatgctcacgcttatcagaatacccgagcacgaataattcctctgctagtgcagaacgaacgaatgagaacacacatccccttctcaaaaaagagagagcgatcgagagaacacacacgggatgacacatccaacaataaaacaaacgaaatttcaaatatatttgccacggtttgtacattacgtgcacgcgattactactaataagcaaaattataataatttcaaatggcaaacaacctggtgtatgtacaaggtttttcagccttcgcacgcgaacaaattaaattaattcctctacataaaaagagaaattttttttcacaaaatctcgccggctttgcacggatcagaccgcatcacggcatggcgtctccttcgcgctggtgtccgctcccacgccgccgcgcgcccacgacaccgtccttgccaggaaggacggccaccgccgcgcgccgtgccagctcccgccgccgcccctcgagctgccctcgcggctcgatcccctgatgccgaggacgaggctcgtggcgtgccggaggcgcctcgacttgagcacctcctcccggacgtgcggcggcagccgcaccgtgaacctctcgtggtcaccgccgtcgcccggccccggcgcgcgcggcgccggcagcgcgcacagcgagtgccccgtcgagttcgacctcggcatcctcgccgcccgccgcacggcgcgcagactctccagctccacggcctcctcctccctcctcctcgtctcctcttcgtcgctcgcctccgccacctcctcaacccgcaccgccgcggcctcgggcgtacgcgactcctccgccgccgccgcggccgcagcaggcgaggaggagaactccacggcaggcggcgacggcgctggctgcttctcgaggttggcgcggcacagcgggcaggtgacgtggccctcgagccaggggtcgatgcagtcggggtggaacgcgtgggagcactgcgggaggaggcggaggtcgtccccgtcgtcgaacacggtgaggcacacggcgcactccagcgcgccgccgccgccgctcctgtgcttcctgacctccgcgtacggcacgaccgggatcgccgccaccgccgccgggtcgagcccgcggcggcgccgagcagccgacgactgcccttgcccagccccagcgccagcggaggagtcgcagtcgcagcactggttgacgatgacgcatacgaagacgaggacgaagaagacgccgatgacgacggtgatgacggtggacacggcgcggttgaccgccctcgtgcccgtctgtggcggcgccggcgacgcctgcgcgttggccacgtggaaaccgccacctacgacgaggaggaggaggaggaggaggcagaggcagcgcgcgcgccgccccatctctctcggaaagggaggaggaggaaacggcggcggcggcggcaaagtgatggatggatttgcgatttgccccctttttcttcgtcggttcgtgcgctcctcagccgtggatggacggacggacggacggatgatatgctttgctttgtggtgccaggttgctagctgttgacatgttagcagcctgacggcggttgggggcgcgatggctgtgttgtgctggcgatccgcggaaagatgagacgatgccacatgccccaactgttcacgcccctgttcgtttgggggagatgggaaccaaactcctatgcacgaaaaacggagcggtccattagcacgtgattaattaagtattagctaattttttttcaaaaatagattaatatgatttttttaagcaactttcttaaagaatttttttgcaaaaaaacgtaccgtttagcagtttgaaaagcgtgcgcacggaaaacaagaaagaggagttgggaacctgcccaaacgaacagagcatattagtgatgctaccaactcctgaaccccttttgaccggcctgaataaaaaagaaatggctgtgtggtgattgactgagcactaagggcgtccataatactagctaaatgctcttgctttgttacgggtaaaaaaaatcataatactttcttaaataaataaaaacatattttttttatgaaatatgttacccatattttcgtataggggaagactcttcttaatttaattttatatgaagctatttatttagatttaaacatgtaaagttacgtatgggcatagatggctatatgccccgtggtccgacggcccgctttggcacagtttgacagttggctgctgccttggcatggtggcccggcatggcacgaagttcagggaggcgaaatagacttactttctgccatatgtatggcacgacccccaagaagagtgagggaaaatggacttattttaaccatgtataagatacggcccaaagaggagggacaaaaaatagacttactttagccatatatatatatatatatatatatatatatatatatatatatatataatatatatatgtatatatatatgtcacaacccaaagaagaggaaggcaaaatagacttatatgaaagaaagcacgatgagctgctgtgccttcaagccggctcggcacaacctggcccggcacaacctgacccttattggactgtgccgtggccgtaggtggagcacgtgggctggcgcggcctagcccgcccgttgagcgagccatatcggtccgactaatcttgggccgtgccgggccgaacggcccatttggccatctataagtaagggggtgacagattcactgtcaccatcattaaagtttctttaaaggagtagagatatatgaaatgttgatagtaaggagtgggtaagtagtataggaggtagtaaatccattaagcaatagcactgttgcgatagtactatctagtatcagaaaaaaaaatccactcctctcttatctattgtctttctaaccaactattgttcgacatgtgggttctagcttattatttatacattgcgagagttagaaacaacctataacctaattttgtaagtctcactctactacttatctggtgaagatacatggagaatgttaagggcaggtttggcttaccattcttaactgcaaaagaaaaaaaaagagctaattgtacttttgtacaccctctagctatatttttaatttggattagtaagattaccttttattacactttggaccattctaagtcagttctctagctgcatctactatctagtcttataggagtagttgctagaccccctaacttgcttgttatagctaaggatgctcattttacctttaatgttgagtgattgagttcatttaatatccttaaagctctcatgtcagtactaatcatccaacgtactgattggtcgctgtcgtttgaaaccatgtgcaatgctagtgataatacttttaggatcattcttaaagtaagaaatactatgctatcgcatatgctagtaaaatgtggactggatctcagttaaaatagtgcaacatttgaaaaaggagctccttgttgttgttttatcttttgataaagtcagttcttacttagtgcagcaaacattatagtatacattttacaagaacttctattacaaagtagtcttgaatgaaacttgagagatcttcacttgagtagtgtgtattgagagtgaagttcattcctccttttataatgtcaaatggcagctataatggcggttactagggtcggttcacccacaaatcgtcatcagcatccaatgggaagacaccatgtggaaggcggtggcaaggggtgccacccctggttcggctgaactagggcaaccgtgtcttagcccactgacttcctcccagagtatgatgagtgggcccttatgacggtgcatggtagataggcctcaattatgttggttttgcattgatttgtgggtctttcaatccgtgtactcacgtatgattgcccagagatgtatttcgtcatatgacgggtgtattttcatccaaaatcttctgcatacaaatattctaccatactcgtggaaatggttactaataaaacctaccactaagtttgctattccattttatttagttttatgtaggagttgatggtcagatttgatatataaagactgtcaacagatatatacttaaaaactttctgcaaaaattacaggggtgggatagagtatgatggagagcctagctgatggatttgcccctgccactatcttaagtgacactattttttttctcacaaattcttgggcaactgcaggatatttagacaatcttattcatacatatgcatatgcatattattctcgtgctcttgcggtcccatgtatatgaggaaaacatatactacctccgttttttaatagatgacgccgttaactttttctcacatgtttgactatttgtcttattcaaaaaatttacgtaattataatttattttgttatgagttgttttatcattcatagtactttaagtgtgatttatatcttatgcatttgcataaaatttttgaatataagacgaatggtcaaacatgtgagaaaagtcaatggcgttatctattaaaaaacggagggattatatcctgattccgtacggtaaggtatgggaatagtaaagcaagtgaagattc

SEQ ID NO: 73338 - DNA, 925 bp, Oryza sativa
ccctaacagatgcacctccaatatcgacaatttctatcgagtttttcttgtaaatttatttcttcttaatatacttggatggcctctttcaaccttcccggcaaattcacacctgtgattacccaccaccggccagtcactctgctactccaagccatgccaaattcacccgttgatttcagtaccaacacgctaaaagcgagtttcttttaatttttttttacagaaatgcataaaaagatcgaaaggtgacatctcaagtcaccaacatactgatgcactgttcgtttggttcattgaagtgaaggcttgcagctgtgcacctgttcgtgctatgctttcagctttcgtgcggtcagacaaacatgacaagggtgtgtacagtgtactggtcagtcagacatgaacaattgctagtactcccagcggtaacaacaggcactaccagtctactaggctgtccgaatcgcggcatttcctcatctcggagagacgaaggcttgaccatcactatcggaatgagctctgacgtgctcatgcgcagcacacaccacagaaattacaacagccaaacaacacatgtggccaattttcacacataacgagataacatcccaatcacaactttatgataaacgaaagcttccatccagttcacggcaaagagattactcatcataaataaatagtgtacaataaaatatatcactgtttacaaatattatttctagcttcagcattttaccacctacctacaagctactgtagctactagcttagctgatttggcatcaaaacatgcacaagttcactcgtcctcctctaagatttcagttagcccagaggagaattggtaagaatccatcataggtgacatggattcatcatcacagaagaatgttcttggaggcagggctgcaggaat

SEQ ID NO: 73339 - DNA, 17908 bp, Oryza sativa
  unsure (1)..(17908): unsure at all n locations
ccaccccaccaccaactcccaacctttttaggaatggagaaaggacatgtggggccagagggcccacatgtcaatcacccaatcgccaactctgtttatgtggaaaggaaaaaaagacactgtgcagctagagggcccacatgtcagtaacaaaatatatatagaaattacgagatgatgatggtaatgcaggttaatgataattttcattaagtaaaaacccattgcaacgcacaggcaatatgctaatagtatcaggaattcaaaacttgaccaggtagtgccaacaggccgataataatttccaccaaactgctggcaagaagtagcaagcaaacaacttgcagttacacccataccagtgcaaaacaatatggttactggaataactgaatttggttgggaagcaaccagcatccgatgtgaaccggatgatatgtcaatttgcacgcgtatcaacgaaaatagtctgttatttttatttcagacagtatattctttcagcttaaattgtactattcaatttcaagtgccagttacattggtgtgaaacctaaaaatagtggtattttacataggttctaaccattcaattatgttattctgaagtgagagaacaaaaatgtaacatctctcgggaatctcagcaaaagtatgcagatgcattcctaaagataaggctaagaactgacatgaaaagggaaactaatcaaactacttactagagattcctttgtatgttcataactgaaatcggtcgtgtaagttcaaaatattgggataaacatgcattatacagcagattagagttaaaagagctcggtaaccttttgcactgtcgaaaaaagaacataagatacccatgtatgggatcttcctgccataattagcatgtgtatttagcaatattgtcaagtgtgctcaactaattgcacatatctaccatcttctcatgttcaacgaattgaattgttatgttgaaaacttgaaattggtctacatattgctgcataagtgataaattgtacaaacattgtcatgggacagaaaatgtatctatacaaataacaaatatgcttcatctcagcttcaatcaataacaactaccaaatccattactttggtgggagagcatctggattagaaagcattttgatgctcatatactccccatttctaggatgacttattttcaagttcatactttcaaggtaacctcaacttaaatgttttcaacaatcaaccatacttcttgacagaactaaaagtttcaagtgtcagaaaaagctcatcatcttgatggtataattgaatatgtaaatagatgaaactgaccatataacagggaatacatccatacatatggacaggacaggactagaacacagaaagaaactcaaattactgtcaagacttaaaagatttacataggattcatgaaagattttaagatgttaccttacgattagaggcaacagtagctctatatagtgctgttgtgctaggataaacagctaagacttgtcgaccctgcccaaaatctggggcactggaaggatcccctctctttggaaatggaataatatctgacataggcaacttgtacttcctattacaaaagggggaagtaacattattttacatgtggaacaaacatcaattatagtgcaaattaatgctcagagtttgcaaatgtttcactaaacatcatatacataaaaaactagagtgctttaacaagagtacagcgaacatgcgtatagcatggtggtaaatgccttctgttgggaagctactgaccagggttcaaatcctggtctttcaccaaaaaaggtcactcgctggttcccccaaaaaacatgggttaagaagaatcgacctatggagggtgggcctcaaagcacgggttaaggttcgatccattgagggcttctccccatgtagggaaaaccggtttttgtgaccgttctcggccccagtttcgggtgctttttcttagttgcaatacctctggggaggtctttccccttggggctgagttcttttttttacagtagtacagtagagggaaacaggtaaggaaaatgaggaagttgatggaagttaattttcaaccctacaacacaattcaactcaattaatcaaaattaactgagtcacatcttagcagtaaatatctataaataatccaaagggactaaggtttaattattagaataaacttaacacactattgttactttcacagaatcattaatccctcgtatggtattatcttacccattctcaacactagtaacacctctctgcctaaacacacatttggtggatcctgtaaagatgtaggagccaggaaaggagtacaagagcagagatccaaaccgactgatgttgaagaatcagcggatgagttgtggttagggttatcaaggaaagggtcacacaaaagcttgtgggttgtggctgtaggatactgtaggattttttttaatgaaactagaagtgnnnancctggtctctgcaccatgggtgctcataaccattacactgccataatcagcgataaaaaaagagaaacaagatagaaatactccctccgtttcaggttataagatgttttgactttagtcaaagtcaaactgctttaagtttgactaagtttatagacaaatatagtaatatttacattaccaaattagttttattaaattaataattaaatatatttttataataaatttatcttgggtcgaaaatattactatttttttctataaacatggtcaaacttaaagcagtttgactgtgaccaaagccaaaacatcttataacctgaaacggagggagtagaagacatggccaataaaggaatcatgctgaggccaataccaaggaacacccacaccaaccttgcgacagcttgcttcaacaggaacaaccagcatcctgatgccagggaacatgatgtggcctagcatcaaggaaattgaaggctacacctaaatcacctcaaaggatcattgacttatcatcgtgcccaaccaaagaagaccagactgaaggtcagaccaaggatttgcatcccagaaatcagttatgattagtcttttttttgtatgacatatgcttgctaattgcttggaagcccctaattaagttgaacctaggcaccttaggagttgccgctgaccatctagcaccttcttgaacactagttataatagacaaacagacaatgctgccatagtgctatggccaatccacctgatctggcaactaggtaaggacgccatctgaaaatctgcatgcctgagggcataaccgattcatgggagacctgacactagtgtcgtggcaatatctgatctggccagatagatcagaggccagactcagacagcacacacgcttgacatcgctgtctgtccaccaggaaacaacagctgcaggcagaagaggcctggtcgcagcagcaaaggtagggggaggaaaggaggaacagcagcttatgtttagtcctctaggttgacccaagaggcctcaaatgtagcgtaggattaacaaaatgaactagatggtcccaaaggttcagtatcaatgaacatttcaggaatcggaatatattgaaaaatgacctgattgttatagtaaaagcaaacaagaaaccaaaatgacagtcctggacttatctcatacttttgggcactctcttcatcgtcacctggctcctcatcaagtacctcatatctgcaaattcaatgaattcatgaatgcttccttcaagaatagcaatattacagaaccccactcccccccccctccccaaacacacacacacacacacacacacacacacaccccaataaaaatacgacatatattcaagtaggaagtaaaaatgggcactgggggctaagatgatgtcagacgatccaaaggaatcggacatgattttgcaagtggttttcatagtagggatgacgagtcgtgtctccacaagactaagccaaaagggtggcactatggtccatttgcaccaagagagagagctagtccattagagacaggaagaggggttaaatggaggtagtgctgtgctattgtgaacatgggtatggtcttctctcaggacaaacagggcgctgcataagcctcgtctcaggaaggatggagcatagaggcagcacagttcagtgtggtggaggagaaagcagtgtgggcatgaggagcagccaagtacaggagaggacgaggtaaaaccacaataagaggcagcgtggtagacaaagtggtggcagcttttcactataaagatggtcacagactagagttctctcctactaatcttagatctaatggttaatggtgacagtaattgagatcaaacagctcaaaattaaacggatggcgtggctcaaccaaagagctggcattccaactactttggttatatatagaaagatataaatagagtagccccacagctctgctggctgttttcatattcatgtttgccaggctcttctggataatcatgcaacctgaaatgataaccttcttgttatttacaatttccttgtctacctcagatatcctaaaatgctccatagacccaggactcatggtcctctcaagtaataatgactacaataagacagattaggaaatagttaatagtctaaaactgccctcatccgcacaaagttttttcccctagagcaagttttcatacaagaaatatataatatagataaaaggtgaataagacatactcttttgtttccttatcgaaatgtatcaccttcaccacaaaccattcatctttttcttcgtctgatttgaccttagctgcaacctgaaatggcatagcacaaatgtgagacatttaatatatacagcatgttatcgcacatgtgcaaaagagcagaactgatttatgcacaattgatgatgtgctaaagagaaaggaagggtaaatttctttatcaagcatatcatccgctacaagtaccaacatcaagtatcaagtttttttagcgcatggtaaaatgtctcaaatagatgtcagttcaaagactggaaagggtaatatcaagacaatcctaattaaccctggaccttggagttcttgccgattagtttgattaaatatatactatagacttaacaagtgaaaacaaaacaagtatggttgaacagtttttatgcagaggatttcagtaattttggtgtttttaattgataatgttcattaaatttacataaacttacatacaaaaatggatgcagcgttcttttcgtaagaatgcaatgatgttttcattccacaacacaaaatcattgcaactgaatgatgaaagtatctttttttctagaaaaacataaattataatttacttctgtatgctggtttttccagcagtacagagggcattaaaacatgatgctgaacaagtccaaatttaaggataatagaagttacagtaacatctccagctcagagaaacaaaataatgttcaggaagcaataaaatctaggtacaggtctttgatgcaagaaaaaaaatcattacataaaatagataacaaaccccagccgggtaccacaaacgttatggagatttgttccggttgaatattcttcccatgtttttttgcaaacttcttcaaaattttgcttactcaatcttcactaaatctttagcaatacattttttttaagtagttcttgatgactccaagaccaaaatgctatgttaaataggataattggatctcactctcacatgtacatcccatgagtagngttcatgtaaaaccatcctaaaatctatatatggcagttgtgagtattcaagacgcagaaataaaaagagtcaggcatgttgggtgtttgagggaacacattgcaaaattgacagcctgaacaagatttaaacaaccctgttaaaactaaaacaccacataggaaagttactaacaagtcttcacatggaaagtagaagtgtttttttcatcagcgttgctgtagcacaaacagctgaaatacaaaaactaactgatatttccaaattcagctgaagttgaaacctgttctcctttcaggtttgtagcttggtcaagttggctcctcatagatgcagaggagaatcgtgtagtatctgtatcagacttcatcctcttctttttctgctcaccaacttctgcaaatgtagcaagcatctttagtttttcatgctcaacaataatttgtcctgaacctgactcgcaaaatcttttctagtgcttacctatcttttttcgttgtgcagctgaagttccagattgcaacaaaccatccaatagtccaaccaaagcagacgatgcactgcaaagtaatacgaaatatttgatcacattgcaggagacgtttcttccaatagaagacatgcactcagagcggaccagataatccaagcaaatatcagtaaaatagtaattgaaagcaccaatataaaatcattgaagtgaaagcgctgctgttgtattgtttgtgatcccatgatggccagcatgaataaccatgttctacaaagccaatgttcaatgtttgaagaaattgtgcctaacaaagaagcaggaactttctgctgacaagtcgcacaaaagttttttcttgaacacacaggaggactgcgatcatttcatttataggcaagttgcacaaaagtaaaaaaatcaaacaagcttatagtccaccattctatgctaaattctgaaaaaaaaaaagtaaaataggttaacatgtgcaagatatacagcatattcatgacatcaaaagtgaaattttagtttcatcaaagaatttttttactagaaattcagtaaatcaacatttcacatagtatgtgatgctcaattctcttttcttatttacagtcatctactttttgaacggaagcttctgttcaggcatataggatgctgtacctattattgagaagtcaaaaccaatatgatgaacttctgagactctttttgaaattgttagcgcttcattttgattgttataactgaaccaaaactgttctctgaggtaaacagttggtcacgactactatctatttttgtacatgcactcaatagattcaggcagggaagtgtttgtactttctactccaccctgtcccacaaagactccacttttgagacaaagttgacaaattagtggtgagagaaagaccacagtacccctgattataagaaagtagtatgtgaagtggtaggtaaggggtattgaagggataaaagtaaacttctcgatttgcggaccgagggtaaataagaagctaaaaatggagtcttttggggacagttgaagggctagaaatgaagtcttattggggcagagggagtagcttttaagacttatccagcagatcagactgtagggagttccatgattttttgtagatcttaactgaacaaaagaatagcatgtgcaacacttgaacaaataaaatttcaacatacttgctcctaaatttagctaagcctggttaaaaatgcttcagcatgtaagatttcaatataaccgatacactgattgtgttcatcagtattgttctttgtgttcatttataatgttatggaagtccacaacagaatgactaccaccggaagaggccagatggaatttctttagaagaggaagcgctagatgaacaatgccacttggcagaggagagggctggaacatgaacaggagtacagggcttttttttttttttagttaaccttccaataacagttaggcagccctttatagatatggcatacactcaaactaacatgccaacacaactaacggatagaccaactaacagataacctgaccattcagaataacaagtcaactgactaagcctaatgacttatctgccacaggcctcatcccttgacaatgcagacttgccacatgattgctgccacgacaggcctgaagaagcctctcacatagtggcatttttcttgctctagattggtaaaaggaactaatatgtttgcttgtttcatttatatctaaacaacttagatttatagcatcttttcatataatagtttatgaacttagaataaagtgttaacttctattgcacagttgtagctggggatagagagaaaacacagatctgatttatttgttagactaatgattatttaaacccaccatccagaagcttgaaaagtaaccgaaataccacctcaactcattcctcttgacccacaaagaaattgacagaatcaatgtacattgctgacacatgcaatttcaacaagattgaaccacagaaacagcacctaatcacaatattgaaaattcaaattgataagtctgctcgcatttcgcatggaaattggtgatgacttcaatagataagctagtacaacagtggtcaaagttgattttttttttaataaatgtttcctaagaagaacagcatgcagcaatgtttttgaaaggagcacgaagaaaattgaagtgagaaaacaaatgtgtgttcacaaaatttttgacatggagctttgacaataattgatttatcctttttaagaaaacatcttaagataacaaaaaaagggaaaattctatcagttcaagcttcatgaaattacctgacttcactctcacaaagttctttggcacgtgtatataaagcacgaagccgaatcaacgtagcatcaacctgtttatcaaccatctctggagctacaaaacaaaccaaatgtaaagaattttaagatttatgtccattctagcagaccgtaaacattactgcccacttaaatagtaccaagcacaaaataaaatccatagaacaaaaatacaggagggcaagggctcaggcagacagaagcagcagaagcccagacatatatcagctggaggctgatccaaggaatagcaacaacaatctggaggagcactgtaataagatactgtagtgatccatattcagcagaaagaagccagctccaacacaagagaagaagcatggctaggatatctagcagaaagaggccataattccaacagagccaacagaagcatgcaaggacacctggcagcaagatgtcatttcgaacagacgcaccaccaacattcgagaggcctgtactgaagtaggagaattcttcaagggttttttctctatatgcaatatagatttatttgatggcttaacaattgtttcatattcaagttccatagtttcatttatctgtttgtgtctactaacataatgaaaacagtacgatgttactaatatgcatgcacgaatctgactatcaaaggaccaccatcatgacaacaatgcccatggatcaaaacttcagttatttatcttgagcagaacactcacagttaaataccagaatttcaacatgatttcaaagagaacgaaaaggacaatttcaagcagcctctagagtctagagaatacaaaaaacttcatgtatggaccctcacaaacctgaagtggcctttctgtaaacagtgattcagaaagaacaagtagttaaattttcagcatagatcaatagaaaacgaggagaaaaagggaactcttcattctcctctaaatccattccgcttctcctctcccagccaagaacaaaaatatatggatgggcttaagcatagtgatgggaacaaagcagcttacagaagcggagtattttgtggatttcattgatcttctcggtgatgctgtcctgatctttctgcagctgatccaggtgattcaacttctcaagcaggtgctccatgtaaccttgccctcttcttcctcctcctcgccctccctctccccctgccctagacgatgacatctcctactctcccttagataagaatttgaccagatttgcacgagtgaacaaggcacagattgatggagatccaaggaagggggttcggttctctcaatttcagctttaaaggtgtgcaagagcaggtgattggaagtaaataaatgagtagtccatttctaaaaggacaaattcaggcgcaaccaggttacggttgcaacctttattgctggttctaggcgtatgtgccagtttgccttcctagctgtcgttttgcttattgggctccgcaacttgctcattttcaattatgttcagcagagtatctaggtgctataacctcatgagtattcttaagcacatagtaatatattgtgtttcttattcatttggattcgacaaaaaaagtatagcctatgatcatccagtctactcgtatatatattccttactcttatatacattccttcttcaagaaacaataattgactagcttgattggcgaaatattaacgttttcataaagatgattacccaaattgatcgaagaaatatcaaggttttcataatcttctactattagttatattcttatcttctactattagttataatggtatatcattaactatagaagctataaagttctaattcgtctcatttaccctactacccttctgtagaaaataccatttttgcacacctccatgcgctgctcttgtggcatgtatggaggaaaacctacagtttttgttcagttacccataagagatttcgtatctctgctgctcctgataaatatgcatttatgttacctataagaaatttgtgtctatcctccttaaaaatatgcatttatgattgagtcaaaaagaagttgagcatgagcaagcatcttgacttaagttaactcacaaaatggtcttcatacgtaagtagccttcgagattgtttctttcatactcacactccccagccaataaatgttgttaaataatagaagaaaacaatatttactgatccaagtatttcagcaatgcatcatatcattacaaatttggcttttcaaaacacaaacctagaggttatattcatatttcgatttttttttatgaacaaagataactgggtaacttaacagagatgtatactgacatttttttttctactttaccttgctcccacttcccaacaaaaacactacttcttacgcatctccatggcatataattttactctcgaacgtctggaaaagaaaacatctactctttttcataggaagatttgtatgtttgacacatgcatgagattcatacaccctgaaactttaaccaaacaagcaagcacaatcaagaaaaggacaacagatcagagtttcagttctgtttttttttttaatagagggccaaaaggcctctttccagcgatcctagagtggagacaacagcagtcatgcacgccccatccaccccgcacaatcaatcctaatggttgtgctcgagcaagctatcagtcttgcagctaaacacatcctagccaactactagcatatcgcacaaaccaacaaaacaagtcaaaacccccgtagcaccgcctcccaatccacctaattcgaggtagcaagcagctagaaatccatctaaaccgtccaaaactgaacatccagctactggataagaaacgcatccaacatctaactgaagggggccgaaaaccgttcgtccgttatctacaaatataatccaacacctcggcaacaattcgaacagcacggaaacgaaaacagcacccacgcgcgcgcatggcgagctacttacaggagaggatcttcttgtgcatcttgttgatctcggtgaccacctcgtcctgctccttgcgcagctggtccagctccttggccttatccagcaggctcgcaatgtccgctcctccgccaccgccgccgccgcccgcgccacctccccctccgcctccgaccgacgacgacatccccggcgcggatttcccccacggttcggtaaaggaatcggagggtggatcgaatcgatctactactctccagttgggggatggggggacagctcgaggcgagccgaggcttttatttggtgccgtgcgccagtgcagaacagcatagtcggatgggagaatcaggaaagcattttctgctataaacacaaggttatcgggataaggatacttaaaatggtatcttagtatcgggatatgagattttttaaaaaaagtttaattaatatttatattaattacatatagccactatatatatataatatagtaataataatatatgtcatgcaaatataaatatttattaatagaaaccacgttggttttcatatatttaattgatttttatataaacttgagaatatttatttacattattttcaaactatcttattttaaataatattttatagtatcgaagggatcgtagaatcgggatactacctaaaattttataggatcgtgtaataatgaatagtaggatcgagatactatgaaaattaaaatactaggtgggatcggtattgttttggcttggtaggatcgtaatatcgtaagatacgatatgaatcaggatactgacaatattaataaacacaagcataccatccgaatatttactactctcactagtcaccatccaaaaaaaatactgcatctccaatactagattgttttttattttacaaatgaagtatttatcacttttaacgtagaatttaacaatttgccacgggactcacatgtcatagatatattagggcccatatgacatatgagtggcaaattattaaatgtcacaacttaaaagtggtaaatagttaaatgtcgtaggtttgttggggctaaagaaaaattggtgcctaagtgctcatgcgttacaatggatgttaaaaaataagtgaaatacatgattcgttatgtcatttacgtacatgatcttataaatcacataattaattcataataatagcttaatgtatctgttaatgaccaaatttggtagaaccatagatcggattcaagaccagagtcagggcggatttgaagggattctggttgagaaaagcagagtgtgtatcggctacggatggcatcggctgccatatgcatcggctgacactaaatccgacaaggacaagccgatgcaaccgatcccgaacaggtggtcctgcaactgttgtcgggatcaattaaggcacttcataggcattgccacgcaaggattagagtccagaaaaggaaattgtatctattaattagaatattttgttaaattccttatagatatttttggtaaaattccgcctaagggacttgttcgtgttttaaattgtaatagagatagagtcgtgtccagcaaggacatgttatatacttcgggtataaatatggcccgacaccttataaacaagggacgacagttcaataatacttcggcgcatcgccacccttttctattttcattgtttcgacgagtttttgcttttgagttgggctgcatcgagttcgatttccaacgaagaggtaaagcttgttatggcggtttgtgttatcgggattagtgcttacatctccatgatactctaatcccgcccatgtgaatcgctaagttatcatatacgctgtataatctagattgatctcgtcatctaacctcattggctagcctctatcatcgaaaacggccgatagatttagatatcgacattgagttagattatacaacgtatctaccatcttgaaggagttttcatcggtttgtttggatcttgcgtttctcttcacacttaatgttgcatcggttaggtccgatctgttaagtaatgtcttgaactgtaatatctaactcattctatgaatactatggagatagtatcggggtttcagacgatcttacctggtttagcagtcttgttccttatatggttcttgatcttctaaatctgccctttatattaagatctcacttgtttgaaatatatcgagctctctatcggtctgttagggtatcccaattcctgggtttatgcatgctttatatatttcatttgtactaatatcttagtgtgaggtggtatcggagtactagccaatacgcgttaggtttgctttatcggctatgctttgagcatatacgatccctactttgaagtatttttagacatcaagtgatttatgctgtctcggcatgttgtccgatctatcccaatcacttggtccaaatgtatttcattggacagattgtgtattgttgacatctacagccgatcgaatatctaataatctctatgcttgatcttccctcgccgatctaatgcaagttacatcggcttggcaccgaacgatatgtcatcagcaaatcaatcgatcggctaactttgttcttctttgtctcttgttggttgcaggatcaaaccaactggcacgctcaaaacctgaaagcagtttcttttgacctatactagagttaagcagatctctgaggccagtacgtgttttccacatgaacagtatcatagtataggtcaaaattgtgtttaaccagtctaagctttgcatttggccctcttaataccactgaggaaaaaaaagtgcaaatagcccctccttcctatagtgcacattcaaatatttattcagccccctctcgcacttcatttcaccatttcgactccctagcacaattaataaggagggcaacgattaggcgatgccgacaatcgtcagcaggccgaggtgctttgggcggtgatttgtatagcataataggtggcacacgataggcagtgcaacgtggcaccatcgctagcatgaaggtagttgatgaacatcaactttgaggggggatagggatatgccttttttctgtcacagtggcttatgtaggggtcaaatacaaagtttcgatcagtatggacagccacattagtgcccaacactggtcaaacgtgttttgcacctgattgtcatcattaaaccaagattatagacctaaatgtgcaatttagaatatcacgaacctaagtgacaccttggtcaaagtttaagcatcgatcgtgaatttcactcttaaaatatcaatctttgattttgggtatgttaaaccctatgattgctatatattgtttgtataattttctataactctcagtgaatttttttagcgttgtattttagtccaatgtcttaatcccctccaacgcacaaatgatgacataccaaatccaatccccgcacatatcttaccttctacttcgtcgagtctctattattgatcggtcacacatcaatctttcacagtaacaattgtcattctacagttatcctatttcatgatatcctagaccatactctctactagttttgccaatcccactcatcatccccatcattcccctagggactatctcattcattgttaggttatacctcgaccgtctaggtcttctgtaaacccaccccctctcaataccacccgaaatctatctattgtgcttgaaaaggaaataaggtgaaaacggtggtctaaatatttgtattgaatcaaaggctaaatttgaatgaaatcattttcaaagtgatgtgtatcatgtttagcaatttcctaaagagcacctattactttgtttagggtttttagtgttcaatgctactaatcattaaaataaaccatgcttgctattgtgaaaggagttgtgttcctagtgattaagtgtgccacaacattccacccatgaaggaacttaattgtcttcaatgagtaaagcaaacattaaggacctatttgccacaccatatgagttgagagtgaggcggaaatggaataggtttttctttgcattcaaaatgatcaagcaagtagtgtggttcatgcatggctagaaagtttgcgttgaaattcaacacgcaacagtttgtctaaaaacttagtagatcaaacaatttgatggtgacaagtccatccaaccctgagaaacaaccattttgaccgaatgtacatcattaggttgtgtggattagataattcatgatgcgaccaagagtactatggatgcaactatttctcgtgtaaagtatcacgaggtaaattcgaataataacatgctccaacttgattgcattaagaatatggcactatgtaatgacataaatatatttatttatttattcagtgacatataagaatggggctgcatgtggatattggacaagtcatgtgatgcatcagaagatagagatcaagtcttcacaagttcaaacggttacatatcgttacttctagtgtggtagttacaattatttcgtaacaatctcaatcttagtgatttgagattaagggagaatgttagataataaggcatagatttgtacttttttgtgttgtgttgataagatagtttctaaccctagaggttgttgtaaccatgaggatataagatatatatctcctgaccttttgtaatcaccatgccaaggggtttttctagctatataaacacacagacgagcttggaggaagggcatcgattcaactaacatcaataacaaaataattttaggaactaggaagagctaagcggcacgctttgctccatccggactcattgatttgctctagaacaaagagaacctccacattataataatttatagataacatgtgttgaatctcatcccaagagaatcaattttctggaagaatgtggtttgggtttctcaaagcacaaaagtcaacaagcgcaccaccatttagagacccaggatatcagagaagacaatgtatgaactatttgtggcgcaaaactaacaatggatgttggcatgttgcataactaccaatggcaggaagataaagatgtggggagcacaaatgaataaatgtcactcatgattcacttataccatttttcagaagcttaggatggccatatctccatggtgctcaagcatcgcatggttcacgttgtaagaaccaatcaattgtaggaagggatgttcattgcataaaggactaagagtatggcgggctcctcaatagattgaatagacatgatgtaaacattcattcagtcatttgtttaataggacttcagtaagaacaaagaaaaagagaagattttcattccacttttgtaggttatgcattgatagtaaaacaacataactagtgctctcaacctctgttacctaaacatcacaaacttgtcatccaatggaccatcaggagtatacacttatactacctttgttttctaatagatgacgtcgttgacttgtagaataacatttgaatattcatcttattaaaaaaatagtgtacatatgtcaaactgtaattcatattttgagagggaggctgagcaccacctcgtgcggagacaaaaataatgggattgctgggaagcgacacaagataatgtggaagcagtgagcccatgtgggggggggttgtaggatcgagatatcgactagagggggggtgaataggcgatttaaaattaaatgtcacctgatcaaaactaacctaagttgctaagctcggcgagggacaagtctaactaagcaactaagttatgttatgcaatcctagggtgaaaatggctcaagtatgtctctatgaaatgtaaattttacaaagtaaatgatacaagagacaaggaatttttcaccgaggtttggaaactcgccggtttcctactccccgttgaggcgagcccaactccaccgctcaaccacgaagccaccgcacacatcctttgtaaaggggtgggcaaggcgggagccggcccatggagaggactacccaagcctcgatcactcggggtagttcttccttcactccaaaggtggtgaactccaaaccactcacaaccggcaccgggcttcctccataatcttctcggagaggtcaccgagcaactcctccacaagccgtctaagaggcggcaacctccaaaagtaacaagcaatgacgcggctcggagatgatcaagtgccacactagctctacaatgaagcaatgcac

SEQ ID NO: 73340 - DNA, 1168 bp, Oryza sativa
  unsure (1)..(1168): unsure at all n locations
attcctgcagccctgcggcatacttttgcccaaacatatctctaaggaaattacatgaaatatcctaattaatagatacaattgcctatccgagagctttatctccatcacggcaatcctcgtgaagtaccttgatcaattctagaagcatcttcaaagtcatcatcatcagaatcggctgcatcacctctatcggctgtatcggctaccctctgtccgatccatctcagtcaatgcagactccagccgatgccttcgcagccgatgcatactccgttcttcgaatctgtcgaggagtgatcctctctagcgggagatcgtgagacccccctttgtgagttcggccgggggaagaggctcgctcaaggagatggtgtatccgccctggactctactgaactgcacactagcaccgagattatacaggttcgggccgctacgaagcgtaattgtcgcgtcccaaaatgaccctaaaatataccctttaaattatgcctagaataattaaaatccttgtgaaagccttcaaaaattaaaatgtgcaaagttaaaagtcaattaaggcttggaggatttttgtatatttcctaaaagcctaaaatgtgtaaataaattttagtggaattttcagagcacaaataataattattaagaaataaacaaagttaaaaaggttttattaagagggggntcgtnggggtccccctttcttgtnttgggcngnantnggcccatctccctccccctctctcctctcccccgcggcccactcggcccctccccgcgcgcgccgctgacgggcgggcccgcccgccaccctcgctggcgggtggggcccacccgtcatccccgacctcccgccgctccgcccgcgccaagcgccgccgccgccgccgaatccgccgcatcccgcggtccccgcgtgcatttaagtggggggaattactccccgtgatcccctccctctttccccccattttcccctctctctctctcgcattcaaacggccggatttgcccccgcaaatctcgccggcgccattgatggcggccggacctcccggccggtttccttccttccccggccgccctctgcccctcccaaccccatttaaaccctccccgcacctccttcgcccatttccaccctttgccgggctgcaggaat

SEQ ID NO: 73341 - DNA, 3638 bp, Oryza sativa
cccccctaagccccactaaatttttcacgagatgtggtggctggagcttcgtcaggttggctggagggaaggctggaggttgaagacgatgttatttcgcgatttgggcttgtttcgaagagcagcccacgaccacgagcgcagtcttcaagttttgtctagcccactccaagcaaaggcccacggtggcagattccagccggcccatttggctactccccctcccggcctcccgcctccccaattccccaatcccactggccacctcctcctctcctaaatccctaaccctaggcgaataggcgcgggcggcgggcggcggccgagcaggcggcggcggccggcgaggggccagacgggaggtgtgccaggcggtgccccggtggtccagtgcatgcccggagcaggtggcgacctccggtgagctgcaagctggcgagcgccgagcggcaagcaggcggcaccgtggcggcgtccagtgagccggcgatgggccagacaggaggcaggccaagcggaggcggtggtccagcactccagcgcctgcgccgccacgccgccgggaaggtggcgagccgctcgctagcgaggtgccgcgagggcgcaaggcgccgaggcaggcaggcagcaggtcagcggcacagtggccggcaaggcagcaacgagtcaacgacgcagtcgcagcctactgtgactgtgattgaagatttgaagttagaaatcggtaaactagtaacctctaatactaatagatagtctaaaattgtgtcttaatgaggttgtgcacttgtgcttgaaacttataattattttctatacatttttagattgtcaacatgtcaaaaagaacattgctcacgtattattttagtttaagcaacacaaatggcagtgatcctccatccagtaaagtgatcctccatccagtaatgagtgtttaagttagccaaagaaacccaagtcagggttttttcaatcggatgaaaaaatcatccaacaatttgaagatatgaaagcgcgtcagatgttagtacctcaacagaaattagtggtatgctctatgcctccattcctccctaaatctctaaattatttgaatccaaaataagtatgtttcgattattcgttaatttgcccttttctttgtataaattactactcatgaagaataatagacgattgggtgtgacacgttatctattcgatattggtttggtatggacaaaattctcgacatatcattaattcaatgtgtaccttgaactgacatttagccaatttacatgtgagacatgtttcgatttatgctggcgtaatttgttcagcccccactactattttttcctggatccgcccctgtctacgcgcttctgcgcttccattttagcctcttgtatggacatgcaaccaccactttcacgagcaagtagtgaaacaccatttgtcaatttcccgtccatcgcctccctctgcagcaaataatttgcagcaaaacttcgtcaaaattaaccgctttcaatcaaggcagcggctaattactatttataaaagtaacaggtaagtacttttttttaaaaaaataacttttatatgtaatcagtgcattagaactttagcttgttgggtccagacatgggcagggagctagataagaatgtaattttctgataaaattgcttgctgttatttataaaaaaagatgcagtttattagatgagaatgtactctatcttctaataaaattttgaaaaatatgagagaaagtacctcaatgcctcgaatgtcattcaggagacggccgcaagtgcccaccagcctaaatatttcgttgtattcttgatgtttgattatgtcgtccgtgagctttactccgataaaaaacattcccgagatcactgtagctccatgcgtgagtgaggtcacaccacactccatgtattcttcgaactttggcacatattggctcctctgccattctgcctcagtctatcatacacctcaatatatctttttttaataataaaatataatatcccggcctctactcaaaaagagttacaactaattattacaaagtagcatctcaatatatctagccactgcaatttgaacatcaacttgttaatagcaacaacattgcaacaaaagaattcaagaaatcgcacattggagactcactgtttctagcaagtacttggtaatatcatggccttgtaatgcagaagcctttgcgccaatctcgtttactgtagtatagagagcctgaaacagtagttttacatcttcagagtatagaactcttgttgatgaggcttatcccacctatgacaaccatttgcacaacgaattagctcattgattgagaaagatcagacaagatacactggatcaaggaatgaggatttgtacgtacttctccattaatgctaggaggttttcttgttcttcttttgatcctccaacatcaaagaaatcgtcaacaacagatgtcaacaaagctgttttagaccacgagatgcgagcatcggacatttcaggaggggatatggaagcagcagcagagaaatagcaatatgttagcttctggcgtgcgtattgtagctgatctagtctgttgtctttcacccacctgtccttttttttttctttttgccaatttgtctaagttaaagccatataggagaagtaataatgaataattatggtaaaacaacaaaagaagaaacataagggagcataacttgacaactgtctgaacggattaattacctacctatcaagttacttaagttcgtcctggtaattggattgagaggtgcagaagtcatcagcagccaaagccaaagttccaaactgacatttcacggttgtctaatcttcaattgtgaatggggctcaaatttaaaactgatcactatattattattttaaaatgtctgcataacttgctaaaaatcatttaagcagtgtgacgcgtgttggcacaatccccttcgtgtgtgaaaatactactccctcagtcccataatacaagggattttgatattttacttgcattgcattgtttgaccactcgtcttattaaaaaaattgtgcaaatataaaaaacaaaaagttgtgcttaaagtaatttagataataaagtaagtaaaaaaaataaataataattctaaaattttttaataataagacgaatggttaaactgtgtaagcaaaatgtcaaaatcgcttatattaagggacggagggagtactccagtagtacagtagcagaaatgaccacctaaaaagacaaattaagtagctgaaataaagtagtggcctcttttcttcaccaaggaaatttggatgatacgaagtctattaattgtcctccctcgtgcttttcccgctagaaattagcatgatcggtctaggtctcgttgatacagtggttatttgctcgtgtcacactcacacaccagcaatagccaaaagctaccagagactgggagagaagaaatgtcgtgcacgctggttgtgctttttgcctacaccagcatacagtatagaatcattttcgtaaaattaaaatttgaaaacaagtactccctccgtttcgaaatgttcgacgccgttgactttttagcacatgtttg

SEQ ID NO: 73342 - DNA, 2447 bp, Oryza sativa
gtgcaaggggtgtatgcaattgaagtaggtgccaatagagtccccttgctactggtgtgggagtatttatactcctacccaccaaaactagtcattgggggcgaaatcccccaacttagtgtactaccggtctgaccggaagtgtgtggccggtcagaccatgctactctacaatggctagttttctaggcgttgtagccctgacattgggccccatttgcccggccggtcagaccacagtgggatggccggtcagaccggcctcggctcggtcagaccgccatcggctcggtttgaccaacctcggctctggtggctctggatcggccaccccagagcacaccacccagggcatatggccggccggtcagaccggccaacacccgccggtcagaccgctctaaggcgacggtcagaccggccatgacgctgcgggcagaccggctacaccggccgatcagaccggcacttgggcagcggtcagaccagccctggttacccagaccagtgacaacaggagatagacaatgaaattgagcacaagtctaaatgcaaacatgacctaatgtggcaatatgaatcatctctcattacccctcttaatagtacggtgaagctaaaattaaactagcaaatttgatcaccctacaccttgatcaattggaaattaaaacactagtttagcatctttttctcttcgctttacgccatcaaattttaatccatcggtagtcatccatgcgcacacataatgtgaacctaacttaaaatatatagctcagtagaatggttagtctacaattagtgcttgtcattaattaccaaaattaacaacaggggctgtcagggttacggataaggtataccctctattgttggatgtacgttgtatactgatacggtatacccgtacgtacacggatagttcctttatacgttaaggaaatccatcacgtgataggaacagaatccacagatggaaggagtcctactcggacgagactgggtctttaccatatcgtgaggagtccgatatctccgattcctacttggagatcaactgacccgcggtataaaaggaaccccctgggcatgacctaaatcatcgaatctcaccgccaacacatccaccacagcctacgaagccggtgcctacaggagccaagtcgccgggagatctagtcgaaccaactcgactacggtctcgtcggtatcatcgagttccgctattccctttgtaatctgtggtttccatcatataatcccatatcaactggattagggctattacctatcaaggggcctgaaccagtataatccttgtctttttgtttgcttgatgtcgtactacgtagatcctggtaccaacggaccctaataccctctatatccgctctacgggtatccaccgtcgacaggggcctatatgcttaggggggggaggagatgttgcggcagtgccaacatgcgatgattggagtttcgaagtggtccatattgattgcctggagttgatctgctcaagcatagaccacgcatgccggaggtggatgaaggacatatattttcttttagaaagaatgatgctttgtttaacacgtcaagaaaattgaaaattccatatgtatctgtaaatttttacctaatccttgctatatcccttaattctcctcattcctttatatacttctgaattttagtttggacctttcatactctttttgttagtgttagttgatcgttaaattcctataataagttcattttgccatttggtagaaaagcataaaaatttataagttttattattgaagggtaaaaatttatttcatggggctattatatttaagagtttgttatgtgaaattatgatagaatttctttgtagatatcacaaaaagttaatatttgtttattagttattgaaaattgtttatgtatagtataaatagatttgtcatatacagaaacatgttgtactcttaaaaaatattttacatgtacaatttttaataattaaataaccattaatttttatatcatatataaaaataagtttttatcgtaaataatatatcgcataactcataaatataaaagtctcatagaacaaatttatatacttcaataatatactctgtaaatttatatgtatttttcataagaaataaacgatcaactaatggaaaatacatggaagtgatccaaattaaaattcgggttatacaaggaaatgagcaaaacttagggatatagaagatacatggaagtgaaccaaattaaaattcgggttatacaaggaaatgagcaaaacttagggatatagaagggattgaacatagtttaagaggtacacatgtacatatggagttttctcaaaatctatatagttttgtacagttcgacgcatcatataatgaatagtttggatttcttcgaatttaata

SEQ ID NO: 73343 - DNA, 566 bp, Oryza sativa
  unsure (1)..(566): unsure at all n locations
agtccccggggagcatcgtcggggtagcggcgcctgtccatgtaccagaacaggtagccaccattgacggcaagggcggtccgccatcgggtgatggggtgtggaggatcaacggcggtctccctcaccggcgccgggctcgccgacggtgagcacctccatccccatggagacgggaggatccatggagggggagcggtagaaggaccgaaccaccttgtacctgccggtaccaggatccagccccagccctgcggtgtggctgtggccatggccgtcaggcaacgtgatggcttctcttgttgccgggttgaagaggtagagcttggtgatagtcggggcgagcactaggccatcaccaagnttgggggggtgggggttttggtaagggtttgggggggggccccttttggggggaaaattttttttaaaaaaaaaaaagggccccccgggggggggggaaaaaaaaacccctttgtggcgcagggaagtcttggatccatgatcctcgcaagggaggaggcaccttgctcccactggtagaagctgatgtgggtggaaaattt

SEQ ID NO: 73344 - DNA, 8400 bp, Oryza sativa
atgttataaaatgtgtgatccacgaaaaaactcttgtcacctaggatctaaagctaacatatactaatctgtcaaaaaaaaaagagaaaccttatgtctaggttcgtagctaggataggattggggttttttttatagagggggtatgctgcaaatgcataacatttttttatttcttatttcttatgatctaaggttacccttagcaatatttcctttttaactactttctcaataaaggtgaaacaaatatattattttattgttattttacgtgtcacattgagcgtcagcggaacaggagcgacgatcaatgagcaagtataatagggactataagaaggctgaatgctaaggtggatgagagaggagagagagatgagaagtaggccgtaagtttacagccggtttaggcataggaaccaagaaaatttgtgacagacatgtggaccatatatttataatgaagagttaaccactacatgaataaactgagagatagactatatacaataaacaactgcttagggttcacaattccgatgaaaaccagttgaattccgtgaaattttgacgtttcgacacggctcggaattaagtttcgattggaattttgaaggttaaacagtagattttgtcaaaattcagttgaaaattatcaaaaattgatcaaaatttatcaaaaactgtgataccgatggggcttaaaatttagtgatcaactgataatataaaccttgactggctgtattattaaaatttagtgatcaactgctaattgaccttggaagaacctacaaaacccgcccccaaaaccttcccgtggctcgagccgaatattagtagggctttcttcatttccgcctccattgatttcaaacgaaaaccgccgactgcctcccctcccttcccctctccgtcgtgcccccttccggccttcccccaatggcgtcgggctcctctcgagccaacatcgaccaggtaaaccctaacgccggcgattctctcctccccatctctctctcccctcaccaccacctccaagcattaacgcactcctcgatccgcctctccgcagttcttcccggccaagaaggggagggcctcgtcgcgcaaggacgagccgccgtccgggagcccgaggggcgccaaggggtccctggaggggtaccttgtccgttccccttcaaccgcggcggcggcctcgttggactcgccgaggggtggtggggacgcggcgggcgccaggaggagcctctccgcggcgatggatgtcgatgtcggccatcccgccacggcggtggcgacagatgagggggattttgagctgaagaggtttgcgatggagttcttgtcattgtcccattactgcaggtatgcgattcttgtgcaagatgaggggttccttttttcctttctgtttaagaaccggtcttgtgcgaagttcaggttgtaattgttgttgcagtgttatcccttctgtcatgggtggtgctagcaatggcgaagcgggcaagcagcagaagaggagtgcgatccagtcgttcttggctccttgtagcaatgcatctgccaagaagcagcgcgttgctcactctggggacttggaagctctaaaggttgttgtgtgtgtgtatgttgggggggggggggggtgcatacaagattcatccgttttggcgattttctatgaaaagtgatacataagttgcaacttacatttggatgtattgcaggatgtaggtcataaaacccccttccgggaaaaatgtggcactcaatacggtggcccagaggctttggaggtttggttgatataagaaaatattgagtctaaaattgttttggaaattctcatattgttttttttttctttatggaattctgatggtgtccttaccatcaggaattaggtgaggggacaaagctgagcagtgagggttttgtggctttgcaacgatgtagctttaccccaaatactggacagaaaagggttggattttcaacagcaccaggggctggggaaacaccgatgtctgtatccacgaactctctgatttcacccggggaggaattctggaatgcagcaattgaatttgctgatggcatttctgctcgggctgagaagggtcctggaaggcctgagtgtgatgtggatgacaagtcatcctgtgcagttgcattgtgctctaagattcttcccagatccggaaatggtggttctgaccatgaaaacacagtaggaagcaatgagacaaagcaaatggacagatcttcatataaagaagaaccagtggcagcaaataatcatcatgtaaacagctctccgttgcctgtgaagcatttggacttttttcatgaggatgaaattcaagttccaggcctgaaaattgaagaaaaaggtggtgctgtagatctgagtcaaaagagtcaaatgaagaacagagaaaatctcacgcattctgtagataacgtgaataaaagtacttttgacatgcacatagattcttcagctacgattcatgatgagtgtctgtccaagttaacaacagaagggaaaaatcatccaacaagagtgggtgacagtggttcttgtctgactagaagagacctcaatcaactgatctatagtgaggataagctgcttactgcgtattcagatcatggcaagcctagcaaagattgtacaaataaatttgcatcccaagaaatggaagccaacactcctactagttctgttccccaaaaggaccactcaaagctgtcaagttggcttccccctgagctctgtgctatatacatgaaaaagggtattccagagctgtatccttggcaggttagttttttcagtttttgctcatgtccaatgtcgtgcttttgctagtcatctgtcgccagcagaataaaacattgctctaaagcacaactgtgcaagttaaaaaatttgtatttgctgctattctcacaaaatatgactatatgctactacctccgtcccaaaatataagaagtttcggggttggacatgggtattaagaaagtaggtgaaattaaatgggggtttgttgtgattgattgagaagaggaagtaggtggagaaattaaaaggtggaaggttgtgattggttgagaaaacaatgtaggtgcaggagttgttatattttgggatggagggaatatttcatttatgctagtaaagtaataaatatattctactcaccagattgaattaataacaaatcctaagaacctgttccaacttgtaagtacttgtgtcctgtcaaactactccatatttcctaaacattctgtgaattaagggtatgcatgccaaaaagctacttctcttctttatttgaagggatccacgcagaaaagtccaagctactatcttatcatatgtctaccacttccatttgtacttagcaacgcgtggacctggctttctacaatctgctttctgaggcaaaccactcaatttctctttaatttatctatttcactgacctgatgttacttgactatcttagtttttgccaaagctaagtgtttccacatttgtcttctattttttcaaagaagtataattgttctccatcattttcttgtagaacatatctgaacatcataagcaattaaagatgttgccttgattacaaactcagtttaaaagtaaccctcacatactgtctgtttcaagtgcttctccacagaggcatgctcaattgtattccttatccatagggttatgttcccatgtctactgcaggtggaatgtttacttgtggaaggtgtcttggagaaacgcaatcttgtttattgtgcatctacaaggtactgggagatcttgcactcttccctgttgattgataatctcagtatccccatgattcagccctttttgtataagttatttttaaacttgtttcttttgtttgaaatgcatacttctccagataccaccttcgagtttttattagtatattcataaaaataattcctatttcatatattacagtgctggtaaaagttttgttgctgaaattctaatgttgagacggatattgttcagtggaaagatggcaatccttgtacttccctatgtgtcaatatgtgctgaaaaggttctgccatattttactaagcttaccttttgaatgtttcagcatgcttgtattgggttgtataactagtattttttttaggctgaacatcttgagcaacttcttgagccgctaggcagacatgttcgaagcttctatggaaatcaggggggagggtcacttcctaaggatacatcagttgctgtatgtaccatagagaaggccaattctttggtaaacaagttgttggaggaaggccgtctttctgaacttggcataatagtaatagatgagcttcatatggtaagttaaaccaatttggtcctcaaaatttctccattttctttactttcaagatgttgcatcggcttcttgcttatgtttactttagagagatcatgggcatgggtcccattcatggcggatactcaaacacagtatcttccgctgacataacctattcccatgacaaatttctaacgtgtattgggatttaacttttatttcacctaataggcatctgtacacttaagagatacatacatagtgacattaagtgcatggatgtaatcatatctaagtaattcagaaattacatagctatttgacatgatcttcaacattttcaagctaaccattgacaagacatatagataagagatttatactagttgatcttagtcttatagaattagtacttattgttctgaaaatcagtttatcttaatgacagtatttgttgttgttccatgtaaaatggttttgaaaaatgggaaattggtttggtaccaacaaaatattacccttttaggtttgtacactgatatttttggttcacttccattaccttatttgaaatttctgtgctctctttgcgagaggaacacttgtaaaatgcctgacttactactgtatgttcctattacctgttgccacttggccagctgatgctggcgagtgaagtgatatagattcatgagagagagatacagaggggaaaattgccatgataagagcaaattgggcaaatttgagagcgctgaagtaggtaaagcgatttaggtgggatggaaaattcaggtggtataaaactaaacaaatcaaaatttggtggtatgaaaaattaccttttcatttgaaaaacataattctgccatccaatatattgtaaatgcggtacttccagaggacatgccaatgtagtgtacatacaatataatacattgtatttttggcctatactcaatattttcaagtttgaaagttcttgagcaaactgcgaaatgaatctcttcacattacaatatttgaagtactaacagtgtgcatgtgcattacaaccgaagttggtcttcattatattggaacatattggtgtacttttttttttttaaaagagaagatgagtttaccataacatattggtcaatgcttttgattagggaccagtctagcatttctcgttgctttccccattttttttgaaaaattcaatgccaaaaatataacaaaataaaagtgtttcgagaagcatttgttatgtcaagaatattgtgtctctgagtcccaagtcctgacctattcctgtttacctttcccctcatgcaatttgaagttcttttcttcttcctttggaagtcctttggatgttgaagaacatgcaatttttgagtgaatcgcacattgtgccacctattattaccaaagtttcactttgtaccaccacctgagcaatgcctttacttcagactaggttagatatcatttccattgcactttggaccacctcttcctcttcacccctctcagcctttcttctctccaaaactttggctcatcaacatcactacaaagagaagagaggaggaggatattgactgacaggatcaaattcagccactggcagtgccatgagttgaccaattgacagcgtgaggaggcggtctggtttgactagttcggccaacacaagcttgtccacggtacctctattagcagagccctgccactgtgcccctttgtcaatccctactgctatccgctgcactgttagacacagagttccagatggtggggagaagatactgagtaagatagaaagggagggtggaccgaagtgcaacaaatggaaatattacctggacaaaaaaaaatgcttaaatgatggtccaagtgaaactttggtaataataggtggcctaatattttatatacatgcatatttcatttttaacatgcaattttgtgtttataggttggtgaccaacaccgaggatatcttttggagctgatgctgacaaagcttaggtatgcagctggtgaagggaattcagaatcatcaagtggagaaatctcaggttctagcagtgggaagatggatgcaactcatggattgcagattattggtatgagtgctactatgcccaatgttgcagctgtagctgattggcttcaagtaagagaacttctgtaatttttgttcatactattatctgtttttttaagaaatgctgttatctaccataaacatgcttgcagtgtaatatcttacggtcattcaccatcattttgacaagaataatgtattatttaaccaaactgtctaatgaaatacagtagtaagtagtaacaagttatgtatgctgatttgctgaacttcaaagtttcacatgtatattttttgtgagttgattttccttttaatgataacaccaccatacttttgattattatgctgaaatgaaatagtgtactgtgctgaatgtacaagtagaaaggatgctgggaaccattgcattacagtgaggattctactgaattagctttttttttttccgagaaaaccataaaatttagcctgtcctgaggttccttgtagtgtctccacaaggtggtggagggctggacaaacactgtgtgcatcattttgacagttatgtcttaagggcctaattagaggcatctaaactacaaatgactgatgcaaccaatctgatttttatgctgcagaaggacgaagaatttactgctcaagtatttcactgaaaataatgtggaactgtgcgatgctctatagtgttactatatttgacaaacagtattagacatgctctataggctttcaacagtatttgacaaacatatttacagtggtacgggacattgacataggtgttagagtatgacttggattcgagtatctgattcagcaaatttggagaaaaaggattcgaagattcgtataatacatattttataaacatattatataatataaaatattaacatgtaaaatagtcggtcaaacacttaaaatacttttaataccagtgttccaaggagtattgtggacataagatccctttcctatgtctgttgtgcatggaagcttcgcttgtatgctcattggcttataagccacaggccacagccagaatttgaattttattagaacttaatttcagaattgattttgtagtttaattgttttctatttttcagccttggcttttggaccaataagaatagagtataaaagtcttaccctatttttttattactttgtttattttctaagcagtacctcaaaaggtgcaggctgcatgctctctctccagcctcctgcaatcctggaaaagctgcaacctttccgcctcttctttgtgcgcacgcacacactctctctcttcacttgctttacctcttaccgcaacttcgttcctctattatcagcagctgcaagcctgcaactctcctctctttcctttggactctgtcagatgggtgccgtcccacgtctaacatgcgttgacgcacgcgtgtcaacatggtaaaagaaaaaaaaaagggacttgcgagtcccagtaacactgcatatttatcaataacaactgtcatgaatattgctataaatatatctaagagaatttcacaaaattgcaattattttgtcaaaactatcactttgttacaattttacatgggtatttcacaaaactgcaacaatagtgaacgatttatcacaaaacaacaactttacctcctatgtgtgtatggcatttgggcccgacttacaccatcataagtattgcatgtgcgtatgacaggtaggctcaaactttgtgagaaataaagttgcagctttctggtaaaatcatacactttgaaatgtctagctgaaattgcagtaaattgataattttgacaaaatagttgcagttatctgaaatttactctattatatgaaatctgcaaactgaccttcaaataccagcttgagtctcaatgcatgatagaa

SEQ ID NO: 73345 - DNA, 763 bp, Oryza sativa
gaccatgtggatgtgggtggatgcaagattcaagacaagcatgaatctctctctttattactgcaccggccggtgttgtcgatcttgctagccaccgatttcactgctcaatacacaatgccacagctagcagctactgttgggtgtaatggcatacttaacgcagtcgatccaccaagctcacatacgcaggacattttttttactctttgaatttactgaaacagccagtacaccaagtacactctgtttttttttatttgacactgttgactagtataattttaattttggtcaataatattttttttctgaattacgatgttttgataaatacaagtagtagtatatccagttctttagcatgcaaattgccaaattacatagataatgatatgttttcaaatgttcgtatttttttaaaaaaaagaagatgagcagtcaaagtctgtacttgcatagtacgtactatctgttgtcaaacaaacaaagatgaacggggggagtaaataggtacaaaatcacaaacattttcccgcgtttcatattatttgaggtagaaatgcattcatgtgtaccgtgcagtgaaaatggcctcgtcgtggtaccgaatcaattcaacgattttgatcttgggtttttttttttttttgggaacgcgtggtgtgtgtgcaggggctgtacggacagggggaaaggcggatcgcagtcccgtagctgccgcagatggggtgcctcccggcgtcggtgacgctgttcggcg

SEQ ID NO: 73346 - DNA, 10205 bp, Oryza sativa
agaaatcgctctgcctggtgtaaactattggacgatccaacctcataatgatattttcttactcactgccatgcatgcatggggttagtagcacttttttcacccatgcacatttatctctttatctttaaatgatctttactcacaagttgcatggggaactaatacgagcacatggacatgcggaggagcgcaacgaacacgtgaggggtttgggagagcgatgcggacgcgtgaggacacatgggcgtggttagtggcggcaatgagtcgttattaactcatcataatctatcccgtttagcgggataccgtggtctagtagtactcctcccttgactataattaatattccgtatccatttactcaacatcgatcaagccggcacgaaatgcatcaacatcgaacaccgaaacatacatacgcaagtctcgggcacacatgcgaatttatcagccaagatgttcccgtgtgtcatgtcactactggagaaccccacatctctcccggttcacaacccctttactcccatgtagcgaaccgggagggagaatccgggactaaagatgacgatttttagtcccggttaaaatatccgggactaaagaaccatcttgagtccaccgggtgtaaaaataaaagtgtcacgtgacgcgttttgttttgagtaaattgcatcctgggccacttttattgaccattgttgcaagttggactagaggtaggacattcttttcagtttgaaccagaaatctttgcaaaaattttcatattgaaccagtcttcttcttcctctagatctccccctcttctcttctcttccctgttttggttcgagctcaccacacttcctcaggttccatctacatgcttgacctacgtcagcgcctgagcttgagtgtgtggtagtctccgtcttgagctcaacacggcacacggcagagctccagcttgagctcaagcacatagccaatgaatcacggtggcacggtgggaaattctaacacgatatattatcactccacacttctgctccaccaactagtcaataggtcccattctagcccaagttcatccatggcagcactagcttaattggagctagggcacttaatcaacgctgcacattaaatcttgagcacgaatgaatgtggcaggggcagcgaaggctgagtagagctcgagcatgactgtactggtggagcttgagctctatctctactaaaaccaactagccaggtatgtgaatctcaaactgaaggtagagagagtgaggaagcagagttggaagaagaacactaggtcctaagtgtaacattttgtaaaaattattagcccaaagtgaaaataatagcttgttcctagtccaagctgcgaccatggtaaagaaagccggtccaatatgcaattaactcttcttctttttttcttttcttttcttttttattttttttgctactttcatattgatttcgcaccgaactcaaccacacagacaaaaacatcaatcacacagacaaaatcatcagcaaattgacatcacatattcatctgcaacttcatagaaacatctagaaatcatccacaaatttacatcccaaaatcatccacagattcaaaaaacatgtaaaaatcacctacaaatttacatcacaaaattatccccaaaatcatccccaaaatcatcgtcaagtcgtcgcctccggattgcccgctgcttgccacctctcctccgtgtgcgccaccgccggccacatcctcccggcgcgcccgcctcctcccctcccaccgccacctcctcccggttgcccaccgcatccaccgcctcgccgtcgccgctcggggccgccacctccctccaccgccgcgtgggccgtcactgccgccgctgctgctgctcgctcccgccctccacggctttggcgctccgccgcgcaccaccgtccgccgccgcctgccaccgcgtgcccaacgccaagaaagaagagaggaaggagagaaaatcgagaggagaggggaagggcgctagtaagaagcgctaagggatgagaagggataagaagcgtagggataagaagagagtggagaggcaccggttaccgaggagatagcacgaggggagatgtgcgggctgcagtttttcttttgaattttggtccaacaaccgggactaaagatagcagggggtctgatacggcctaaccaccttttgaaccatgactaaaattcataaagtatcgtgccggtttagaaccggggttaaagatctttttagttccggttcctattcgaaccggggttaatgtgatttttgtctaacctagcaaagatggtttctcaagtagtgtgttagtcccgtaaggtagaaagaacaaagacaatgcttgttttaattagtaaagctaggaaataaatatattcaacagctgcaaattaattaatacaatatattcctgcatgccctgtataaatgcggaggcccgcaggcacgaacgcggcaaccaagaacgtacaccagccagcaggaaattaaatagtcatcgaccaatggagaagctgaagagcgagctatggatgacagcggtggccacctgcatgtcgctcttgttgtacctcaccatcctgagacggcgccacgcgagcggcggcagatcactagcattgccgccggggccaacgccactcccgctcatcggcaacctactctgccttggcggcatcttccaccaaaccctcgcgaaactggcgcgcgtccatggccctgtcatgacgctgaagctaggcctcaccacggccgtggtcgtgtcgtcggccgaggccgcgagggaggcctacacgaagcacgaccagcggctcgccgcgcggccggtcccggacgccttccgcgcgaacggcttctccgagcggtccatcgtgttctcgccgagctccgatccgcagtggaagaacctgcggggcatccacgcgacgcacatcttctcccctagagccctcgcggcgctgcgcggcatccgcgagcgcaaggtgcgggatatcgtcggctacatccgcacggtcgccggggaggagatgtgtgtccgcgaggtcgtgcacaacggcgtgctcaacctcatatccacctccttcttctccatggacatggctgacgtgcgctcggagtcggcgcgcgggctacgcgggctgatagaggacatcatcgcaaccgtcgcgggccccaacgtgtccgactttttccctttcctccgccagctctacttgcagggcttgcgtcgacaaacggcagccatctaggcatcgttttcgggttgttggacgacataatcgatcgccgcatggccgaaacccgtgaccaccctgacaagcagcggcacggcgacttcctggacgcgctcatcagcctcgcctccgccggcaagatcccacgctaccacatcacgtaccttctgttcgacgtctttgcggctggcgccgacacgatgacgaccaccgtggagtgggcgatggccgagctgcttcgcaatccccgcgtgatggccaaggtgcgggcggaggtgacggacgcgctcggcggcagggagagcttcgacgagggcgacgcggcgagcctcacgtacctccagtgcgtgttcaaggaggcgatgcggctgcaccccgtgggctcgatactggtccctcacctggcggtgcaggacggcgtcgagatcggtggctacgccgtgcccaagggcaccacggtgatcttcaacgcgtgggcgatcatgcgcgacccggcggcgtgggagagccccgaccaattcctaccggagcgcttcttgcacaaggaggagtcctcatcacctccgctggaattgcgagggaaagactacgagtacatcccgttcgggtccggcaggaggttgtgccccggcctgccactggcagagcgcgccgtgcccttcatactggcgtccctgctgcacgcgttcgagtggcggcttccggacggcatgtcgcctgatgacatggacatgactgagaagtttgccactgctaacgtgcttgctacccctttgaaggctgtgccagtcgcgtcacacactagttagggtgtggaggaaagtttggttgaaattggaacgatatgatgaaaaagttggaagtttgtgtgtgtaggaaagcattgatgtgatgaaaaagttggaagtttgaagaaaaagtttgaaactaaactcggccttatacttatatatgtgtgtgtgggcgcgcgcgcgcactacgacgtaggaggcctcataagtgctccatgcctcattgtttcaggcgtctccatggttcccacctttgtatccttaaaagttataagtttatacttggaaatcaattgacaccaactttatttaattgttgtttgagttatcactataaaaaacgatttttcatgatagccaaaataggttttcacaagcggctaatggcaccaccagagatcaaagggtagtgataatatggtatttgcgctggtggttttcgtaaggtagctgcctgcgaaaatgaatttgcacaggcggctacgttgtatcatctacctgcatcaatatactggccatggctaaaaaaatttgatggagcgacggcgctccgtccacctccgtcagcacatgttgaagtttttcccaaatccacagaaattatttccaaatccatgcgttggtcccaaaatccacaaaaattattcccaaattccaaagttaacaaatcattacaatttaaatacatctcaatttacagtcacaactttccattcacaagtttccaactggagcaatccctacaaacaaacaaaccggcactacaagaatctatttaatctatgataaaaaaattcgtcatggatcactgaagattcgtcacagaaatttatctgtgacgattctacttatcgtcatctattgagcgtaatagattaaatctatcgacgttttctccaaaattgtcacggatcaacacaatctatgacgttttttaaccgtcataaaacgcttttggactcatgtagtccaccccaagcccaacctttatgatgaaattaaacgtcacagatggttgccacaaggcagccaatatggcaggtgacatggtcattgacatgtgtgtgatgacgtgtcactaataacatggcagctaatgttagcaaatatttttaaacggcccattattttttaaaacggcccattattattttgacggcccattaattttttaatggcagcccattatttttttttcagaactggcctattttaaaataggcccatttcagaaccaggcttatttcaaaactggcctattttgttaacaaactatcagatcaaagcccactaaacaagcccattaagtttgagccaagcaaattcaatccaatttctcataccatctcagattcaaaactaataacagataccatctcaggtttaactaataatagatacaatcagaatacaacagaattcaaacaattaatagttcatctcagattcaacctaataacatatagtctcagatactctgctccagaatcaaacaatagttccacagcaagcaacaaaaatttgtgtagcagaacaaagctatcaacttgtccaagttcaagaatcacacaacattcaagcatacccagttttggttcaacaaacacctgaaaacacttgcagcaccaaaaaaatcgaaggtccaggttcaggttccctccacaccggcaggacctgcaccaaaaagggttgccattgttgttctattagtttctcttgataaatcagcagttgcattagcagccgcgctagcactaggattgctagatgcacatgcactagtactgaggggtaagaaagaagtcaaaagttatggtgaaaaactattgcatgcttattctgatgctacatgtgctaagttgtagctagtaaaaatcttgcaagctgaataagacaaataattagggattcctgttcctgttcttcaacaactaggattaaattaggggtgtgcatgtacagtagaggtgtcttccaacattaatttaagttttattctacctcaatggtttagcttgggagagaaaggaaattaaaatgaagtccaattggcagtataaattggtagagtttaattcgtgtatgacaaactacatgacaactagacactagtgtattttgttcatttatatgctaaaactaagattttgctaatgaggatcttgcaaggtgaataagatactactttgagattttgagaaaaacaaagtatgcattagtattgattattcaatcctccaaggataaaataactaacagaagtagatggtcaaaattttcacttgaccaacaaatatagatagatgagataccttgaaatcatggagcaaaggtttcatccatatagaaatatcagcatttgagattatagccatgatctgttaaataaggtagactacagttagcaatgtaggtgactgtaaagggtttctacataaaaaaagaaaatgttttggagcattgacatatcctatcattggtgcttttgattaattagcttgaagaactaaaatgacaaagagacactaagcttgttttcttcatttatatgctttactaagctgtagttaattaataaggatcttgaaagctgaattagaaagtagtttgacatgacaagaaaaactatgtatgcattagtattgaatccttccaataataaataactagtacaagtagatggtcaaaatttacacttgaactatctatggagagagaatatctaaaatgggtacaaatcatttaacttagtttatggttaaatttacgcgtcaactgtatatatagatggaagatctaaaatgggtgcaaaatcagctaaaagaactaatattgtcagttttcacacatgctaaaagaaaatacatcacaaattctaaaaaaattacatcacaaatacatcacagatcaaacaacatagatccaatgaatcacaagttcttaaaaacacaaagaaatccccaaatcaagtcctccgcttgccgcgggccgccgcctcccgctcgcagcccaccgcccgccacctcccgctcgctgcacaccgcccgccgcccgccgcctcctcctaccgcgggccgccatcgcctccccagcccggcggccgccgccccttctcccgtcgactccgctgcagaagatagtgtctggttcgatccatttaagacgtgggagggagatatttagtcccggttggtgatatcaaccgggactaaagatcctcggcgccctgacatcgtctgacacaaatagaaccgggactaaaaatgattaccaaccgagacttaagatcatagagtccccatgtactgcttaaaccggtttctagtcctggtttctccagtagtggaacaaggcggcatggctgttggcccatggcacaagttaattgagtttttgctaccacgaatgatactaggcaaagaatggccaatgcaattaattcaattttttttacatcaagagaatagatcaaacagaacaaattaaagaaacagaacaaattaaagggtatatgtcataattacaccctaattacactacatttacagcctacttacataatgtaagtagggtgtaactatagtgtaattactaaagtagaattggaatgagtacccaacatcttttatattgatgtgcatgcaagttaatggttcacagtgataggttaagccttactagtggaaaaaaaattgactaatttttagtctaaaatgtgtctgacatttagatagatactcccttttaaattgatgtgcacattaatggttcactgtgataggttaagcctaactactaccgtagtggaaaaaaaaactgaataatttttagtctaaaatgtgtctgacattttactccccaaaacaatactactattcgacttcacgatccctttgccggtaccacctcgctagcgacatggtactgctcagtactaccaattctgagccgtctgatctacaccaacagacgatcgggattaatttggaacctagccctgctccatcataatagcgtatggacacaggactgatgagcatcgtctttctaccgccacccgcgcctggttgccgtcctcgatcgtctgctccgtcaaccacggaaactcttacggttggatgtacaggttccgttcaagttacatccataaatacatcacaagtatatcgttttcgtttatatatatgacagcaagtttaatcaattgtattttgggcatgtctgactgaagagctatgtttatatatcagccacactcttagctgcacctgcatgtggcaggtcaaatttgaacgaaacagacaacatacagacacagacaattaaaatgatagtagacgctgttaatgttattaaatatgtttgatcgttcgtcttattaaaaaagttaagtagttattaatttttttccagtcatttgatttattgttaaatatacttatatgtatacgtatagttttacatatttcacaaaaatttttaataaaatgaacggtcaaacatgtgctaaaaaattaacggtgtcaaatatttagaaacggagggagtaatatacaagaccggacagataaattctcccgctaccctgtacgcacgcttagaccttgtttagttcccaaaacaaaaacttttcacctattccatcgaatgtttggacacatgcatggagtattaaatgtggaaaaaaaaactaacacagtttgcgtgtaaattgcgagacgaatcttttaagcctaattgcgccatgatttaacaatgtggtgctacagtaaatatttgctaatgactgattaattaattaggcttaataaatttgtctcgcagttttctggcggaatttgtaatttgttttatcattagactatgtttaataccttaaatgtgtgtttgtatatccggtgtgataaccaaacctaaaatttttccccaactaaataaggccttataaacacaactggaactttgagcgagcgatgtttttataaaaggaactttcatgtaatttttgtactagttgagcacaaggggggtggggaactgttttttgagcaattaatctttctagatatcaaagggctcaggacaaaaccactgtataaatcggaagcatatatgcttgattcactgaaactctgaagggccgtaggggacatcagcagttgaagggctgtataaacttttggatatacgacgatacatttaacaaaatttgggtgtaatttcaaaattttaggacttatgtactgtcagtgtaatttactgattttttttttgcgttgactttggacttgtagtctttattttgttatgatatatagcaaaggaaccatctcaccagattaacaacttgtcaaaagtagggtcccgtgttacttaatcatgatgtgatgccacaaacccttcacagtactgttttgcattaatacaaacggggggatgccggtctgcctgatcaggctctcgatctcagccgcctctctggtttacagtggttgcttccctttactcaccggggagcaacatataaggaaggtgaacacactcgctagttccatgcgtgttgccctcttaatttgatgcaggcagaaagctgatcaacgataagctgctagttcttccctcttggaatctcttcctcctgccccccttggtctgctacgttttgcttctccagcgtacgtcctgcctctcgtctgtacaaggtgggtttctttctccgatgaatctataaacagacgaccccctttaaacatctgtgtccttttagtgctctacactttgcttctaacactaccgtttgtgttctcatacacagtggcgaagatcaatattaatagtaaaagaggccaaatagtcaccgctgataataatcaatacgtaaagtagggtttttattaaaaaaacttgaatttcagctcttaatttggaactagtctttatttctaaatcatttccatataaactatggacgtatgaaaacaaagtggcatttatctgtgttacttctctgatctctgtcattaatcaattttgtagaacctgtttttttgttaatgggctaatgttttctagacttgctaactgcctggccttgcccatagaatcatacagcaacaggggcttgggggggggggggg

SEQ ID NO: 73347 - DNA, 1020 bp, Oryza sativa
aaaagccggatggcatctccaaggtcaagtgcttcacctacacggtcgaataattttcagaatatacatatgaaaaatacagagtggcatacttgggtaaatctaaaaccacctcacctttcttagcacaattgaggacgtaatcaacactgacttgatctatatccacatcatccaaagagatcgcaccaggaggcattacaactttcttgatcaagttaccagaaagcatgtagttgagcaatacatgacggtcacggcgataacgttgcatcagctcaacaacattttctctggttaagttgatatatagaaaaagcttagctcacaattgaacatgcatatactgatctataatacctattctgaaacgatcattactcgtccatatcgtgtgcaggggagacagcaatctgagttcagaaacactgttggaagcaccccaagtcgctttcagccagcatcgctctcctgcaaaacaaaaggggttaactacatgaaaaagtgctggggtgcgtaaatcggttggggctgaacagtttatgttgaaaatagctagtgaatcatgaatctgatcctacaatcggtccattttgcctgtacaaattcacaaactctcgctattaaaaaggaaatggaaatgacagccatgcagtggccaactgatgattcattcaagaatgcacaaactgagatgatccatgcctcctctcagaccggccaactcaacctccctactaaatcacatccgacatccaccagtgacagaactgagatcgcattggcccgcagctcccaaatcatacatacccgatccatccatccaaaccgaattcgccacaccacagcgcccccgcatttcaaacaccgcaaaaaccacaccaccgcaacccaaaaacaagtcgagccgaaacgaagaggaagcgcatatccaagcagctccgcccaccaccaccaccaccaccatccaaggccggagggcgagggcgagggcgagcggctcgggggctgggtggatct

SEQ ID NO: 73348 - DNA, 741 bp, Oryza sativa
tgtgtttacctcatcaaaccgttcattaagctctggaagttgtctatcaatgacacttagaaacatgtcaacatggaagcgatgcatattcttgatttaaataaagaacctcctatctcttccaaccggccgatagaaagagtccatatcagggatcttgatcttatgcttcacacaaaaagattgcacttcttgaagaaaatcatcccatccaggatcctcgcgtaattgctgcaattgaaactttgtcaataaaatcagtcctactgcattaacaatgtcttgatccctcttctgcaaagcatgattcaagtcagatgtgaacccaagtactgtttgcatcaagtgtgccataaaaacaaactcaaatgattggaatattgtcaacactgtttgtgcatttgcacattctgcaccaaaagagcgttgacaaaataggagtgatcaaactaaaacaatgcaaagtaaaaaattgccccgcattatgaaacgaagggagtaaaataaattaataatagagcattcaaataaatagccttgtcatttgcaggagtacttgtagtgataaacagagggggggaaatacaagcagtgcatacaaactgattctcatgggataaaaagtagcaagaccgaagaagctaagcagcggtaattctaacgagagactcggtgtagggcatcaaggtgaagtcgacgacactcttccatctcgctggcctaccaccctgatacgggctg

SEQ ID NO: 73349 - DNA, 5333 bp, Oryza sativa
ttataataagttttatattataagtcgcttgattttttttctagtcaaactttattaagtttgaccaagtttattgaaaaatttagcaacatctaaaatattaagttagttctattaaatctaataaaaattaatatattttgtataatgtatttgttttgggttgaaaatactactatatttttctataaatttggttaaacttaaaagaaatttgactaggaaaaaagtcaaatgacttataatataaaacggaggaagtatttgagagtacagttgtcgaagctgttatactagacagataaattttattgtctatcacaatcctttctattgcaaagagatatctcacacatttcctttgctttccccaggagcagcaggtgttgagaagagcctgggattagggaggaatgcgggaagccagcaaggcatggtacatggcccatttttttagggagtatctaaaaaaccaccgcaagttttttaagggaaaaactttcaaatctaactatagtataattgtaatataattccactataactataatataacttgtatgtcagtattaaaataatatatgcaactttatatctaacttatatagagattataatgtagttacagtgtaactacactgtagttacaatgttactataatgtaatcacattgtagttatactacaactatactatagttgcaattgaatgttttttttttgcctaaaaatcttgcgacagttttttagcaattcctttttttattatagagtaattcattaaaagaaactcttggcctccgtactgactagtgattagccagagatgtgcacaaccaaaatactgccaaaattagtagaaaaaccacaacaacatgacaaaagatgaaaatgcattttgaaagatatatgaaaaaagaatacatgaaggccatctatgcaaatgaggcactctccaagagactgcgatagtaccctcccaaagaaaacatcatatatatgtttaccaatattgtcctatcaaaaagttaggttttcaccacaacaatttcaatacaacacctttaacaagggatagataaacgttggccaccaaggcaccaacgactgcatcctattaaagctttaaaaaaccagactcgattagttgtgactatcaacagatttagggtagatcaaacagcagcgtgctcataccatgtcgcagctgagtattataactaaacctcatgcattgctttgtgaaacatatccatggttgagtttattattccgatgggatatgcagcataagaatgaactgcatgacaagataaggaagcagcttagggatgtccaattacaaccatcttcatacgacactgcatgggtggccatggtgccagtgcagggctctcatcaaactccacgctttccgcaatctattgagtggatactgcaaaaccaatatgatgatggatcttggggtacaaacctgccaggtttggtagtcaacaaagacattcttttgtgtacattggcatgtgttgttgcactgaaaagatggaatactggccgagatcacatcagcagaggtacaaaatcaataattgcattcatgagggtgttgttttaaccttgtctagatctttgtactgtagggtgaaaccttcttatatagctacgaaaaatggttttggcaggactgaattttattggaagaaatttctcagttgccatggatgagcaaactgttgctcctgtgggtttcaacattaccttttctggcttgcttagccttgccactagaacgggtttggaattgcctgttatgcaaacggatattgatgggattattcacattcggaagatcgaattggaaaggttagtccattgcaaaatccaagtgtgaatatttgtatttatttgttatttttagctttgtatttacgtgtcaactaatattggcggtgacacagcgaggcatgtagggcgtgttcaagtagaaatacttttctaccctttctcattagcttatgaactaatttggtacactagagttcgatgaagatagctcaatctgctacctttaatagaactaggaaggtagcccgcgcacatgcgcgggcaccttacttaatgtggtgaaattttcttatgaatatttatgtatgggtgacttttaataataatgcttttattatattctaaactaaattaaatttacttattttgctttgaacgttggcaccatcgctacatataaattctaaaataaaattacttgagatcgtgcagttgtgtcgaaacaatgtatgtggttcccatgagaaatttttttatattttttgactgccctgaaagatatcttgcaccccctcccgcccacaccccccaaaatagtccaataatgtcatttattactgtagttaatttttatatctattttcattctaacaatcctcctaaaatgtttgaatttttctatttagaatgagttttaaatccaacaacattttttcaatttatttcatgtccatttttttttgagatttatgttttatgaatcatccttgatatgctttgatcttgcaaattgggatgaaaatagaagtgcatataaccttgcacagggtaaaggcatatgtttaaattttctctcgtgtattgaagtaatgatcatagattcatagtatttttagtgaattctcactaaactgaagtctcttataacaaatagaaatttctagattgttctacgttaaatgtcaagaatttacaatgtactatagcaagttttaccaaaaagaaaaacatggacaatgttaagagaaattaattaagttggtagaaagtcgttagatgtctaacaggatataagtaataggtggagatccatttgtggtttttctttgacatatagataatttcaattttaattgtcagggagataaaaaaacagagagtaaaggaatggtgcatgccacacacgggcagggagggaggaaggtttggcatgtttttctaaatgattaatctaacgacctaaatgatttgtcatatgtttaagtcgaaatcgatggttggaagttttcttttcttgtcagaatttggaggatattgtctcacttaaaagagcaatgtaacagcttaaagagtgtttataagatgtataatagacttttagcaccgcatgccgcaaaggagcgggagggagggaaggatgtttggggtgtttcttttataaaaatagatccaatgaccaaaaatagtgtgtcaatcgattcaaaataatgtgtccaatgatttaagtcaaaaccaatggttagatgtgtctttttttcaaaattcctatgattttctctaatttaagaatgtcgtgtaatggcttagaagcgtttatgcgatgttaatgggcattaacaccgcacagggagggtagggaggagagaggtttgagatgttttttatgaaaaaattctgcaaccagaaacaatgtacccattaatttaaatagaaacctatattcagatgctttcttttctttgtctgtttttctattattttccctaatttaatagtattttctctaatttaatagcaccttaggatattctaagtgacagtttgagagccgctagacctagtacgtggaggtctattgtgtgttcttttaacctgtaaagataattttgatttacgtacgtatgttcgcactggacgtggaggttccggatgtggttattttacagagatctaatgatataaagcaattaatgggtccaccgacttagataaaaattgatctgaatgtgttctttttgttttgataaaataggtctaacaggctaaaacaatgggtccactgatttaatgaaaattgatggtcgaatttcttaatttattagatcatatctataaattagatgctatgatcgatcatcttatttatcgaccaattcatgtagatgttgacagaagttacttaagtctgcacaaagttgttagatatctaacagtgtatgagtaaaaaattagggtggcatattttgattttattttcttagaggcctcaagatgaatgtgagttcagcagtaataattttgtagcgttacatcatagtctatttggatcttaattattgatttaattaaaaaatacaatggtacaaataggtcataaattgaaatataatttaaaagttacaactatttaaaagattgtttatctatttatagaactaccgaaaccaataaattaatatgaatgcatggccataaaaacattggatgtcttttaccttaactaacttaactaccataggagagagaaaaaatcaacagaagggagggagggatggctaacatgcgtgcgcacaccgaacagagaggaaggtttcggactacttttttcgaagatagatctaactaaatctttttttttagaatttctaacaatttttttattttgttagagcgccacatggcagcatatgagcgtttgtaggagtgccacgtggcggattaggagtgtttataggaagtttaatggacttttagtatataatagaagatagaggcaaaattctcatgcgtttaaaatactccctccgattcattttaccgtttgggagggctaatctcttcatggtggaaagcctagttatgggaaccaccgtaaaccgataaaaactagaaatttaccataacttgaaggttttgtttaatttttttgaagttatattagctggcttactagaccttaaacactaccgcaccctagtggtaagcctgattatcatggtaataaccggcagtaaagcaaacctgcttggtacagattaaataaagcgattatagaatacttttattttctttttatgtataacatcattgaattcccctcctgtatatttgtattcagagtccctttaatccaccccctcccaccctctctatttttttattccctaacctatcttaagcatacatctgactcacctttagtattttgttgatatcctacaaaatttaaaatttcatgcaaaaaacaacaagaagaagaagaatggggataggaagtgcaatggaactccacatatttagggaggatcagagccaagattagagatccctaatggataggggatgggttgaatacgagtttcaacagagtttgctaacatttgatatttaaagtgaagaaaatatggaagcatcattttggaatattttttatttcattttttcgcattcttaaaaactatgaattaaagtataatttattttgttgtgatttattttatcaataaatatacttcaaggatgacatatatttttacatattttacatg

SEQ ID NO: 73350 - DNA, 952 bp, Oryza sativa
  unsure (1)..(952): unsure at all n locations
ttaattagctagctagccccaactcagcccctgcattaaaaaggttgttcccgcaattaattaggccagatcggtcagtcccatcgttcggtatactcgagaaaaaacgaaacggtatatttacaagtagaaaataaccctcggtcccaaaatgtaagcatttttagctgtgaatctggatgtatggagtattttataaccatctaaactacgacaaaaaatttctaaaatcaactttaaatttaaggttaaaaatttagattttagctaacaaattaaacataaatatagcgaaaagatgggtcacacacacggcacactctccttgatgtaaaatatggcaccccgtgcccatcttattgtactcttaggcctggtttagatccaaaaaattttagccaaaaacgtcacatcaaatatttgaacacatgcatagagtattaaatgtgggaaaaaaaatcaattgcacagtttgcatgtaaattgcgagacgaatcttttgagtctaattacgccatgatttaacaatatgatgctacagtaaatatttgctaatgatgggttaattaggtttaataaattcgtcccgtagcttatatgcggaatatgtaatttgttttgttattaatgaacgtaaactaaatacaaccnnnnnnnnnnnnnnnnnnnnagctcaacgtctcaacgatgtggcatcagcgagaagctgactatccagccgggcagatcggcatagaaggagccaagaaggtgacaaaaccaggccacgtgatgatgcggcgactgatggaaagtttgcttgagctggactggggcggggcgccacggtcaatttggacgcctcgactgtggcacgaacgaaggatgcgccactccggcgggcgtgcgtctgtgagactgtgaccagtgcgcggggccaccggtcagctagcccgaaattccttccacctgc

SEQ ID NO: 73351 - DNA, 1122 bp, Oryza sativa
atctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaatgttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagctgtagtatacccaagttatcaatggcataaggtaaccaatatgtggctgaggaataggacccatcccacattacattgtaaaagaatgcaacattgaatagaaatgcaggatgttggtaaattgggtacaatatgatcaaacgtattgcatgacttgccttgctctcgaactgatgagacctca

SEQ ID NO: 73352 - DNA, 3164 bp, Oryza sativa
ataggagtatagtacgtccacagtccactgcatattactgtacgtaggtggctgtgcctgttcggcgctgtaccagcagatagaatttcatcaatattagctggccatgtttattcgtgtaaccatattatttcatggcgtcattgattagcttagagatgggcctagcagcagcagaagccctagaagaagaagaagaagaagaagaagagtgtcatggtgatgagggtggagagtttcggcagccgtagacagcgttgcatccggggggcgttggcgtgtaaggccttccaggaggaaccgatggcctgtagtttggatccagtgacctcctgcttctgtctctccctgcatccatccatcatgctcttacttagttcattaattaattaattagatcagaggtttagtttgtctgtgtatgcatataaaggatgtacagcggctggcctgggatgttttaggagtattattaatatatgctgatgctgcatgaacatggctcaactccaatgataaaacacaagaatgttttaggagtatttgtctgttgatgctgcataaaaaactagaatattagggaaggacctaatatcaaataattaggaggggtgaggctttgaacccaggtcgtctagcccaccaccttgtggagctagccggaagacccctgggcatttctcgatgctgcatgaacatggctcaactccaatggttaaattaattatagggtactagtaattacctgctccgtctacggggacagtgtgcagggtgcagatgagggcgaggatcatcaggagcaccttgcaaagagacacaacagcagcagcagaagaagtgtgttgcttcctcatctctaaccttgttgtcttctgctctcaataatattgcaactcaattggttgctgttttactgttgcttctctaccggctgttgggctcagaatttatactccctccgtttcgaattgtttgtcgccgttgactttttaagcacatgtttgaccgttcatcttgtttaaaaaaatttaagtaattattaattcttttcctatcatttgattcattgttaaatatattttttttgtaggcatataattttacatattttacaaaagtttttcaataagctaagatgaatggtcaaacatgtgttaaaaagtcaatggtgtcaaacatttcaaaacggagggagtatatagcacctgtccgtagtgttgcttggttgtggccatatgacattcaattggtggtagtagctagataacggcttgatggtagtattcggtttctgcatgcatgtattagtgatcgatgagtgggtttttgcatgcacattaatcaatgagtaagtgtgttatggatgcatgagtaagtgcatgcgttctgcttgcatgagtaacaaagtgtgcgtttccatgcattagtaagtctccgttaagtcatgcttaattcatcctccgtacaatctaaagtgacaaagagttgattcctagaagaaaaagaaattgatccctgtgctattacccaacacgtagcacatgggactgcaattcgctttcgtttaattaccatcgtcagcaaccaacaacatgccacttctgttttgtccccggccaatttggctcgcgctagcaattatattcaccatttttccccagggcatccagtactgtctctctctctctctctctctctctctctctctctctctctctctctctggggatggccatggagaaattaattagacgtggatatcatgcattttacacacgagaatcaggagcaattgatgacaactttaattaccacgactcagcaagtcgaattcgatttgcgtccctcaacccaaaaaccagacacaacgggtccctcaactatcaaaaccgatgtagattaggtccctcggcggttttgagggcggttttggctgacgtggcgcttacatggctaatttgactcggtcttcatctaacgtggcattggcgtgataataaaacccgtggaactcacatatcagtttcacacaaattaataaaaatggtgagtcccacatgtcattctcacccttctacctcgtcttcgagtacatggaccatgacctcgccgccacaccggggctgcacttcatggagccgcaggtcaagtgcttcatggcgcatatcctcgtcgagctccgcagctgccatgaacggtgcgtgctgcatcgagacatcaagggcgccaacctgctcatcgacggcgacgggcgtgctcaagatcgccgacttcggcctcgccaccttcttcacgccgccaggccgcagccgctccagccgcatcatcacgctctggtaccgcccaccggagctcctcctcgacgccaccgagtacggcgtcgccgtcgacctctggagcaccggctgcatgcctgcatcctcgccgagcttctcgccggcaagcccatcttgcccagccaaaccaaggcaaataaataaatattataacctcaactctccatctatatatcatgatatcatctatgcgtggatgaaatggatcggcatctgatttgtcattgctgatcgacgcagatcgagcagctgcacaagatcttcaagctgtgcgggtcgccgtcggaatagtattgggcgaaggcgaagctgccggacgtgacgctgttcaagccgcagcggcctaccggcggaagatcgccgagatgttcagggacttctcgccaccggcgctcgacctcctcgacacgctgctcaacatcgagccgtccgaccggggcaccgcgccaccgccgccgtagccgtggacagcgacgtaagcatgcacaccttctcccctccctctcctctcctcctcgctcgcatggggtcctctgctgctgcttagttcttcaggacaaagccgcctcccgccgctttccgccacctttcgccgccccttcctcttccgcccacagccgctggagacgtgcctccgcggctgcacgccactccctcctttcccgccggccgccgcgcaccgctgactctcgatcgtgtctggagagaggagagagagatgaagagagggaaaatggggagagaggaggaggaagaagaagaggggtgagaatgacacgtggggtccacgggccccaccggtttttttgttattttgtgtgaaaa

SEQ ID NO: 73353 - DNA, 656 bp, Oryza sativa
attggttttgcagtatgcactgaatagattgcggaaagcgtggagtttgatgagagccctgcactggcaccatggccacccatgcagtgtcgtatgaagatggttgtaattggacatccctaagctgcttccttatcttgtcatgcagttcattcttatgctgcatatcccatcggaataataaactcaaccatggatatgtttcacaaagcaatgcatgaggtttagttataatactcagctgcgacatggtatgagcacgctgctgtttgatctaccctaaatctgttgatagtcacaactaatcgagtctggttttttaaagctttaataggatgcaatcgttggtgccttggtggccaacgtttatctatcccttgttaaaggtgttgtattgaaattgttgtggtgaaaacctaactttttgataggacaatattggtaaacatatatatgatgttttctttgggagggtactatcgcagtctcttggagagtgcctcatttgcatagatggccttcatgtattcttttttcatatatctttcaaaatgcattttcatcttttggcatgttgttggggtttttctactaattttggcagtatttttggttgggcacatttttggcttaatactagtcagtaccgaggccaa

SEQ ID NO: 73354 - DNA, 10444 bp, Oryza sativa
tgtttctgcgtgtttattaggcccgattggtgggaggagccgaacccattacgggcggcccatcacgcccatgcctctgtttatctggcccaactgggggtcggagatctattctccgaacctccctatcctgcaaagtggaataagttcatctgaggtcccttaattttacgccaaatccgattttcatgcttgaacccaaaaccagatataactggtccctaaactatcaaaacaggtacaaatgagatccctcggcggttttgaaggtggttttggctgacgtggcgtctacgtggctagtttgactaggtctccgtcccacatggcattgacgtggcgcttacgtggcaattacgtctcaaaaaaataataaaaccatgggcccacctgtcagctaaaaataataattttaaaatggcgtggcccacatggaccccatatgtcattccctctcccctctcagctctccctcttcctcatcaagccatctcctcgcgccgcggcgccgcctcacagccggcaggagcatgccgacgaagcggaaaaacggcggcggcggcggcggcaggccgcggggtcggtgcctactcccgcgccgccacatcatgttagatgctgcacagcggtgaggaggagaggcggagttcgagctcaggacagcgaggattagtgtacagatcgagctaaacagccaacaggattagtggcaggcaccaacaagcagttgctgctgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcgcctcgctgatggtctcgtgcagccgtgcaggtagtgcatccgcttcagctcgtcgtatccggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcttgctcttcccttcgccggacgccgtcgacctcgcttcctggtgccgatacacgcctccgcccgcgcgagccaacccgacgctgttactcctcgatgggacatggaagcataccaaggagatgcaggccgccagcctcccgtttttgtcctccttcgtctcgtccccttgtcattgctcgtctactgcgatgtcggcgccggcggggtcgaggtggtggaggatgacgacggtggtggaggcgggttgcggcggagggcgtgcgctgcgccctctctgttgcgcctgagagaggagatggggagagaggaggaagaagaggaggggagtgagaatgacatgtggggcccacgtaggccccactattttttattaattcatgtgtgaaactgacatgtgggtcccacgggtttattatttttcttagatcgaattgccacataagcgccacgtcaaatgaagaacgagtcaaattagccacgtaggcgccacgtcagccaaaaccaccatccaaaccgctaagggacctcatgctggttttgacagttaagggactcgttgtatctggttttccggttggagaatgaaaatcggattcgttgacaagttaagggacctagggtgaacttattcccctgcaaagttgacggtcgcacgcggcacgcctcattccgtgcgtcagaactcactaggacaaaggatcgagtaccaagcccaagcattttattagagccaaggcagaccatgtatgagcatggtattgatttttttttttaaaaaaagcacggtattgatcaacttaaaggagtgatgatatggtctttgattgagatatgcaccttatatggtgcactggtaagggttgtgtaatttcaaccctgagttcctgtgttcaatactcaacatgctcacaatttctttttaaaaaatatttggagagacgtctattcctccaaatctcaatttctttttaaaaaatgtttggagagatatctcttcctccaaatctcgtgtgatgattaaaagtttccgctccaacacccacatctgctcgtgtaagatttcttttccaacctcactttcctccgatccctgtgcaaggtgagcttccccaccttagagcaggtacaatagtaggctataagccagctgcaaatatattttaataagataaaagatgagagagaagagcagcgggctacaaatctgtagccagctgcagcacggattttaagacgcaatgtgtatatgacagcgggaccatatgctaatagtatagtaagtaactattatataaattagctattaaattggctatagatgaattggagttagtagttggctatactattaaccttgctcttagggcacgcgcacacatatgttcattgggcaaatttgccgttgattatacgtagaagaaaagaaaaatactgaacctttgaagaataagtgatgtcttacggaggcttgattagctcttaacgttgaacaactagcaagaattaagcagtactaatgttcatcattcagattaattacaccactaattaaccctgtctagtatagctaacatagttgcaaacattgcatgcatgcagggcagcttaattagttagttggacacggatcaaaaaagttttgatatactactgtatttagtttagtttaccctccgtctacgaaagcagtgtgcagggtgcagatgagcgcgagcacaatcaggagcaccttgcaaagggacagtgcagcagcaacggcagaagaagagctgcggtgcgtcctcatctcgcttaattaccactccactaattaattatcctgttcttctctctgactggaatgtatgcaccccctgggtttaattgttgcttcttcgatcgactacaggccgtgggtttccagaatttatagagcctgcaggcaagcaggcagggtagtaaagtatatttagtgcacttcgctatcgtttactaggagtcaatggctggccgggcctcttgattaatcccaggaccaatttggcactgatcttttccctcgaaaacattttgggtcacttttgaaaaaactgataactgattaaaccctattactagtgaagagccagaggagtgacgtcagtgacacacgaggataggcaagtttaaactagtgacatagagtgaaagggctaattttaagtgacatatgagaaaacaggctaatttgaagtggaatataacgaattatccttataaattacatgcacctcctgagtttagttgttgcttcttcgtcaaaaggccgtgggtttccagaattaatagtgcagttcgctatcgtttactacgagtcaatggctggcccgatctcttacaagttacaaccccatcgtttggtttatatttgtgaaataatccaaacgatatatttgtaaatgaaaaataatttataaataagattttcatatatgtgttcttaacgatctaaaagcaaaatctaaaaaataaattcagataaaaaactcaaaatcagcttcaaatttaagattaaaaatttaaattttagatgatatatatatataagcataagtaaaaaaagttgagcccctaatttcttccgggaccaatttggcactggtcttttccctcaaaaattttttggcagttccctcaaaaaaaaaatttttttggcactggccaacaaattaagtcttcgttttttccacaatatgagacgtctcatctggtagagtaattaatcaatagagaccttatcagctcggctacagcacgactcaggatggcaccagaatctgttgttaattccattattccatcctggagggcttgaccgacttgactactcagtacatatctactccaccatagagaattgagaggcaaaacaaggacaaggacaaacagcatgctctctgtcatataaaaaacaaaaccagcctatacttcgtaatactataatatatcatattcggtactatatggaacgaaaaaaatataccaataggtggtacaagatatattacatgtgccatattatataaaaaaaattacatgtgccatgtttcattcccagcaacataactaggtcgtttttaatcctgtgccgctagatttagtctttttctttaaataatcttcttcggtttggttggtcctatattatgtcttaggccatttcctctcgcattttaaccattctctttaataaaatggatttgcttaatagcattccacaaaaatttaagaatgaaatcttacagattttgaaccgttagatccacgttaagattcatgtctaacaagaagataaagttttcaggttggagttagagttagggtaggagggggatgggatgggggagggagaagatggaacccctagagcttagggggatagctataggtgacggagaaccggaggtgagcaactaagtggtggacacgggcgggtggcaaggcaccggtggtggtgctggagccatagggttggcaggaggcggtgggccggcgttggcggtggggaaaacaaggaggtggcgattggtggtggtgaatgtagtgtcggggacccgccgaagatggggaagatggttcggaggagggaattcagcgcgctcctttggggaagagaacggggagagggaagggggaggaggctcggggtaggggaaaagtttggttttactatttcactttgatagatttttaagcttatatcttttaattttccatccgtaggatgttacgtctaaatttgtgttactgtcgatccaacttataattacacttagttaacagagcacttatactcaggtatagtgcaccaaagttaaattttacattagttttttttcgctagatttacaactttttacattgtcccatttttttttatttcattcaaaatagattgtatccatatagttgcctcctactactgaagcagcgtgctgggtgcagatgagtgcgaggaccttcacaaattcacaagccacagattaatttatctacagccacgtattatctgtggctgtagattaatttaatgccattatctaaaaagaaagataatacgtatcttatcagctctaactctaaacgaaactagctaggtaaggttgaggtacgcagggccggtcctagggctatgcagccgaggtgatcgccgtgggcccatgatgatggagggggggcaacacctaatactagtagtctagtacctgcctatggcttacctgaagcagaaacacccgagaaacgagaggagttgcagcgtcgtcggtaactcggcagacggcatcgcatcgcacaggacacaaccgcacaggcgcacagcgtcgtcgactcgttcttgatgattttgtatcaagaaatacccgaagaagtatcttttcatgagaaatagtgggtatgatgggatgctattcttcattaaggtaatgatattagtttcaaggtacaaatatattgttattttggtcgactttattttttgataattaccagacatgttaaatttaatatatggataaatttattttcatttgcaaataaaattagcgtatatatatcataaaattttatatataacttagagagcccattgcaacgagttcacctaggaccctcaaaatcataggaccggctctggaggtacgtaacagtcatactacatatcacatatgcagatatgctgctgctgcctcacgttcactgcacacatcacactgagcagatactacttttatatatactccaatatggaacgcatacagaggaattaaaagacacctactcgatccatcgatctgcgttagatgcctgctggtttatttatttgtttgtatatataggcatagcatcgatcgacatgagtagatcgagatcgatactttaattttagataatgagatcgagatcgatatggtcttcgatcatgcagtagcactgtatgtagcagagagatggagtgtgggtcatggtcatggcgagcctgctccaggagggcatctgtagggtccgcggcatccccggccgccggtgtaagacccgccgggggtcgtcggcggcgtgtaggttggatccaatactgaacccttcccacccccaccaattgccgcagccgctctccctgcatccatcacaacaatactcagtggcggagccaggatcgtcgtcgagttagatatgactaattaatagtgttttataacgatcgactaaattttacacttattaaccgcgtagttggtaatggagacggcagtgacggagcccgggcaatggctcgacttacccgggagctaccttcattgacaataccgatagtgtaatactaccgatagagagatcagaccactgtaaagcagtggcggctccaggatcgaatcgttgggtggtcctgcttggcgtcccaaattgtcacgatgttataaaatcaagtcaaatatgtcaaatatagtggaaatataattcaaatattgaaagataactcagtacatcacaaattgatttaaaaccaacatttaagttcaaagttacgaaagttacaacataaataattcaaatatcttacaatatttaggtagaagattataatacactacttcttttctactcgccgggtcttcatagacatgaaattctttttaatgtcttcttcgctaacttgagagaagacatcccgctcaataaatgtgattaaacaatcattcaataatttgtcacacatactatttctcagcttgctcttcactacactcaatgcagaaaacaccctctcaacacttgctgttgctacaggtaatatcaataccaacttgagaagtaaatagacccaatcataaagaacatgcttgtttgtttcacaagtttaatagagagctcagcaagagtttctaggcctttgaacctttcatctcttctcatatcatcaataaaagtcccaagttgcatttctagtctgatcaaatccatggttgaaaactcttttggataaaacttggcaagcttaagtacttgttgtgcatcataagaggcaaatgaattgaatggattcaatgctgacatgcaaatgagcaattccatattaacctcatcaaacctactattgagctcttggctattttatcaatcacaccaatgtacacttctcttctaaaatgatcatcatttgtttggtccggataaaaccgtggagatcttccatgtggcacatattttccatctaaggttggaacttggatactatgtttattgcaaaatgaaacaacagttccttgaaaaaattcttcccatccttcagatcttaatttttgcattctttccttggccaaagttacaagtgacattgcattaacaatatcttggtctctcttttgcaagcacaaacacaactcatttgtatatccaagaatgacaagcatcaaatgtgcactaaaaacaaaatcaaatgattcaaaagctccaaccacagcatgtattcttggccaatcatctctttgtgtggggtcttttccaagagttatgagcacctcatgaattgtggggtacataccaataatatgcaatattgttttgtaatgagaaccccatctagtatcacctggcctagccaatcccatctcttgatttaatccaaccccactttctatttcacccaattcaagtgcttccataatcttttgagctctaacatctctaagcatgtcatgacgcttacaagaagtaccaacaatattcagtaagtgagaaacttgagtaaaaaaccatacgcaatcatcatttcccttggcaacagaaacaagaactaattgaagttgatgtgcaaaacagtggatgtaataagctgaaggagactctttcatgatcaatgttttcagcccattaatcttccctttcatgttactagccccatcatatccttgaccacgaatttgagaaggactcaagtgatgatcactaagcaaagttagaattgcctttttaagtgcagcagaagtggtactagctacatggactactccaaggaaccgttcacatactcttccaagtttgtcaatataccgcacacaaagagcaagttgttccttatgtgaaaggtcactacactcatcagcaagaattgcataatgatcatcaccaagttcttcaatgatgcgcttagtagtctcatcagcacaacaatggataatttccctttgtatactagaacaagtcaagatgcaatttccaggagcatttttcaacaccaaccgatcaacttctttattattttcagcaagccatttcaaaagttcaataaaattccctcggttactagattcttcactttcatcatgtccacgaaatgccaatccttgatttaaaagatatctcaaacatctaagtgaatatgtcaacctagccttatagtgaatttcactttcatttgacaccttcacaatgacattatctattgaaggaccaccacttacaaataggttgtatttctcttgagctttattgtgagcacttgttataccccccacatgtttgtcaagtgcatcggctttgttccaatttctccaaccatccgtaacaaaattactagttccactaccaaacaagtaacataccatgcaaaacccagcatcctttgctacactatattcaagccattggtacttatgaaaccaaacaaaattgaagtggcgcttcttaccataaatttccctgactgggaaatcatgtgcataacattggtttgggcctttcagaatatatgcacgccgaactgcgtcttgttcattgacatcatagctcgcaataggggacctcagtcctggatcatattgaagatgatcagcatcatactctggaggtgcatcttgctcttcatttgttgcctcaacaactggagttggcacaggatgtggctcaactagtggtggctcctcttcttcaatttgagcttcctcatcaataagatctgccctcttcttcgcctttgcttcatgtttccgaaaaagcgatgcaatgtctccattccttttcatgtctcactgcaatttgcactacaaattaatgagacactaagttaagttatattgactactaactaagttgctgctaaaaaaaaaatctaagtttcagttttcaatcacatttttcattcatccatgaccgatctattcaaagtaaatactaaagactaaaatgggtaactcaccatctcggtcttcactcttcagttctttcacagaggggcaggcagcagcaggggggcagggcactggaggccggagcaagcaaagccgtctactcgtgactcgtcgagcaggaggctggaaggagagggacccgactccggtgcgtcgtcgctgccgtgaggggtggccgggcggcggggcaaaatggtggccggctagccgccgccggccgggatggtgccgcacgcccacgtcgggcccgggcggccgacgggctgtcgcccgcctcctgcagtcctgctcctgcaggcgtacaggcgatggccgccggcgctggcgcctgccgcagccgcagagcgagaggacgaggatgcgacgaggcgaggagtggagaatcgggactcgggagaggcggagacgagacagaagcgaagcggagcggcgggtgtccctacgcggtgcgcctctcctctgtcatcctaaccctagcgcctgtggtgggcttttttgatttgggccgtcggggggggggggtcctcgtgggccaaaatccagggtggtccaaggaccacccggactacctgctggagccgcccctgctgtaaagagatcgaccctgagggattagaagtgtattttacctccttgcacggaggcagtgtgcagggtgcagatgagggcgaggaccatcaagatcaccttgcaaagggacagagcaccaccaaaactggagctgccatgctttgtcatctctaacttggtattatctcttcttctctcctctataactctgactgaaactgcatgcacctcctgggtttgttgcttctctacaggctgttgggttttcggaatttatagagcctggaggcaggcagagtgtagtgtagtgcagtgcagttcgctatcgtttaccacgagtcaatggacctctaatttctcccgggcccaatttggcactggccagagcaaagtcttggtcttttccacgacatgcatggaacgactcatctaatatactctcatccctaaatatt

SEQ ID NO: 73355 - DNA, 8208 bp, Oryza sativa
  unsure (1)..(8208): unsure at all n locations
ttgctttagtcaattattactcaccgaatcaccgttgttagggccaaatactatcacactgtaagtcaccatctggagcatgcattgccataggattctactactagtagcaggcacacaatcaacgcaagtacgcaacgacaggccacaactatcgttacccgtcactgccgtcgctgtcccggccgaagaacagatcagaagctgctagtaaagctttatgccggcacccacgcgaaagcccacgggggcgggcatccgttcggccggggccggggcagcagctgcgcaggggcgctctgccccggattcccttcacacgcgcatccgcgcgcgaggccgcaccaccggcgcgtggctcggcaggtggaagggaattcgggctagctgagcggtggccccgcgcactggtcacagtctcacagacgcacgcccgccggagtgggcatccttcgttcgtgccacagtcgaggcgtccaaattgaccgtggcgccccgccccagtccagctcaagcaaactttccatcagtcgccgcatcatcacgtggcctggttttgtcaccttcttggctccttctatgccgatctgcccggctggatagtcagcttctcgctgatgccacatcgttgagacgttgagctnnnnnnnnnnnnnnnnnnnnggttgtatttagtttacgttcattaataacaaaacaaattacatattccgcatataagctacgggacgaatttattaaacctaattaacccatcattagcaaatatttactgtagcatcatattgttaaatcatggcgtaattagactcaaaagattcgtctcgcaatttacatgcaaactgtgcaattgattttttttcccacatttaatactctatgcatgtgttcaaatatttgatgtgacgtttttggctaaaattttttggatctaaaccaggcctaagagtacaataagatgggcacggggtgccatattttacatcaaggagagtgtgccgtgtgtgtgacccatcttttcgctatatttatgtttaatttgttagctaaaatctaaatttttaaccttaaatttaaagttgattttagaaattttttgtcgtagtttagatggttataaaatactccatacatccagattcacagctaaaaatgcttacattttgggaccgagggttattttctacttgtaaatataccgtttcgttttttctcgagtataccgaacgatgggactgaccgatctggcctaattaattgcgggaacaacctttttaatgcaggggctgagttggggctagctagctaattaagataagccctttaatttgttctctcagtgattgggaacagcattaggaaacagtaaactgctactaaaatttcctgagcatgatgggaccggtatgtgacatggccagtacaatgatcatataatccgctgagatcgatcgctggaggttctgggtctcaggtcactcagccgaaacagtggaggaatcgattcctcaggataaccccgatcggcccggaacgaaaagggttcacgccctcacgactttccatcaggaattcaggatagcaccttttcggcacacgtcgtattcttaccagttgaaatctaagcttaggcagttgttccagttccagtaggagctccactgtggacttcggacttcaagtgcggatgcggatcccgtgagaagtgaagtgtttgccgtcagataatgctccaaatatgtaatactaacacactatttatggaaaatgaaggatacaatgcatacaatcattttagtgttaaccacaacaccatgccatgccggtagacgttgacagggatcgacgattatttgaacctagctgattaccgtgcaaagctgctcggcctgcatgtcgaagaaattaaacagcaaaaacaaggaaatgaacggcaacaacaaatgggtggttgagaggcaaacaccagctgctactgtggttctaatgcgtgcagctaagctcgcaccacaccacacaaccctgtgtacgagacatcattcagtggaggtcagggaaagaacagatcgcgacactcgggttgatcagaatggaccaaaacaaagttgcagataataagaggcaaacccacgtgttggttaggtacatcttttggcttttgtaccaggggcttatcgtcgtccttacatctgggattaatttatttccaaatttagaaactagatgcccttaaattatttctttgatgtgggagtatttttccatccagggttcatttcttaattaatgcacggaattaaatagctgtgtctatccagagtatagatgtcggaagctcacttccatttgtccaaagaaaataccatattctttcttctttgaacttgtcataggtggaaaagcatttcaacttctttgttagctataagaaagagattatgaaaattctctatttctccttaaagtcgaccacctctcaaacttgcccctctaaagttgttttttttatatgccactttgtaagtaatatttatccaatgtttacccctaccactcttctaaccatagtgtccattttaccctttttcttcctctcaacctttttctcctttctttgccaaactttttcctccattattttcttcattactccctccatcccataatataaggcatacatgcaaacatgcaattaattatgatattttctccattaaattattacttttttaaatcctccactcttatgctatctaatcctattggatgcatgcattatatttattaggatgatccaaactataagatgataataattatttcttgatttttgggttaagaatggttgtgccttatattttagaatggagaaagtaattagcatcctgacattggtctcctctttccactcaaccatggccctcgtcctcccctttaatcaccctttccttgacaggtgcctactccctcctcaaatggcggtgaccctcctatttagctcgccctatttcatcttggcctaatactaacccttacattattaaaaaaggaaaaacgctggataagagagaagagctctcatatagaaaaatatcaagagaagtaaggtttaaatttgggtcatctagcccactacttgtgctagtcagaaagaacccaaaaatttctcaccctctcaccattcattgacaattctctttaaccctctttatcacacgacatcgatatatacaaaacataacgagagatttagaaacaatcatagtgcgataagacattgggtaataggaacatgaagacaaagtgaagtaagaacaacaaaactgtttaaaatcattatcctgtgctattgaatagcacaatactgataaaaactgcattcgcagcgggtgaaagagagaaaatttgtttcgttttccgctcgcacacgcttcccaaactactaaacagtgtgttttttctaaaaaaatttctatatgaaatttgcttttaaaaatcatattaatccatttttaaagtttaaaatagttaatactcaattaattatatgctaatgacttacctcattttgcatatcttctcaatcttctcttttcttctcctcttaaactcagagcgcgacaaataaaagagaaagctaggttaatatggaagtgacaaataaaagatactacatagtgttccttcctttttattgttttggttttcttttacggaattatatatccttttcaaatcacacatggtagcgccttctagaattcgatggatcagtcaccaagtgcatcgatgtaattgtcttgttggcagcaaatcaaccatcctgacggcgatggagatcgtgaaattgaaaaggaatattagcgtacgtacttagtgccgatcatttagcgtttctatcgaaagtgcggctgatcgagttcaaacatgtggtaaaccttttttcatgacaaacaaagcaataaattaaaataccacaatgtgggaggaaaagctttcttcagtgtttctcgtggtgagttaattgtgatgtttactttcgtggcgagttaactgtgacaaatgacaaggcaatgaccaatagattaacaaccaaattacaaaaatccaaccgaaaaatgacagtgacatagctaataaacgcaggcagcatgtctaattaattatccaggtggcgaactggggatcgcacattgctagctttatttctgtgtcttccgcctttttatttttcgaagagccttgacacccgtcagagttgtgttgtatttactgcttctatagtgctcaatttcaacacacaaaagtttttgcataatcaggaaaaataacatttctatatctatataggagaccaactaactgttatattttataatatatttcaagtttatcaaaatttaactaatcgtctaatcctgagatgatgtgatactctgaaatgtggatactgttttggaaaattattaaaagataaatttatacagcgccaaacggatctcctgtcgattcatacaccagtgtaattaatcaaagctgcgcattgtaatctattggatttgactcagaaaccttaccctttcatcaatggaatcgcattatagcaactaaagctagaggtatatatatatatatatatatatatatatatatatatatatatatatataatataatgccccctcacaagtaataattaaaatatttcaattaatctgcccaggttgtcggttgaaaggcaaaccttccgaatcgactgaatctgacttgctgcttaacgaactgtttaaccacatggattagtgtgataacatgggctaataagtggcgatgtactataacgcacccattctctggtctggctgattacgttgtgtaaacaaacactatttttttctaatatattgacgtgcaaatcttttgcgcgttcgtgaaaagaaaataacacacccattctcgacaggatgagcgtgagtgcagctgcgacctacccctatgcttcaatttcttttttgacagttgcataggtcccttttatctttctgaataaaatgcactgctactagttactactattaattattgctaatactttccaatacataggtgatgaagcaagcaccttggcagtgtggaacctatatgtatgtattttatttcttgctgggcaataatgttcactagtggcatgtatagcaggttttttctataatcttggatggccgttaaatggtggaattgtacatatacatgcaactgcatatggattaggaaaaagttcaaatatcctctaaactttagatgaagtccgtctagtaccttgaactttaaaaccggacattcaaccccctgaactttgacataccatccatattacctctaaggtggttttggagaatggttttgcatattttggaagcttaaacaaacaattttgaataactaatataacatatttacatatcatcagttataagtcattaatttattcttacacattgatatcatactattatcatgttgatatttatttgtgagtgagagtaaataaagagcaaaaagaagtatttaaatcaaaattttaatatgtatgtctaaagcgtataacacgtgatcaaactcatctaattatatataaattagataaaaaccattatgcaaaaccatcttagtgggttatataaattgtattgtaaagtttataaattgtattgtaaagtttaggggtggaatgtccggttttaaagttcaggttgctagatggacttccatctaaagtttaggcggttatttggattttttagtcttttttttcgaacgattaaggcctcctttaatccttataaaagtaaaaagatagaaaggctcttaatgttcttctaaagtaaagtgctaagttgtgcttattttttaagttcatgtgaacttcgacgttgaagttttaattgtagttttttttcaaaacgaaattaaccaaacaaattcaaatgttgtttatttcacacttgtttactgatagagttcaagttacccgatagaattcaagttttactatccacaagcattacatacacatggactcttttcaataggaatttagttatgttagggatttgctgatgtctgtctctttaagcactcgcaagtatgcatatgtgacgtgtgtacgtggtggtgtatatgcgtgtgcagcttccgtataatcagaaaaaagatataaatggagaatagtcgacattgttaagttcgtgggacttgacaagaccactgtagattagtcagacatgtaccaagacttgtagaaatactctctccgtacatacgtaggtttatgtcgatatttgaacattcgtattatttaaatttttttattgtgattaacatttttgttgttattagatgataaaacatgaataatactttatgcatgacttttttattttttcatgaatttttaaaataagacggacggttaaacattggacacgaaacctacgtctgcacttaaaatgaaacggatagagtaataaacacgacacatagatgtgacccagcagaatataacatggttagaattggtcaaccttagtaccattctacaatttaaaccacagagacgaatgtctggactaggcatgcaataagcataagctatgatttcgcttcaccgtatcaggtgaagaggcctcagctcaccgaccccacctgtcagtggccaaagctggagcccctcaagaatctatccatcaatcctgatttctttttcccactgagagaaaaacaaaaggagggaatattgtggggagagaagaaaggccaagaggagagggaaggggggggggggggcatgagataaatggccaataggaaaagttgagaacaaatccaaaccaaccaatcccaatatccacataccacctctccattggaccacagtttctctctccccacaaccaaaccaaaactaagaaacccctgctgctctctgcaagaactccatcaaattccccagccaaaaacactcagataattttttttattagaaaaaaagaaaggagattagccagccagtctgctgctccatctcagtgctcacgcactcactctgaggagtgaaatccaatccagcccactccggagttcctggaaaatcctcgcgaagtccaagaaaaaaaatattaccactgccatttcttggtttcttgatagcttctcctagctgctgccgcccaatcatccgagagagcgagcaagtaagaaagattgattgattgcttgattgggagtgtcctttgggcgagctgtggtgggatttagcggcatgtcagcgtcgccgtcgtcgatgagcggcgccggcgccggcgaggcgggggtgcggacggtggtgtggttcaggcgggacctgcgcgtggaggacaacccggcgctggcggcggcggcgcgggcggccggggaggtggtgccggtgtacgtgtgggcgccggaggaggacgggccgtactacccggggcgggtgtcccggtggtggctcagccagagcctcaagcacctggacgcctcgctccggcggctcggcgccagcaggctcgtcacccgccgctccgccgacgccgtcgtcgcgctcatcgagctcgtccgcagcatcggcgccacgcatctcttcttcaaccacctctacggttcgattcctatatcttcttctcgcactgcgacctcttcttggtcaattcttccttttttttttaggctctgctattatgattcagacttcagcttagagttccagttaaatttgttcgatatttttccttccctcttctcgtttaacaggatccattgatccagaattccagataggtactatatctcacaaagggaaaaaaaaagagagactaggctaagcttccacgaacagcatcttgtgtgtctaccatttatggatatttcgcaccttaacacccttactcttcacgtcaaagagctccaagtatggagagcatctaccttagactttcccatcaaacactccctgaacactcggtcaccgtctccctctttaattcccaaaagttcatgcagccaccaacctcctcacctcctcatagcctatccaagaactccattaaatttagcagttggccaaggattcaggaatggtgtgtgtgtgctctggtttactgttttagcaacaagaagaatggttaatta

SEQ ID NO: 73356 - DNA, 2588 bp, Oryza sativa
caatatagataagcaaatgaaaccctttagggaatgtgcaaatggattgctcactttgtattaagatggagaaagaaaagttacatcatcagcgattgggcatgcaaaaccagcagattgaccgaacaaaaaaccaaatacaaccaggcgactatacttcagaattactgaagacacatttttctaatcaggttgctgtactagctgtgcggttcggataaagtcaggacaaataagacaacctgaagcacttggaatatctgttgaactaaaagataaggtgcatccatctttttatgctttgttgtcactattaattaagtatatcatgtttttactgtttctgctacagtttgcttgccacttgatccgcctcattcctcaatttactcagtggtttcaacagtgtctatgttctatccattagtaacacacgatcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagaaagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcacgttacaccgttgtccaattctgcgtggaaccaacctgagaatgctcaattctctgaaactggagtagccgagatgaattcagacaaatcctctgcccaattaggccggaaatcagccaacttgttattcttcaccgaattagtcccacgaatgaattcggcacacctcttcccatcaactaaatcagactgcttaattcatgtcagcaaatacggtccacaaatgaatttcccaaaccaaaatagcaaatacccacagaagtctacgattggatccactagtgaatttggcccaacacatccatcaacgagttcaacccaccctcaaggaattcagcacaccaacaaatttggtcccagttaactccatcagtgaaattggcccacgaaattcccgcaaacaaattcggcccgctaaaagatttggtccatctgctacccattagcgaattcagcccaagcataaattcggccgtcttattctcgacatcgtattcagcccatgagtagatttggcctcatagattctcgtctacaaattgagcccaagagtaaattaggccgactaaattctgtcaactaatttggcccaaaaataaatttggtccatctattttccgtaaactaattcggcccatgagtagattagggctcatgggttcccgtcaacaaattgagcccgagagaaaatttgaccctctaaattccgtcaaccaactgggaaa

SEQ ID NO: 73357 - DNA, 10415 bp, Oryza sativa
tggagtatataataagagtaattaatcagcgatggttaattaaaggataaagagcaacttataaatcgcagacacgactcaatcaggatgacaccagatcgaatttgttggtagtccaattgttctatcctggagggcttgaccgaattgattatacttaaataattaatccactatatatctactccatgcaccatagagacaagacaagtactccctccgtttcaaaatgtttgacacagttgactttttaagtacgtgtttgaccattcatcttattcaaaaaatttaagtaattatttattcttttcatatcatttgattcattgttaaatatactttcatgtacacatatagttttacatattttataatttttttaataagacgaacggttaaatatgtgctaaaaagtcaacggtgtcaaacattttaaaacggagggagtagtatttaccagctactagctcaacatccattatgtacaaaaataaggagcgactagctcaacagcatgcatataccggtagccggtagctaggtgctacaagatattacatgtgccatgtttcattcccagtatcataactaggtcgctatgtcatctttaatcctgtatcgctagatttagtctttccttttatcttcttttgctcggtcgggcttcgttttgtcttaattaggcatttcctctcgtcttttaactattctctttaataaaaaggtcttctttttggcttaattaggcatttcctctcgtcttttaactattctctttaataaaaacggtattctttttgtcttaattaggcatttcctctcgtcttttaactattctctttaataaaaatatacggaggtaatggtaccaaatctcctcacttgtacgtagtttgtgattttcttttctatctcccttgcatgaattttaaagcaaatagaacaattcaaaattacattgtagttgcatgcaaattacattggtggatatatggaagttacaatataactacactatatgattgcactatatttatatacgtcaaatttatagaaaaaaaatatcgacaagtatatagcgcaaaactaactgcaagctttaccactaccctcaggaaggcgcctttgctacttccattggtaaggcccatctgcagaggattcaccgacttcacaggccatcactaggaatttgtttatgaggggtaattaagcctaattggtggtcagagctgtaactgcgtggagcccaacctcttacgggtggctcatcacgcccatgcctatgttaatctggtccaattggggtcggagatttattctccgaaccccccctagcccccgctcctccaaagctgaaggccgtaggcctgttccgcgtgttagaactcacaaggagaaaagatctgaagacgctttagatcaagcattggacgctaacgcaggcatcggatgcgctattccccatcttttctccatgctcactttccccatttccctgtcttcttctctccaccattccccttctctctcacctagcaacgaccaaaagtggccaagtcctcaggaccgaaggaagatgccatcgccggagaaagccgcgatagtggtggctttgggaggagaggtgtgtgcgggtagagtagaaggcaccatggccggagagaatcccaagctcgccggcggcggcaccacgaggaggatgtgcagttattgttgaagacgacaaagctcagcagcggcggtacctacatcgcgcggagattcagccatcaccggttagggccccgagctcgccggaagcagcggcacggccgcgaggaggtggcacgtaggacggagtttgagacgccatcgcctgagagggccctgagctcactggcgaaggtgaagaggtttatggcaacgtcgaggattgttgcacaccatatgttttttttttttgcacatagtgtgtttgtgatgttgcactccgtcttttctagatgtttcttaaatcagtactagatgttgcatttggtttctttgaatgttgcacgtattgggtttttgttgttgcagtcaacattcttgagtattacattcgattgaaacatcttcgataaagcgatgaaatattcttcagtgaaagatgaaacattaagaaaaaattcgtgttgaaacttttttttagcaatgaaaaattgcaacatttcttcatcaacatatagtgcaacatcgtcgagagatttgcaatctctggacatccgatgcgtaggcctctccaaaaaaaatcgagaacttagcaacatattgtgtttttatagtagtagagaaatgggtatgcaaaaatcacaaatgtagaaatggccgaacgaaattaggacccgtttttatttttatttttttgacatgtagaaggaccagttttgctgatgaagaagctggtaggctaatgcttccgtgaattgaccagataaaaatgggcccacatcaaactaaccaaaagggcccttagttttcggcccacatccgagcagcagcccagcattctaagggatcccgtgggccaaatcgtgtgggccgtggctgttggggtcggagatttcttccccgacccttcctttttctcagggcgagatgccggcgtgatcaatccgtcagatccgcacatgaatctggtagtggttgcagagacaccgacggcacggagatgtttgcagttgattatttcgtagagattggaacgatttcaagcatcgagatgcatgatttctacgtgtttttactgaattactccccccgttttaaaatgtttgataccgttgactttctaattacgtatttgatcattcgtcttattcaaaaactttaagtaattattaatttttttcatatcatttgatttattgttaaatatgctttcatgtacacgtatagttttatatatttcacaaattatttttaataagacgaacggtcaaacatatgctaaaaagtcaacggtgtcaaatattttgaaacggagggagtattatgatagtaagctacgttaccccgatacgctgatacggatacggatacgcgatacggcgataccgggatacaccatcttcccaaaaacatggatacggggatacacgaatatatatatatatatatatatatatatatatatatatatatatatatatatatatatatatatataatttaaaaaaattgagtgtggaatatggactgaaaaaataggaagcaaacagcatcaatccaccaatgcatatatgatatctcagtacgacagattcacaggctcacagcatctcaccaagtcaccatttattgaagaggcatacataaataagtgcaagacttacacagtagatgaaatcatgaaaataacatagttcttcaaatagatggtagacattagacaacattgttcacatagtagatgatgcaggatttacctcaagttctcaacgtcgtcgtcgtcggaggtgatgcaggattgataagaggcagcggcgtgacgcctcgtggaggagtctggagctcctggaggacagtgcagaggagggggcgcggagaaggctgtaggccgcggcgtggcgtcggcgaggcggcgcagcgacggcgtagggcgggccggcggcgaggcgacgcagcgacggcgtggtcggggcggccgggcggcgctgcgatggggattgggttttgcgagcggcggcgcgtttggaggggaagaacgggagatgcgttttgttctgtgtgatttagggctccccatatcatgtacgtatcccgccgtatcggaggagtatcggtattttttttaattatctgaaaaagagaaaaatgagggatacatatgggatacgtatccggccgtatcccgcacgtatccgtatccgggcgcgtatcagatactgatacgagggtcagctgccgtatcggggtgacgttgatagtaagtaacatctctgatcaaaactctttgcagtgcgtcgtcctcccagattgatttaagactgtctgcctctcgattacccaaagaaaagatgaaagaataatcagctgtcaatgtgtagtactagcagcaggcaacaattaatgcaacatggatgcaggaacgatgtgtatatagatagatatccgcttcactttatttaccgcaaaaatacaccgttgcatacatcacaattcacatcgcatatgctgctgatgctgattgctgcatacccgtctactgatcgatcgattgatagataatgtgttaatcagatgcctagttttatttgtttatgtagtactccctccgttttaaaatatttgacaccgttgactttttaggacgtgtttgaccattcgtcttattccaaaaatctatgtaattatttttttttcatattatttgatttattgttaaatatacttttatgtacatatatagttttacatatttcataaatttttttaataagataaacggtcaaacttgttataagaagtcaacggtgtcaaacattttgaaatggagagagtaattaagctacgcaggccatgagattgatcgatcgaaataacaagtgaacatgcagtagcagtagcagagtagtgtgtcgatcgtcatggtttggcagctggaggacctccatagcatccgtatgcaacggtgcatccccgtcccgggcgtgtgtaaggttcgccgggaatcctgggcaccgggtaccgtggtggattcagcgctccgttcctaccaattgcatctgctgctcctgctctccctgcttccatcaatcacatcgtacaacacatattacaaattaagtcaaccaaccaggcttaactatctcaataattataagcaggattatcgcatttatcatgcacggtagtcttttcagtttttgaaaccacgatatgtcttgcggttataccgcacggttttcacggtaaccacgtggttaccgcgggaggaaaaaaaagataaggtgaaccctgattataagtgtatttacctccttgtaccgaggcagtgtgcagggtgcagatgagggcgaggaccatcaggagcaccttgcaaaggtagctgcgttgcgtcctcattactatcttattatctctaccttaattctttttctgatctctccctcaaatatattgcacctctttgcttgctggtgtttgtttgcttctcggctgttgggttttcacaatttatagagccagtcggttgggtagtgcatgcagttcgctatcgttgaccaggggtcaatgacactctttcttccctggactaattaggcacctggccaacaattaaagtcgtcattttttccacgacatgcaatgtctcatcatatctctgtggactgtacgtggagtaatatcgcccggtgaattccatcgctggatccagaaatttttacgaacctaggcaagactagcaataggtaaagttttatacagatccatatatagatcatctcgacgtgagcatttgcgttactagtttgtgtgaaacatgttaattaagttgctagtactatacagtactactactgttgtgctgctcatacggctcaaacactgattaagcaaggtaattttgtcttaatcccaatgaatgtgccggccggtcaactatccacggtcgtccggccttcgccactgcactggctgtgttcggaagtttaatagtatagcccattactggctccaattcatctacaaccaatctaatagctaatttatataatagttgcttactatactataaatatattaatattatatggtcccacctgtcatacacacattgcgtattggaatccgcgctgcagctggctatagatttgtagcccgctgctcttctctctcatcttttatctcattaaaatatgtttacagctagctaatagcctgctattatacctgctctgatagaaaccatctcctatgcacggaaaacggagcggtctattagcgtgagattaattaagtattagccatttttttcaaaaatagatcaatatgattttttttaataatttttgtatagaaattttttgtaaaaaaacgcaccgtttagcaatttgaaaagtatacgtgtggaaaatgagaggggaatgttgggaactagctcttgcaagcgtacgtgttgggaactagccatactgtcgagtaatcaaccatagatatatggtattagagcagccctaatactacagtcaatataccagtggtgcacctatacaatagttaactatatatttataatccattattaatacttggatctctccatatagttaaaaaaataatatttacatgtggtccagcataaattcacatatacttttaagcgttaaatgcattatgcttaggaggagatggcattcagacaacttagagcaaggttaatagtatagcccactactagctccaattcatttatagccaatctaatagctaatttatacaatatttgcttactatactataatatatggtcccacctgtcatatacacattgcgtcttggagtccgcgctgcagctggctacaaatctatagcccgctgctcttctctctcatcttttatctcattaaaatatgtttgtagctggttaatagtctgctattgtacccgctcttatagagttctcaaaaaaaaagaacaactttacggtatattttactgtaaattttgtcttttaagccttctcctgtagagatgacgtggaagatactaatagtaagatgcttattctattattatccttaacctcacaaagatctcccacaagcaaattcagctatctaattggaacaatcctacgatggtccatgatatgagtaacggacggatcttgcctctaccccaggggtgccaaagaaagtgttgcgtagccttattctcctagcgtcatgggagatttggaaggagcgaaatcagttaagacaaaaaaaaactatcggcaacatacttggttgcaaagatcaaagaggaggcacagatttgggccatggcagcaccgaatggactatgtaacatagtgccttagagtcttcttttttcttttaaacctgtatagagctactcttgtacagctttttttttttgccatattcaatgaaattggcacattctaagtgccggttcgttaaaaaaaactcatagttttttgaagttcgtgttacaactggttacatatatgtagcttgctttttttttctgtcctcttctctcttaatttcaattcagtacaaatccgatgtgacgtcttctatagcccgtttacatgatcttatcatacatgcatgctcttagataatcacactccacattccaaacagattccattgtcataggtatacagaggaaatgtactcctccccctatcccataatataaggtgtgcacatatttcaatattcaactttaaaaacatttgatcaacaattattataaaataaaatgaattttatttgttaaaatttatatcattggattgacatttaaatttactttaatgtgattataaatttgttgcaataaaccttatagtatatgagaaattttaagtcaaagattagttttgaagattatgtcaagtttgaccatacctcttattatgggatggagggagtagtatacaaagttgtagttgaccattcatagtccttggaaagatatcaagcatcgagattagttcaaggttttttactgaataataatagtgataattaacgtgtatggttaaaactcttggcagccagtgcgtcgttgaagattaatttaagatcactgtcatacaactcttgtcaaacatggacatggacaacgcccaatagaaatctaatatttgtctgcctctcgatttatacagataagaaagtaagaataatgaaacttcaaattcaagaccagggtcgaatgatgccatcacggagaaggcgaacaagcaaaggagccgaagtacagtttctaagatcgagttaggtcttaagtagggctgtggagcagcataaatctagcctctatcttttttattttgtgagagcgttccattcagctttgctcttattttaatttgagttggaactgtttaactggactccagcttttgaaaagaaagaactgaaactgaaaatggcgtcaaacagactcttggagagcagactgtcatggtaagacttcttcacctggagctggaggggcgtcgcactcgtcgatactgctgcatcccacgccgcccctggagtaactgctggccttgttggaacgaggacctggatatcccacggacacacctctccctgcataaatatatccagcatatatatgtatagtccattgatttattcggttaattaattaccaacacaacactgtctagtgagtgatctacagtctttaactatttacctccttgagctgggcgcagggcgcagatgagagccaggagaatcaggagcgccttccaaatggagacagcagaagaagatccccgttgcttcctcatcttcagtttcttcgtctcactggtcgaacttgttgaaccttacctcttggtttggtgctcatcacaacttatagcgcctgcagtgctggggagtgcaatttgctgttgtatcctttactttctccgtccctaaccaaccatttttagatggacacagatatttaaaaagtagaccaaaatacttaaagatatattatgattaattgagaaaagatagtagatgatgaaatcaaaatagaaaatgattgtgattagttaagagaatgaaacatatgaagaaatagttttattttggaaaacgagattttgagaaagaaaagtgcattcaaacttttttttagaaagaaattgtgcgcgcggcggcgtagctcctccttccacggccaatttggcactagccggtagccactcacaggccacccaccacccattctcggcgtgtctcaatgtgtgtgcatggagcaatcaatcatggtggataactggatatatcatggattagtggatgttaaaagaatcttgacaatatataaggcaaagcttttatctttccttcaaaagagttaaaataatcttgacgaattgactttaccagcgtcaaatggacacactagccagcaggaataatggtgctgctacttgtagtggcggctttacaaatttttcgttggatggtcctacttcaggcctttaaaatttcataacacccaaacttagtatacatatataaaatttgttcaaattatcacacacatatagcattaatatcttattaattggccagttttcttaaagacaaagacaacaaaaatatctaccacacatatagcatattgcttataataagaagatattttgtataaacttttttctgaacgaactacccaaaatcaacttgaatattagcaaactacaaaatatgcataattacaaacatggtaaagaaggagttccaaagaacaaatatgagatataactcggatgtttacattccaaaacaaaaaaaaaatacaatcaatcatacgttgtataaaaaattacctgccattatgttctcgatcacttcttactatttctatttcttctgcttctccctcttcctccctgctgcttctgcattatgcaaacaagcaaagatacgaagggaaagggattcatgagagagagaactcaccggttaggcagcaagagaaatcaaccaatccctggatggaataaaaatttatgttctaattctaggccactgagtcggtcttggacaatgcagggtcttgagtgtggcaatcgcgacggatgtgatagcgactagcgaaaggcttgagctcaccaaatctgcaaccatgcacatatagattggccaaacaataaggcctttcaaaatttatttttcaagatatgtatctattgttcacgctagtcaaactagagtggtatttagctggcgtggtaaaacaatactgtcacgccagtctcgttgacgtgacagcgttatttggccacgtcgatctcgctaacatggcaacgttatttggtcacgccgctctcgttggtttagcgggacaaaactgtcgtacccattgcatgcgacttatcaatattgttttggttcagattttgtaaataagttttgaaagggtttatttttaaaattaaaaatttaaaaggttaaaaaataaaaataattcctgtagtaaacagtggagtagtatgtgttgtgtacaacttcctggctccttgttccatgatgtactcatgtatatgcagcacaagcataatacatgggacaaacacttgtttacttagaaaatgttcctatgtgatctgtaatacatgagtaaatttcagaaaactgtaactataataacaaaactatcagtttgctacaacattagtgatctatttcagt

SEQ ID NO: 73358 - DNA, 19907 bp, Oryza sativa
ggaatcaatcttcttctttgatttcgcttcgatctatttttcatcttcgatactgatattaccaaatttggtcgtcaacacatgcccccaagtccggaatatttggtaatgtttcggatttgccatatatcaactccgagtgaaattcgcaccttgtcgttttccgaccgttattccaatgctttaaatactaaccgttgccccctaaaaaatcttcactccgttacttccgtttttaccgcctaagccaactttgtcctttctctctccggcgatttctccgacgcacaaggcgatccccaagcgactccatctccggccagatctccgcccgcggcgatgtcgtcctccgccagcccgtctgccgcaccgtcggccgagtacgctgaggtaagttctcatcggctagatctcttttcctcgcaacagattgattttccaactcctcatctggttttcctcctctcggttcttttggatttgtagcatctctccaacctagttgcaatcaatcttcgtctttgattccgcttcgatctaatcttcttcttcgatactgatattaccaaatttggtcgtcaacacattgcagtataaagcaattgaaaaatcccttcttatatccaccttgaccttgatctacttcttcaagcccaggactagatcgatggcaactagctcggattgaagatgaacaacattggaccacttgatgtcgtggtcacaccattgccgcctgtgcctgcgccttcctccgccgcaacctacaaccagatccagagaagatgtggtcgtcgccagccttcgcattgctcgttgtcctccaccaatccaccaattgccagcctttgccttgctggctgcaccctccgccagatccaccgtcgccatggacactgctaccgccttctcgtcctctttgtcgtcgttgttgcgatatccctagcgctgatggggataaggagagatgcaccgcgggtggctgatgtgatgtgtcttggcattgagcttgatgtgccacatgcggccgagcggggcgcggtcgagcgacaccacgacgggcaggaggagaaggggcgctcgaggcggagaatgagaggaggaggaaaggagaaggcaaaggtgtggtggaggcaaaggcggaggtagcgaactggcggaggcaaaggcggaggtaacgaaccggaggctgcttgctcggaggattcgagattgggacgaggagtagtgggttggtggcggctgaggttggtggagagtgcggacggggagggattaaagactatgggcgctttggttttctcttttctttttgttttaatgtttttcgagcttctttcagttgatttttctccaaacgattcgtctcttgtgggcacacatcactgttgctacgtcatcatttataattgtaaactaaatgatactagcgctttgttgcgggatatatgtaaggtattgtgaaatggttaatgatttgggttgaaatattttaaaaatgatttgagaatgatgatttagcatgtgtatgtttagttctagaatgaaataaattgtaaaaataattactatatgctttgcatgtataactttgtgtgtttagtgggttgacgtggcatgcttgcatgttaggttttaggaatgctaataaatgttatgcttgcatgttgagctttaggtgtttagtgggcattagctttatagaaagaagagattagaaataagtagatatagtactattatatatttgacaatatattcttcaggtactaataataatttatatcttctaactacttaaaaaaattagtaatgtttcaattgtcaaaaaaaatcaaacggaaaaggtagttacttaacatgaaaattaaatagttgaatcggtttattcagtattttttaaagaaaaaaaaggtttattataacgtgattgattagctgcagaaattgttttcggtattgctaaaaatatgtcgccacaaattacgatagatttcagtcggttgtttcaaccgtcggatgcagaaatcgcgcatgtgtacgcatatccctccgattctgttctcttctgttctcttatgttgttttaacgtttgtatttgctaagtaggattactaattaaacttaaaagctaaatatttgtgtcatcacaaatttatagttttgggaattacatcaacttacacatgtaattttgagaattacatatgtaattttaggacttacatatgtaattttggaatttacatagtaaatacactaaaattacatatgtaatttaggaacttacaatgtaaatacatagcgactattttttggtgaaaaatatggcgccataaatatagctactccctttgttttttattaaactgccgtcaagtccgatcgagtgacgtcgtctgtccctgcactgattaacacatcgcgtaaggctttccaaaatttttttcttgggctttccttgcgctaaccctgatcgaactcttccaaaaatccctaagggcatcagcgatgtttattcccaaaccaagcagtaagtgtgggcccacctccaaccagcctatcacaagccttgttgtgacttaaaaaagtgaggtgggacccatcatattcccttactaccagcaataagtttgtaatctggtagtaactatttggaaggccctaagcgtcgggcgcccgatttacgtgcaaaaactactttcaagtgatttttctcttaaattacttattcaaatcatgatccgattgtaccattaaattcgttgcaattaaatcttcaaaacaagaccacacatggatatattccgacaaaaaaattttagcttattattgaattatttttaaatgttgcacgatgctccaccgggtatatcagaattgtttcactaagtagatcgaaactgtttcactcgtttaaatcgggtgttgtttcaccttatataaaaacaatgtttcagcaaatagcgaaataatgtttcagttcactgtaacatttgatccatacatagtgatatattataagtacactaggtgaaacatttttcggtggaacaaaaaataaaacgaattcccttaatatagggtttccaaaatatgtgggttttttgttacaatgaagtatttcagttcactgcaatattagatttatacatagtgaaacattgtgagtacactaggtgaaacatttttggtggaacaaagaataaaccgaattcccttaatatggggtttctaaaatatgtgaatttttttttgcaatagagtatatggtgaagatatgtggcaattagtatgaacacatagtggggtcctaggagaagcacatggacacgttgtggagggggggagcgtccgattttctccccctcccccgggcgaccgagcggcagcattttcgcaactatttactactctcacaatgtttattacctgataataagcacctatttaatgcttactcctactctagcactacattatcggcgtggattctctaacgggcgagagcaaagtcagaggctgacttaccccctctccgatgccgtccgaactccatccaagggctactgagtccctcaacgtttacagtgtgcatcagttagctcaggcattgttttagcccaaataagggcccagtacgggacacaaatgagcccagctcgagaaagaggatgcagagggttcagaaacaagcagcgcttggtacagaaagaattaagcaagcatttcagtttagaacttggtacagattcatgtcccaaataaccaaaataatatccaccaatggccaaaatggatttgtacatattaccctagagttttgatggtcactgaatttccatcaaaagcactgaattttcgataagtgctaaacacattcatgccaaaagaacaaaagagccttcctcatggagcagaaactaaatcagagatctaaacaagatcttggacagacatatcatcaatctcactggcaccctacaaagacaaaacaaaaaaattaaatacttattactaataagcatctggatgcaatcggatgcaaacaaaatccatgaatttcgaatgtaaatccaacttacttgtttggttctgcttgtgccatcgaatctccactggaatctggttccaccacctgcgatggcctcccttccaggcacggcaaccacgaaccctccggcgtcccggccacaccgctagccatgcgatcgacgcgcgcaacttcgccctttcctcgtcgccaagccgcgctacgcacgcgttccccgccaaaaatattctgcgcgctctgttccggcgccaaaatggcctctagtggcggcagaggagtctaattgggctttatttgggcgttgggccaacaagcgaatgtgaacagacttgctctgatagctgaacctgggcacgcccttggatggagcacggacggcatcggagagtggtaagtcagcctctgactttgctctggcacgttagagaatccacgccgctacattatggatgtcctaacgaaacacacacgaacatatcctaaaatcccattaaacaatcgaatctctggaaaaatcatgacttcacctggcaaaaataggcaagtaacttcaactaaacaaacagatggaggtgagaaataaaaaccaaacagactgctccttatcgctgcccggaatgatccacgtcgtcggtcgctgttcccaagctctgacgcgcggcgttttgatgggcccacaagccgcgtgatcatctccgccgccgctgtcaagcaaccgttgcctcccaagactagatccggcaagcctcaggacggatctgacgaggagggggcgaggagtaatcgtcggcagagaaggtcgaactgtcgccgtcgccgccaccgttgagggggtggcattggcaaagggggaggaagagcggcgccatcgctgactcggtggggggagagagagcagcggagaggggaggaagaactgcagctcgcgatgggggaggagaacagtgctggcggtgggggagggagagtgaccctggtggtgggaggcagggggagcggcggtggtgaggggaagggttggagggagtgagagcaaccgtatgagggagggtgaatttattttgtttatgcttttagggtgtttgaagtaaaattttggatttctctacaaattacaaaatacgaggactaaaaatagaaaatgataggggttgacaagcaaaattagaacacccctagagccactttgcactatggaagaaactgatttgagtccgcagtcttcatcttatgtgataatctgacggagccattgtacgttatatttgcaaacgaaaagtaatttgtgaataaaccttttatacacgtgttcttagcgatttaaaagcaaaaactgaaaaataaatttcgatgaaaaaacctcaaaataaactctaaatttaatgttaaaaatttaaattttggttgataagtataaatataaggaaaaaaatgaggccgtgagacttctcatagcagtgtcttttgtactgtgaattgtgaatggcctgatggagcactctaccactacggatgcaagatttcgtggtgccatagatatggtctatggaccgttggcattgacacatcgaagctttgaccataaaaccggagggcccattgcacaccgcggtgaaaagtactatctaactttcaggttataaaattttataatattgcctatattcatatggatgttaatgaatctagacacatatacatattcattaatatatatatatatatatatatatatatatatatatatatatatatatataaatgtggacaatgctataaagtcttataatatgaaacgaaggaagtaacagataacacacacgtacacgtttatgttcattggttatgccccatccaaggagctaagacaaaattaggctacaagatcaccggtgttgtatgcttgtgtacatgggtttgcctattcctctcccggacagatcaaagttttggaaattacagtaattttggtttgaattaaatttaaatgttaaacaaaatttggtcacatctatataaattttgctaaattcaactttaatgaaagattcaaaaaataattaggagaaatagtttcttgtcagaaggggtgacaaaatccagaaccttgatggtttagatcttgctgacgggtgggaatcaaccatacattttagggatacatagaaatacaaaacagtttgaattttttaagttattattatccaatatatataagtgaagaatattgtaacgccccgcaataatgtgaatccactttgaatttgataaatgtattgcttgtgaagtatgtgttcgcgtttgaggaaaaagaaaagagagaataaaagaaaaagagcaaagcagcccaacagcaggccttgggccttggcccatgggtgcagccagctcccagcccagcaagcaaagctagctagcagccaagcagcagcaacagcagcaaagcagtagcagcagctagctagcgagcacatgcaaggcaaccggcaggagctgtagcagtttagtgccaatctccaaaaaaaaaaaaagtttagtcccacctccgctagtttggagagatggcgagcacattaaatagaagggctgctcagtgattgtaactccaattctgaaatttttgcataaaagcgaggaaaaaaaacacagtgagttgtagtgctaggtgtggtccaactgtacgagatggatccaatatcgtttttgggcccggtgtggtggccgtcgcagattaggtaatcgttaggcttccaggatctctccctgcaacgtgtggtgacgtcgcaaattagataatctctaggcttccagtgatctctcccagtggcgtcacatattaggtaatcgtccagtggcggatctaggatttaggacatgggtggtccgactcaattgtgttttcaaacaccgtaacgtcgcagattaggtaatcgtcaggcttctagtgacctctcccagcagcgtcgcagattaggtaatcgtgaatcgtcaggcttccagtgacctctcccagcagcatggctgaaacgacgcagggcggcgtggccgaaacgatgcagggagaggcgtggccgaaacgacgcaaaaaccaaaatgacacagggagagcatggccgaaacgacgcagaaatcagtcgagggagaggcgtggctgaaacgacacaaaaaccagccaaaacgacgcagggagaggcgtggccgaaatgatgaaaaaccagtgacctctcctagcggcgtggccgaaacgatgcaaaaaccagttttctctctgaaagaactaaatgaagttagttctcaaaacttatctatgaaacaagttttttaaaaaatactaccaacttatcctatgaaaaaagattttttttaaaaaaaaaatactacctcccctatataaaatcggatgttattaagtacgattccgtttcgtttttgttgcgaatgcgcgcgcacggtgacgtggatcgatcactcgacttaattagcgcccacgcaccttacggacgcagccattgtgtgctgtcctatataacttcactgctgccgccacacccacaacataatctccccctctcttttccagcggagcaaaaagcctagcaaaatcttgcttaatcagtgagcaaatcctagctccttacttgcttatctccatcatattgatcggagcaagaagaaggggaagtcgatcgatcatggagggcaataagtccagcagcaacgatagcctttgtcgccatcatgccgaggacatcgaggagggggagatctgcaatccgggtggtggtgatgggtgctacgttttgggctccggcaccgaggaggacaacgaggaggagaaggtgggcatgcagccagtgacctgcaagtggtgccgtctcaaggacatcctcgcgctgccttcgcccatgccatcttcttctggttctgaggggacgatcaacgaccatggtgccggcaacgctgccgccgtgttgcgactggaggcatccccgtgccacttgtgcagcagggagttcggcaacatgaaggcggttcacgggcacaagagagtccatcaggtagagaactgttaacgaccaaatttggtaatccaaggatcgtaaatgaagaagaaaccgagatggaattcgagatggaaatcgtcccagaaacagagtgagtatcggctgaagtccgaatcggctacgactaagatcggcagggttcgagtcggactgggttagccgattgagccgaatccgacaaaatatgacgcagcatatgttgtcggtttaggttgacgtgcttcaagatgattgccacacatggatagagtcctgagaaggcaattgtatatattagttaggatattttatgtaatttccttagagatatgtttgggcaaaagtctgccgcaaagacttatggtattttagagtttgttagagataagagtcatgtccgatatgaacatattttgtaattctcgggtataaatagaccacgagccccatgtaatcaaactaacacacgttcaatacaatctcggcgcatcgccaccctttttactttcgttttattcgacgagttcttgcttttgggttgagctgcatcggtttcgatcttcaacaagagataaaacttgctatggcggcttacgttctcgggattagtgcttccatctttatgatactctaatcttgtttatgtaatacgtcgagttatcatatatcttacataatcttcgacgatatcgttatctaacctataatcggctaacatctgtcagaagagggcagccgattaggttaaataccgatgttgacttagattatatatgatatccaccactctatgaaattttcaacggcttgattatctagatattgtctttcttttcatacttatagctgcatcagttgagtttgatcttatgagtcgtgattagaatctcaatctctagcctgtctttggttattgccgattagagtagtatcggggtttcagccgatcttacctgatttaactacatttatcttatttgccttattgacatgttaaatctaccctttatgttaagatcttgttacatctaagtatattaggctttttgtttggtatatcttacttgctttaatatcttaatatagagtggtatcggagtattagccgatacacgctagatctatctgatcggctttactgtaaacacatatagtcttgttattaatatatatttcgatctaagtgatttatactgtctcggcacggcgatagatctatcccaatcacttgatttaagtatatatcgatataaggactatatatcgttaatatctacagtcgatcgagtagatctagttcttattaatgactgccgatcgatgcatttatgacatcggctcaaagataaatgatatgtcatcggcacttagccgatcggctatcgtttatggatttaaccacggtttctttgtctttgtttcttgttgattgtaggatcaaatcaactggcacgctagcatatccaaaggcaagtttttgacctgcactggagttaagcagatctcccggacctcgtgttttcacatcaacacgcttttggcacgcctggtgggactgatcagaagtcagaatcacaacaacgttttctcatggctgagaaaccgccggcatcaccgtcttcagctagtaaagatgattcttctaaatctaagacccagaagcctggtctatctgaagttaatgagagcaacatcatgcccatcactccggacaagttgaaacccgagcaacagaaggatcttgaggcaatgatgcagcaagcatgaaaccaattcttgaattcattcatggagacccaaggttcagaagtataaagtaaaagtaattgttgatgttcccgcaacaggttcttccaaggatggagaggtacaacaagttgcagatggtgcagctcaatcaagtgataaaggtgctgcagatggttttcaaggggttcaaggtgatggctctccaagggttcaaggtgtttttttcaaggaattcaaggtgacggttctcagggatttcaaggtgaaaatcttaaccaagatggcaacacggcacagctacagtttaacaacttccaggatcggattgattatgttgtgcaacatgctttgattaatcaatctggggtattagtcaacacattatcaaacatggtgaagtcgatggttgatggctcgatagctgaatatcaggctacaggactggtttatttgccaggaggggttttttcaaattatcggcccttgatcactaacaatcagccgactgttcagccagttcctcccaatgtaccatcggctcaaccgacagcaccagtatcggctcctgcacctgctgcaccatcatcggcaccaggtcaattaattaatccttggttgttggtgagagagcagccacagcatagtgggcagaatatgaatcggctaacctaagatcaagttacggctatgttcttatcacctcaacctactgttgacacaatccagcaacaaccgattcaacagacaccaccaaggcagcaggttgtgcatccgattcaacagacaccaccaaggcagcaggttgtgcagccgattcagcaaacgccactgaggcaacaggttgttcagccgatttagcagcaaggtttgataaatgcatcagctgggtttggaacacctaacaatcaactagcacgctagcatacccaaaggcaagttttggacctgcactggagttaagcagatctcccaggcctcgtgttttcacatcaacacgctaaggcagcacgctgcgaatcaagttgtcccagagcatttggttcataatgtccaaccagaccaaacggtgatacctcaagttgttcccgaacatttggtgcgcaatatacagtcaaactttcaaaattaccaggggccaatttgaattatcagtatcagcctccatcgccgcaaactcaatatcagcaaggaggaccggctcagccccagtttattcctcagtacaatcaattcgagcctgttccacagcaagcacaaggagcgcctcagcaacgaccatggacagatatgattgcagatgtaatgagggaacagtttgggcttaagccgaaagatgctggaaatttgtatcggcatccttaccccgagtggtttgagagagttcctctgcctaaccgattcaaagttccagacttttcaaaattctcagggcaggatagtgtttcaacctatgaacacgttagccggtttttaactcagtatggtgaagcatcggctgtggatgccttgagggttaggttgtttccattgtctttatctggatcgactttcacttggttttcttctttgccatgtgggtcaatcaacagttgggccgatttggagaagcattttcatagttatttctatagtgggattcacgagatgaaactatcagatttaacagcgattaagcaaaggcatgatgagcctgtgcaggaatacattcagaggttcagagagatgaggaataaatgctacagcttggccttgactgatgctcagttagccgatttggcttttcagggtatgatagctccgatcagggagaagttctcatcccaagactttgatagtttgtctcaccttgcgcaaaaggtaaaccttgcatgaacagaggtttgcacaggccaaaaagaactttaaaaaggttaatcatgtctgtccttacatatatggatcggatgatgatgatgatgatgactccgaaatagcaacagccgaatgggttacaagcaagaaggttataccatgccaatgggtaaagaattctggagaagaggagaggtatgactttgatatcaccaaggctaataagatttctgatttgctacttcgggagaaacagattcaacttcctgctggtcatacaatcccatcggctgaagaattgggcaagaaaaggtattgtaagtggcataattctggatctcattctactaatgattgcaaagtcttcagacagcaaatctagccggctattgagggaggcaaaatcaaatttgatgattccaagaggccgatgaaggtcgatggcaatccttttcctgttaatatggcacacacggttggccgaacaacagatggaggaagagccaaaaggtttcaggggaattcggctaaattatcaagaagtatcacaagaagtctgacaaacaataaaagaggcattatgaagaagatgatggcggttttgatcctcaatggggctgtaagttctttagattttgctggaattaaggtatgagggtgccatttattgaagactgtccttaaggcaagaattgtgcaaaaatttccagtggatccatttaatagaagcaatcggctaaagcaaacaagggttcctgtggatcaaaggttgggcccagtgaaccaagatcgtaaccaaaaggacaatgaagacaggaagactcaatggtgtccttctggtatctttacaaaaaatcagaagagaagggtttaaaggttgaggaactggaagcgctttcaggaggttgagcaagaaatcaatcatcggttgaagaaggcgaagccgagacaggtgtggcgtgttagaaatcaagctcctgtagccgatgaagccgcagccgatgaagcgaagatgttggctaaaggaaaaagtgttgtgaccgcatcggttaacatggttttcatattgcctgctgaatttggggtcaagcaagccgatgtcgatgaagttgaagaagaatcggctaagttgattttatcaccagagcaagcagtcttcgagaagccagaaggaacagagaatcggcatcttaaaccattgtatataattggctatgtcaatgggaagccgatgtctaagatgatggttgatggtggggctgcagtgaatttgatgccttatgctacatttaagaagttaggtagaaatgctgaagatctcatcaagacgaatatggtgctcaaagattttggtggtaatccatcggaaaccaaaggagttttaaatgtggagatgatagttggcagcaaaactatccctacaacattctttgtcatcgatgggaagggttcttacagtgtcacgcccggaatttctatcgaaaattccaaacgcttacatgtgtgtaaaccctcatccaggaatcagccgaggcacacaataacaaattgataatagagtgcaattattactctaattaataagcgaatataaagtcattacagtggtagatagttcctctcaaacaataaagttctaagcatcggaaaataagataaacggcgcagacgactccatcccacaagcagcttgaccagggctacacctaatccaccacaccttcggcatcactgtagaattcctcctctgatgaatgattgcaaggtgagtatatgacatactcaacaagccacgcagcaaatatgcaaatgcaagggataacaagggatggcataatatagtctcatttgcataaatggcatttaataaatacttcagaatttaataaaacaataatgtatttaattaagcaatattaatccatcgctatacaacatacccgttgcataggcccaaccattccgaacaaccaatcccggctgcacagttctatctccaaaccaggaacataccattccaaacctggagctaaacaagttattaccaagtacaacatcatttattatggtgagaggtgtgaaactaatcacgaaagacattgttagaccggcccataaccgcgggcacggctattcgaatagttttactctggctagaggtgtaccactgtacccacaagacacaatctcaacgtcatgtcaaccatgcgtcgcgatacttaacaagtacccgaatagagattgtgacaataccctctgcataacacaattcaaagcaatgcaccgttcctggatcataatcacccccttaaacaaggcatggactccccagcgacccccgtgggcttatctctgccacttcacagtctggtgctctacaatgaaccatactatacagaaagtaaagccgttgcccacgctggcttgtggttggcacggttaatgtttcacaaccaaaaatcgtgaaccggtccttaattgtcatgagcacgaccatcaaaaccatgtgctcacaacccaccattatcagttttagttggcaaattaattaatcatcctatcatgattaaccatcatgagctatcattaagccatcattaaataatagtgaatcataagttatcccatttatatgagctaatgtctctaagcatggctaagcatcctaagcactttagctaaaaccatataatgttctagctaatccaaatattaaccaaacgataaagaataggtaatcaataacaaaaaggctataacaaggcaatgggttattcccacccaatgacattcaaaaataaatgcaatagttgaatagaaaaaaaaagctttaaacgggatcaacatgctcaaagggttgtttggaatctgtgtgacttgccttgctggccttgaaactcttcaaagtcttctcctgcaaattcggactctccgggaacgtcggaatctaaggataaaagagcaaaatcaccaaaacagcacataaacaatcaagaacagtacatatggatatttttaacatgtagctctcaattttagaaaaatttagagacttgaccaactaaatccgagctaagatgaattagttatgaatttttaaagattaaatcagattaaatcatttatatagattttaattgaattatgacgcaataaagaattatttttgagaaggaaaaaggatttattgcgtcagcgggctcggatttatggtggaccgggtgcacggagacggtctacggaacggacggccgagattgaatctaatccaaaacgaacggccaagattgaatcagtctaccgcgggtctacgggtgacgcggcgctgacatcggcgatgacgtcatcaccggcggcggctcacgctcgccggcgaacgacggcgcggcggcgcaaatggagggcacctacgcgtagagggcgatgcggcgaactcaccgaaggctcagacaacggcggacggcaacgaacggtgacggctgcgaggtcgaagtggcggcggcgtttgcgtcgacgacgacggcggtgctccggcgatcttcggcggaaatggagggcgggacgaggacgacgacttggcgatcccaacggcggccttcccgagcgatgacgacgaccgtagcggcggcggcccacggctgaactcccctcgacggcggcggcgcacgggctctagtggctagggtgctacgggcgatggcgagctaaagcgagggtggtggcggatagaggaggtcccgggagtccttttataggggctagggggcggcgatgaaggcccacggtggccggcggcgagatggaaagtttagggttagaggagagaaaacgaatccgaatcgaactcgaatccaccgatttccaaacaaaattagcaagagattccaaaagagaaaaggaagaggggatcggggaaggcgtgatcgaattttggaaggaggcggcggcggcttgcgcggctagggcacggctgcggcggcgcgaggtagacgacggccctgacaggtgggccccacctgtcagcgggagagaggagggagagcggcggctcggctcggcgagctgacttgggccgggcgcgcttgcaggccgaagagagagagagaggggttttgggccgactttcggcccaaagccaaaagagggattttaaaacctttttctatttaaattattcatgaaatgcaattccatttattaaaaatacttccttggctcaaataaatcccagaaaaatctaggaactatagaatcaaatgaagtatttaataaaattttatctagcccatttttgtattggaatttattatttaaaattagatcttttcttctaggcttttaaaatcatttctaataattccaattaaacaaaaatttatacatttagggatttttagggtgtgacatacagcttgttgcttggaagggattagattcatgccaattgttgtattccttcaaccatgcatcaatgcttgattcagtggcaaggcgacaagattgaaattgtgccagctgacaggtcagttaatgttgccagtgacgatttagctctttgggagatggatggtcttgattgcttatctggaaaagtttgggatggacatttttttaatcaatttttttgagggtgtcgtggagggttcaaacgtctacaccaaggacacagtagatgatctcgatgacaaacaaggacagggtttcatgtcggccgatgatttggaggaaattgatataggtccaggcgatcgaccagggccgacatttatcagtaaaaacttatctccagaatttagaaccaagttgatagagcttttaaaagattcaaagattgctttgcttttgtatattgtgagatgccaggactcagccaatcaattgttgaacatcggctacctatcaaaccaggggttagaccgcaccagcagcctccgagaagatgcaaagccgatatgctcgaacctgtcaaggctgagattaaacgtttatatgatgcttgttttattcgtccttgccgatatgctgagtgggtttctagtatagttcctgttattaagaaaaacgacaaggtccgggtgtgcattgatttcagggatttgaataaagctaccccaaaagatgagtatccaatgccagtagccgatcagttagttgatgctgcctcaggacacaaggttttaagttttatggatggtaatgcagggtacaatcagatctttatggccaaagaagatattcataagacaacttttaggtgtcctggtgcaatcggcttatttgagtgggttgtaatgacttttggtttgaaaagtgctggggctacatatcaaagagccatgaattatatatatcatgatctgatcggctggttggttgaagtctatattgatgatgtggttgttaaatctaaagaaatagaggaccacatagccgatttgaggaaggtttttgagagaaccaggaaatatggcttgaaaatgaacccaacaaagtgtgctttcggtgtatcgtctggccagtttttgggatttcttgttcatgagagggggattgagataactcaaagaagtgttaatgcaatcaaaaagattcagcctccatagaacaagacggagttgcaggagatgatcgacaagataaattttgttaaaggtttatttctaatttgttcgaaaggttagagccttttacaccattattaagattgaaagacgatcaaaagtttacttggggggtagagcaacagaaagcattggataatattaaggaatatcttagctctcccccagtgttgattcctccacagaaaggggtacctttcagattatatctatcggctggtgagaagtcgatcggctcggtcctgattcaggagttggaaggaaaggaaagggttgtattttacttaagttctcgactcttggatgcagaaaccagatattcccctttggagaagttgtgcttgtgcctgtatttttcctgtacaaggttaaggcattatctattgtccaacgaatgcactatcatatacaaagccggtgttgttaagtacatgttatcgcctccaattttgaaaggaagggttggaaagtggatattttccttaacagaattcgatcttcggtatgagtcactaaaggcagtcaaggggcaagctatagccgattttattgtcgatcatcgtgatgattcaattggctcagttgagattgtgccatggactttattctttgacggatcagtatgtactcatggttgtggtatcggcttagtgataatttcccctcggggggcatgttttgagtttgcttacacaattaaaccttatgcgaccaataatcaagctgaatatgaggcagttctcaaagggttgcagttactcaaggaagttgaagccgatgctatcgaaattatggggggattctttgctagtaatcagtcaattggcgggagaatatgagtgcaagaatgatacattaatggtttataatgagaagtgccaagaactaatgaaggaatttcggctggttactttgaggcatgtatctcgagagcaaaatattgaagctaatgatttggcccaaggggcatcgagatataagccgatgatcaaagatgttaaggttgaagttgctgcaataacagccgatgattggagatatgatgtacatcaatatttacagaatccatctcaatcggcttctcggaaattgagatataaggcgttgaagtatactttattggatgatgaactctattaccggacgtatgatggggtgttgcttaaatgtttgaataccgatcaggctaaggttgcaatcggcgaggttcatgaagggatttgcggcactcatcaatcggctcataagatgaagtggttgcttcgacgtgcgggatatttttggctaacaatgctggaggattgtttcaaatattacaaggggtgtcaagattgtcagaagtttggggcgtttcagagagcaccggcgtcggctatgagtcctatcattaagccatggccatttagaggttggggaattgatatgatcggcatgattaatccaccatcgagtaaagggcataagtttatattggtggcgaccgattattttaccaagtgggtagaggcgattcctttgaagaaggttgattctagggatgctatacagtttgttcaagagcatataatctatcgatttggtattcctcaaaccattacagccgatcaagattcaatttttgtatctgatgagtttgttcagtttgccgatagcatgggtatcaaattgttgaattcttcaccatattatgcacaagctaatgggcaggccgaggcatctaacaagagtttgatcaaattgattaaaagaaagatttctgattatcctcggcaatgacatgctcgtttagccgaagcgttatggtcttatcggatggcttgtcatggatcgattcaagtccctccttataagcttgtttatgggcatgaggctgttttaccataggaagttagaatcggcttgagaagaacggaattgcaagatgatttgacagccaatgagtattataaccttatggccgatgagagggaagacctggttcaatcgcggttgcgagcccttgcaaaggtaacaaggataaggaacgagttgctcggcattacaataattcggagggtgagcttgtatggaagttgattttgccaattgggactcgggataataaattcggtaagtggtcaccgaattgggaaggaccgttccaaatctataaggttgtgtctaagggagcatacatgctacaaggactcgatggagaagtctatggacgagcactaaatggcaagtacttgaagaaatattacccaagtgtttgggttaacgcatgattggctgatgttgccgatacatgatagccgatgtgtttgcatcgccttgagatggccaatattgttatatcgcccttaattgttttcatattgtaatcggttgtcgtttgccgatgtacaatggtcgatattgttatgtcgcccttagttcaagctataattttatcaatgcttttgacattgtaaaattaggggggcacatatatgaaaaattgcaaatttttgagcaaaatatggagttatgttgaatcggcatgaaagttattaagataatttcaatgaagagtcaaagttttgttagccgattacaaaaattcctaa

SEQ ID NO: 73359 - DNA, 111839 bp, Oryza sativa
tgcatccgggcatgagcacattttctgggggccatgtgtcactcacaccttgaaccttatattcaaggatttctcaaaaaaatttgactggatgagtgatacatacagcaaagggaaagctattgtcaagttttttcagaatcatcagcattgccttgcaatgtttagaagtaattcaaagttggacctacagaagattaaaaaaactcgttttgcttctcactaccttttgcttttgaggctcactaaatgtcaagaagcacttgccaccaccatagtcaccaatcaatggaaagattggatgaaaggttgcaccaatgatctgcggcagcaagcaagagccattgttcaagaaatcaattgtgaggacttttggaataatgttgagaatattcttgctatcacaggtcctatatatgaagtattaaggttcagtgatggagagggtccaaaaatgggtgagatctatgagagaatggattgtatggttggagagataaaggatatcatgatgaaagatgacaatccatacaaaagttcctttccagagatagagaacatagtcattgaacgttgggaaaagatgagtatcccacttcattgtttggcttatgctgtttgcccaaggttttatgatcaaaattatcttcaaaaacctgctcccggtggcacattaaggagagcaccgaatcaagatgttgaggtcatgacaggtgtgctaaaagcatttgagagaatagcagataataaagaagaggaaaaagtccttcgcgagcaactcaatgactttattatgaagaagggattttttgcactagaatatgtgcaggccgatgcagcatcgatggaaccaattgagtggtggtgcagctatggatctgagacaccagaattggcagaggttgccaaaagggttctctcgcaacctatcagcagttcatccgctgagaggatttgggggacttatcagttcatccataatgcaaagagaaacaaactaaacgctgcaaacgcggataagcttgtgtttatccactcaaacttgtgtcttcaatcaagatttactgaaagctataaatcagggcctaacgccatgtgggatgcacatcccgaagactccaccatctaagtggtaataagcatatgttaactgattatttatttatttatttttcataccttggcaataatgtgcatatatagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccatatgttatgtgtttacaggaacatggaaagatcatatgagtgctacactgctactacagaaaagaccttcatggtgctgttgtgattcatgaattcatgatgcttgctgccagcagccacccatatctataatctatatatgaagctcaatttgtaataatttattctaagagcttttgttacactttgctataaacttgagttaagtttcttgttaaaaaaatcattgaaacaatattcttgactaaggttccacgttccatgctatcattccaacaaatataggaacatgttcctctagtagggtataccgttccagataatcgttccgaacaaccaaggaacacgttccatccatagttccgtagagttccggattatcgttccaaaaaagctaggaacacgttccacctatagttccgtacttttggaagaggtataccccttcgttccatgtttttggaaaatggcgtcccgcgctccacgttctagttcctcgttccatcgatccgggaacttttgtgacttaggagccggtttgagagttgttgtttctgatttcttcttcacagcaattctttttttctacaaagacaagattagtgaataatcggctgaggataaaatagttataaaagatggatcctagagaagtgagctggagcagagggagtcggaggagtttgtttaggtgaagccgatggagttctttcagtatcacttacttcatctgcggcttgatcaataccctctccgatctcttcttcatccagagcttgttcaatagatggatccagggcaggcagatcatcggttggcttagtcttctttaatttggccttcttctttggggctggagccgatgtatccacagccgatgacctggttcttctgtttttaccggcatcggctggttctctgatgagccattgaagaagagttgaagtcttgggggcattatagccgatgacaggaggagatggcccacctccatttggaattagacctagggcatattcgatatctctaccactattgctttgatgtggaggggaagattccattctctgcaaaacagaagagaagattagtcaagttatgaatcggctgataattgttcaaatgaaattaataagatcaaggtttacctgaggtataacatcaggaaagagatctgtcatatacattgaggccggttggtggaacagatgcaacttccattcaccccaccatatgtcaaatgatctgctcctgaaccttgccaactctatattctcaatactacccaaaggaggcccttggagattaagcagtcgatccatcatcaaggttgatgaaatttcccctcggcattgaattttattggcaaagaacaaaccgattggtagttgtcccatcccaagttgtctgacagcactcatcggatgatagaactcataagaaatttgaatattccttccttgatgaatgccaacaaggaggatgcatggactgattgcaggcgagaaaacttctctggacttttgatatctttcatggttgatgtcctcaaatctaaagtccgatggattttccaggagagtcgagtcttcataggagaaccaaatccgagcgtctttctgaaagccatcataaaaactgcagaaccagtccttaagcagttcagctgatagctttgctcctgcatcggctggtgtggcatattctccataagatgtgcatctacgatgggtgcgttcctctccatcatcttctacaatcggctccagtcttgggaattcggcttctgtcacagatggccgattgacgaatttcatgaccatcagattcaaccaggattgtaataaccaccatggtccacctgccccaactactgagccgatggctatcttagccgatgcattattcagcatttggtacaaatagccgaagaggatcttgcctaaggggaattgtctctttgattccaaggcctcggctacaaactgccagttggttgtagggccgcagcttaatccacagaagagaaattcctccagccacatcaacagaaaggctacatgctctcgaggagtgacagaaccttggcccacatatgctgccacataacctgaccagccgtctatgctcttggtcctaaaatcatactgattcttcatgttcagactcatagagttggccgatgaggtgacatctagaccggtaatcatggtgatatctattagagttggggtcatcggcccttggttgaacaagaaagcattgatggtgttggaccaaaaataggaggcgacagccattaaaggttcatccttgtcagaattagctatggtaaggtcaagcgcttggccgattccgatttcgtcccaatgaaccctcttgctagccgacatacgcttgaaccatgtaatccaactcttctcgggtgaagttttctcgagggatggccaagatttaaaggtgttcttctagtgacctagatctgggttggccaatctgaaaggaatcctattggtttcgccgatgataaactcggtaggatcagggttgccgactgggccgaggaagtaataatttccgtgcgataggcttgtaattgcaactaggttggagagatgctacaaatccaaaagaaccgagaaggggaaagcgggataaggagtaggaaaatcaatctgttgcgagaaaaggagatctagccgatgagaacttacctcagcgtactcggctgatggcgcggcaggcgggctggcggaggatgacatcgccgcaggcggagatctggccggagatgagatcgcctagaaatcgcttcgtgcaccgaggggatcgccggggagagagaagacggagcttgcttcggtggtgaaaacggaggaaacggtgtgagatttctcggggacaacggttagtatttaaagcactgactaacggtcagaaaacggcacgagaggatttctctcggagtcgacgtatggcaaatccgaaacattatctaatattccgaacttggggggcatgtgttaacgaccaaatttggtaatccaaggatcggagatgaagaagaaaccgagatggaattcgagatggaaatcgtcccggaaacagagtgaggatcggctgaagtccgaatcggctacaactaaaatcggcagagttcgagtcggactgggttagtcgattgagccatccgacaatatgacgcaacatatgttgttggtttaggttgacgtgcttcaagatgattgccacagatggatagagtcctaagaaggcaattgtatctattaattaggatattttatgtaatttccttagagatatgtttgggcaaaagtctgccgcaaagacttatggtattttagagtttgttagagataagagtcatgtccgatatggacatattttgtaattctcaggtgtaaatagaccctgagccccatgtaatcaaactaacacacgttcaatacaatctcggcgcatcgccaccctttttactacgagttcttgttttcgggttaagctgtatcggtttcgatcttcaacaagaggtaaaacttgctatggcggcttgcgttctcgggattagtgcttccatctttatgatactctaatcttgtttatgtaactcgtcgagttatcatatatcctacataatcttcgacgatatcgttatctaacctacaatcggctaacatctgtcagaagagggtagccgattaggttaaataccgacgttgacttagattatatatgatatccaccactctatgaaatttccaacggcttgattgtctagatattttctttcttttcatacttatagctgcatcagttgagtttgatcttatgagtcgtgattagaatctcaatctctagcctgtctttggttgccgattagggtagtatcgaggtttcagccgatcttacctgatttaactacatttatcttatttgccttattgacatgttaaatctgccctttatgttaagatcttgttacatctaagtatattaggctttttgtttggtatatcttacttactttaatatcttaatatagagtggtatcggagtattagccgatatacgctagatctatctgatcggctttgctataaacacatatagtcttgttattaatatatatttcgatctaagtgatttatactgtctcggcacggtgaccgatctatctcaatcacttgatttaagtatatatcgatataaggactatataccgttaatatctacagccgattgagcagatctagttcttattaatgactgtcgatcgatgcatttatgacatcggctcaaagataaatgatatgtcatcggcacttagccgatcggctatcgtttatggatttaaccgcggtttttttttgtctttgtttcttgttgattgcaggatcaaattaactggtacgctagcatacctaaagacaagtttttgacctgcactggagttaagcagatctcccaggcctcgtattttcacatcaacgagaacgagaaaggagagccaccgctgccgctgcctgcggcggcagcgtgggttcatcccctggctcggttacctagagtatcacgatcaggtggaccgtacaggtgcaagtacgagggttgcggcatggagtataagacacaccaggggatgggtggccacgtggctggccacatcaaacagggacaagctggctgccgccggcggcagtggcggcgccggtgccggcaagacggagggcaagcacccgtgcaatgtgtgcgggaaatagtaactgacaggagtggcacttggcggccacaagagggagcactacaataagtaccttgaccttaccctctcctcgcgccacgcggacaacttgcggcgccgcctacacttgctccagcttcggcggccatcgccgcggcggtggcattgccactggctgagacagaaacggaggtggctaaacatggagatggagcagggacagtgttggcgcctccatcaatcgttgtgcggatttttggcgttgatgcggaggaacaagacggtggaagcgactaaagaagattaaaatatacccagtcaaacagtatagtagtggtgattttagatacttgatgcagctactgctcctttgttatttagatagtgatggggattatgtttatactttaaacaacgtactgatatcatagggatattatttacaaagagaaaatatatctttggttgtgtttagtccccttcaaactttcaaaaattccgtcacatcaaatatttgtacatatgtatgaagcattaaatgtgaacgaaaaaaactaattgcacagtttacatgtaaattgcgagacgaatcttttgagcctaattacgccatgatttgacaatatggtgctacggtaaatatttactaatgacaaattaattaggcttaatagattcgtctcgcagtttacaggcggaatctgtaatttattttgttatttgtctatgtttaatacttcaaatgtgtgttcatatacttaaaaaaattttaaaaaggaactaaacaaggccttcttttagaagttcttagagattatgtttttagagagagatagtatacacgcgcactatattgccgagtaaggaaggggatgcatttatctaagataaagaagtggattctaaactctcgagaagatatcccaaatagttatattatttttttaaaaaaatagaaagatatattaatatgtgatatatcactctttaaacacgtaagttaaaattcaacttttacaggtcttagcgaaaaaaagctatagcgttaatacaaaattatgagaaagaatcgtaaggttccattcttaggaatttggactagtaagcacactttccaaaagcccatagtgctccgatttttttttttgcaaaaaatctttcttcattagtatttcttccaatactttttcaaaacaatatttttaaactctgtaatactccatccattttatattataagactttctagcattactcacattcatatagattttattgaatcttaacgcacatatatatagattcattaacattatatgaatgtaggtaatgctaaaaaatcttataatatgaaacggaggaagtagttaatttatccatttgtgcctttgaaaaattatcatacacataatcatgtattcaaacattttttttaagaattacacttatagatattcctatctctttgcgagtgtaagaaaaatattaaagcataacaaaaatcccaaatacaattttcaaatcagagtgaggtgccaaacgcaaacttgaccagcggcagtgccaagcgcccaagcttctaaaaaaacaaattagactgcaaacaaccttggcacccacggcgattagccaattgcagccttggcacccacggtaattctaccgtacctgcccatgctgtcgtcatcccaccgaggggagtcaaacgcccaaaaccatcaaaaccctcttcggctcggcccaaacccctatctaccctaatccatccgccgccgccgccgccgccgccgccactttatgctcgtctgcctccggcgacgaggcctctcgctcctccggcagcgcccgccccgccccttcccccctctcccgcgcccgcgcagcagcccaccccgcgtcgcctccctccgccccctctccgccgcggcgatgggggagaactccgccgccgccgccgggaaggggaaggaagcgaaggggaaggcgacgacctcggcctcggcctcggcaccgaacgtcgagcccgacgtggcctaccttgaggcggtgacgcagaagcggatccggcagttcgaggagatccaggccaagcaggccctcgagcgcctcaacatcggaggcgagcccatcaggtgagccccgttctgcgattcgttgtgaatttgatgtagttaagaaactgggagggctttgattcggaaaccgtaatgcttgcggcgcgttatagatgaaaatggagttagatactacatggatggcagatgtctcaggcattgagatgtagatataggcatatagcacaccaagggaatatcctcgatagccatgctttgtgctgcataatttggagtcggattttgagtgttgggaatatttgaatgtcgatgcgacgacaaaatgggcgctgcgcaaactgcataataatgccataatgttattcaactttaacatccatctgtctttaataagaaaatagagacggcaagcatttcttctgcctaaatattctaatatagaaaacccttgattatatggtgcttaggtttccttttctcaatgtacctttgctagttacaatacaaatgtggcacactgtgacctgcaatgtgcagcacaatggcaatggcaattaattcttctcatgtgatttttttccctgcaactttcttcaggataactttgccagatggtgcagtcaaggacggaaagaaatggatctcaacccctatggatattgctaaggagatatcaagtggattagcaaatagctgcttgatagctcaagtgaatggaacactgtgggatatgacgaggccactggaaggtgattgtgaattgaagttgttcaagtttgatagcaatgaagggcgtgacaccttctggcactcaagtgctcatattcttggagaagtgagttaaagcttcataatttccttgtatcatgtttttttctttaagcaagttgtatggttgtctctttttcttttttgtttacacatcgagtgattttgcatgtctctctgctataagtccttttgaattcagtattttctaattgaagatgcacttttgcagtctcttgagagggcatatggctgcaagctgtgtattgggccatgtactacaagaggggaggtattgaattaatcaaaaatcgtgttcagtgcaagaaagataataagccctcttagtgattaacataatgtttctacttttacctgttaagggtttctattatgatgcctactacaatgatctgacattgaatgagacacattttggtatcattgatgcccaagcacagaaagctgttgcggtatgctcttattttgaactcattttaaagtttgtgtttacccttttttgtggacgctacttagcagttttactctttgacttatttgatattaatctgtcatgaagtgtgatatcgttattggattccatgattatgccatgttttctttgtaacgtaattggaatcatctatctgctaactcttggtttttaacccaacatggtgcaggaaaaacaaccatttgaacgaattgaggtctccagggcagaggcccttgaaatgttcgcagaaaataaatttaaggcaaaattcctgatttatgcttgttcttgatcttttcttgtactctaacagtcccattgtttcgcttattcatatgcttatccgaattgcttattaacaaacaaaaaaaatcatttgtgactaaaacgactcaaaagaaaatgctgtaaaataaactataatgaaagaaacaagaaaaaaattaaattaaattaagttctaaatttcaaaacttgacttataagcataagcataagcgaattaatgaggccctaaatatctatttctgcttatatcacatttgagattttattaaattttttatttgtttgaattgtgtttctaggttgaaatcattaatgagttgcctgaagacaagaccattacagtatacagatgtggtcctctagttgacctttgccgtgggccacacatccccaatacttcctttgttaaagcttttgcttgtcttaaggtaattctttggttgtcttaagcttttgcttgccaatatttttatggaactatccaatttgtacttgcatgtaaatatgtaggcatcatcgtcgtattggagagggaaagcagatcgagagagcctgcagagagtatatggaatttcttttcctgattctaaacgtctcaaggtatagcatatgattttggctattgttcagatatgggcgttcattaattaatgtggagtctgtttttgtgctatcatgtctgtgctactggacacaataatgtaccctctatgtttgcattttagacactagagtattaatatttcattgtgataagattggagttgatttggcaggaagtttagcgtgcactacatggcatgtaaattgcacaaaatatacaactatatctcaaaagtgtatctatgggctctgtgctttggtggaggttggggttgatttgcccaactgaacaacaattgtcattacagaagtatatggtttctttttattagtcagttattacgaatttcttcaattaatacatggttaggttcagacagtgcaacccttgtcagctattttacaagttactaattcctaagttcttttttatccatttgttttatcactggtacactatggttttcatatatgtttcctgctcaataatccataggaatataaacatctgctagaagaggctaagaagcgtgatcataggctattaggacagacccaggatctcttctttttccatcaacttaggtaactcaaggttttcggtttgactttttcatatcttaatttaccttggcttctattctgcctcaggatgtttgattcactttgactgtgcagtccaggaagctgcttcttccttccacatggtgctataatatacaacaaattgatggattttttgcgacagcaatacagagatagaggatatcaagaggtgggcattaatttgattggctggtcaatcttttgttcagattatgattagattactagatcatgggcatgcatttccactgtttctctctgttcatgatgtctgtattttcaggttttgagcccaaatatttacaatatgcaactctgggaaacctctggacatgctgcaaactacaaggagaatatgtttgtttttgaggtaagtctagtgtgcagaggatttgctctgtacatattatagattacattttggatgaattacgatctttattactgggtgcttgttggtcttattcttgcagattgagaaacaggaatttggtctcaagccaatgaattgtcctggccattgcctaatgtttgagcacagggttcgttcatacagaggtaaatctccttcataatggcatagttgtatcacaaaatgtatctcttttatcaagtgaaaattcctgctgtcaaagtaatcgcttcaaccttctgcctgtatgaactgtttttcttctatgatttaattctccctctatttctttgatattgtgcatgcacatttattatctagtggcttgtgctttctcattaaaattttcataaactgaaaatgtaggcagcaaaaacagttccttagttgtctggcaattaaactaggggtgggcataattaaccgtgacgaagaactgaacccgaaatgacccaaactggaatccagtaaaaatatcgggcttcagctctcaataactgaatttagtcctgttattttggttattaggctcgggtaattgagaaatcgaaacatatcaataagccttgtccagttcagcccaagagagaaaaccctaacttcccctcacctccccactcttaactccccagtccccacttctcctaccactaccccgactcctcccacacacggcaaacgctgctgttgccgccccgccctggctcccgcctgtgcccccacagcatgctgctgtctctgcaacactctgcctccgttgccgcaattccacgccatcaacagtggggaccaccttcaccagagatctcaaggaggctctcggtgctctgccacgccggagagctcaaggcggcggttgctggggaacactggtgtcgccaccgttgtgaacatgcggttccctgcccatggtcccctgatggcagcggattggtggacacgtctatgcccgctggctacatctcgtgctctttgctccaaattgtgttgatttgaacttcatctatgtagggtattgtgcatagatctaatttgtgttgatttctgttgattctgtggctgattttgggattatatgagttgattctgtggctgatttgagtattctatgatttctttttggatgtgtaaaacagcagttgtaatatcttggttagtttggtcacaaccggagaccgaactgaactagccgaaaccgaattcgtcagtattcatttttttttccaatgtgtttcggtctctattttcagatgaccgaacttttcaaaacaccgacgaactgaaccgaatgcccacccctaaattaaattcctaattcggcaaaagtaacggctctagaattacttagtgaattgttttttggtgaatgatgtagtactgaaattgttgtccacatgtacattttgaactattggcttttgctattgatataaatgatgaacttcccttttctaatattatagcaaggggaattttatatatgatgtgttgtgtttttgtgttttgacaacctttttcttaacactaacaacttaattaaaatgctgcagaattgcctctccggatggctgattttggagtccttcacaggaatgagcttagtggtgcacttacaggtttgacacgtgttagaagattccagcaggtaatgctaatgttgttttgtgggttgttaatttctatactaattcaatccagttagtaatctccttgttttaaccacttctgatgcattttccctgtaggatgatgcccatattttttgcagagaaagccaagtaagtttgaattctgcaccattctgtatatctgtttttagtagggaaggggtgccattgcaatcataatgacatgctactgaacagtgtatttacactgtgtgacataaattagtttaggcaccagaagctcataatatttagatgttcatgacttgcatactgtatggatgctagtttgtattcccatttgttttcacaatgtttcagatggtgttaatcacaacctccttttaacagctgcactgtgcttcggataattttaaatagtgtcccctgattgtataagggcctacttttcttaagagttctttctttgttgcagatcaaggacgaagttaaggctgttttggacttcatcaattatgtttacgagatatttggatttaaatatgaattggagctatcaacggtaatcatctcgttgttgctgtatgattaatagcatctagaaattcacaggaactaggattcttggaacttcaatatgtattcgagaagtcacataaatagatgcttagcaagtgttaggttgctgttataatctggatgaagttggttaagtatctttttaccatttctgcttcccatgtctactcctgcctaaatcccaacataccaggtaactttgtgatgattgcatttaagagaaaaaaaggttatctctatacaaatttttaaaggttaacaagtcatttcatctcctatggtcctactggaattcctgtgcacatttcttgaacaacgtagaaggaaaatcgaactggctatgaagtataactatgttggtacgatacaatccatttttgcactgtgtattgtgaacctgaggttggtgaggtttatgaaaggcctatgaacctgctagtctctgttttggcatcgtagatcatttcatactttttgtttaatttcaatcgttgtaggcgaatcataatttatcattgtatgtgggctttggacatgtgctgagaaaataagcatgccagatgttgaacatgttacttgtattttgcatctatgtactccctctgtccacaaatataagcattccatgtgtttgatatttgttcacaaatataaggcattccacagtactaattgttccattcctcctttaatgaggggcaccaaagtctttctcctcaaccttaatatctgctgaacaacctagaaatgcttatatttgtggacagaggtagttgttttcccattttcctatcactattgtgaactgctaatgtttgggaaattctcagcatcctacggaacaatatgtgaataactgatggttatggcttgatcctcagcatggttgtaatgttgcatatctttctcttttttttttttttgcagagaccagaaaagtacttaggtgatattgaaacctggaacaaagcagagcaacagctgacagaagccttaaatgagtttggaaagccatggcaggtactatgacagtcactcccctcagaatgtttgtttcagtctatgctattagaagtgcatttccaacattcattattttcacaatatggttaacgagagtttgcactaatttcttccactatttttaattttacctgcactcagcattatcactagagtcctttgtcaaaaggtattatgctttatttagttttggcttaactctaatgtcgttttggtaacaacatgtactgtatgttgattactattgatagaaatatatttttttaatactgatttctattgatacaaatatatttctttatgccggataatattgatagaaatataatttagtggtaatgttttcagtaaacatcttaggagagattattcttctttgactcaattggctggttcctgtcatttttaaatttcaaataatttcatattctcaatctgaagtttggatgtaatactggcggaatacccaatcttgaagtctggctcgcaagttgtgattactggttgtttcctagcagtttttttatcccttattggtgtacttatttagatgtctacatgcagatcaatgaaggtgatggtgccttctatggtccaaaaattgatattggtgtgtttgatgccctcaagaggaaatttcagtgtgcaactctacaggttatattgaatgtcattttgtttttaattgtagacagaatagaaggttatttatctaaacttcatttcctgttacagctcgattttcagctgcccctacgcttcaagctgacttactctgcagaggatgaagccaaacttgagaggcctgtgatgattcacagggcaatcctaggttctgttgaaaggatgtttgctattcttttggagcattacaatggtaaatggcccttgtggttgagtcctcgccaagccattgtttgctccatatcttccaattcagtggaatacgctaaacaggtaaaaggtccttgtgtcatagaatttactaattactattaattagtagctcttctccattgatcaaagtgtgaaaatcttctagtaccttctgattcgataggtggtgctttgtcttagttttccgtggtggtccaaactatatttcttttagttcaataaaaactacttgttaaatttgagttgcctgatgggttttaaacatgtataatttttttatatgttactattattttgacgtggaatttgtctggtgaacctatcgctacaacccccagctgtgaaatatttttaaactttttgtactgcatgatgcactgtgtcaacttatttcatagaatacttatgtaccgaactaaatgccaaacaatttacacgtgtcattagactgtagtatgcatgatgcaggtttttattttaaattatagcctgatgtcgttcgaatgcaagtccaatttgatacagattatccacagctaagggcttctttttgatttatcagatctcacacatttgtctgacataagttttttgatatgtttgcatgagtaactattcagctaattgttaatttaagtcccagacaacattagctttctttttgcaaggtgaggatggcttttaaaaagtctcatgatgaaatgataacaacagtacaagattgtctttggtttcttatttgatcatatatacttcctcgatttcttgatggatataaacatccatgcagtgctggaaatgtttattccttattaattaggcttcgtttttgtattgagtggatttcatcacacagcattggaagtctgtctagtccattattattttaattggctcaatttatcttaaatggattccagatgacacttgggtgtattagtaatgtactttttataaacataatacattttgaagttcgcccactaattccacgcatggtcaaatgaaaccttgcttacagtggagtaagaattttggtaactaatcagttctcttctgtactcaggtccgtgctaggatacatgaagctggttttcatgtagccatcgatgagacagacaggacaatacagaagaaggtagttccatcatgtcatagtgtaatttatgtttgtcctttattattgtttgctttcaactctttgaatagcaaaacggaggtatgcaacaatatgtggtatgcattgttctgattttttgttgcagggactgttccattttggttttgcccatgctgcaagaaagttctattattttagtaatttagtttacacggttctcaacaatgtaatctgtgaattggtcacgaccatttttcatctttgcaggtacgggaggctcaattagcccaattcaactacattcttgtcgttggtgcacaagaagcagagactggacaggtttttaccctttgcacccctgttttcactagagatgtggaataattatttctttctgccatccatatgtacaggtgaactagacaattaaattcaagagatgaagtagtcatcctcagataactaaaaaaaacagcccactggttcatatgaaatgtgtagtcctatattatttatacggttgccttatcattatggcttacgctattgcaggtcagcgtcagggtaagggacaaagctgaactagccacagtgagcattgatgacatcatcacacgttttaaggaggaagtagcagcttacaaatgattttgatttcacacccttttgctaagaatttactccaaatttgtgattttgatggtgtagcgggcagtgtaatcttgctattttatttcttgacaaaagtacatctgattgtcttttcttaataacgaaagtgtgctattcttcatcagcgacatatatagggatgggtgtttgatcaactcttgctaacatgaactgcgtctctaattggatttaccccaacttagcgtatatttccacttaaaccatttgcagatcttattttctcataatgttatgttttggagtaaaggacacaacctgtctagttgtgtcatctaggtgggtatgacttgtcaattggtgtatggtttggtaatgatgccacataagcgtccaggtggcatgcaatgtaggatcctagagcgctagtgcgctcgtggtagtttgggaacgaaacgatacaatttaatttaataagttttgtgtattttatgagtttggggatatagatgatgcatccgtcataagttaagtctaagaactagttgagcagtttactttggctgcctttgttcaagccggttcttaacccctcttccttgttttctgcgtgtgtgtttttcaatcggataaacggtgcatttttgtaaaaagtttatatacgaaagttgcttaaaaaatcgatctattttttaaaacaaaaattaataatacttaatcaagcgctaatggaccgtttcgtttttcgtgctagagagtagcgttcccaacccgtgaaatgaacgcagcctttgtatattacacatcttaggagacttaacaaaaattgctagttatacaacatcttaaatgcgctaaactcattctcatgtatgactagttcctaagctaaggcctcgtttgattcagcttaagattattataatttggattataaggagtaagctaaaacaaacaaatagatcattataataggttattataatctgcaagccagattactataatctaataatctcctctagagaagcttttttcacattattgagtggctaaagacccactactctcagatgtcttcaataatccagagaaacaaacaactcgcagcttattttatgttagcttattataatttagcttagagtaatctgatttagtaatctaggttataataatcttaagctgaaacaaacagggtctaagtattagtcccgcactttcatctatactaatattacacaaataaaaaaaggtgtaacttaaataaaatttcatattataactagatatagttacataggccgactagccagatataatcagatccaccaaagcttggctatccaatccacaagcaagctaataaggggtagacctccaatagagaagtcctaaacaaaagcaacagttctcgatcactcaaaataaactaagttcaacaccaaaaaaaacaaaggtactacctccgtcccagaatacttgtagctttgtggtttttttttgtaacttttgatcttttgtcttactagcaaaaatgcccgcgcgttgccatgggtgaaaaaattataatgataatatacatttttcatgaataatcatttcaatgacaatgtttgtattttaaagagcagcttgtttttttataaacaatgtttttttcttgcgcgattttctcaaaccattcagaaatggcgcatttcattctaaagtttttttttctaacatgtttttttttgcttttttatttacaacgaaaaccatatttttctcctctttttgcttttcttttctagtgtgtttttgcctttttttacaattattttctcgtgcgtttttttgcttgcttttttcaaatgttctttttttgctttttatcaatacaggagaatatatgacgaaataaaagccgtgtagtaggtggtaaaaaatcgatggatcctatccgactcagagcgatttttttaatagactatgtttttttcttgcatagttttttaaaaccattttttaaaatggcgcgttttttctgacagttttttcctcgcatgttttttttaagaaaatcaccgatgatggaaataatttttcttgcgcgtttttttatttttttatggaagatggaaaacaattttttagcatttttttgcgcttttttctgacttttttctcacgcgtttttttgaattgtttttattttttttgtgcattttctctttttaaatagttaaattatattagagatagagaagagatatatattgattagaaatcagactttgtttcgtcctttccatttttttctcgtgtgcattatttattttatacgaaccattttttcgccaatttcttagggaatcggacgaacttttttagatgttttttcggttttttcgcctttataggaatcagacttttttcccgtttttaaaggaatcgaatctagtattttttttcaccacttttttttttgccttttataggaatcggatttttttccgttcggatctacggtttttttccgccacttaggggatacagaacttttgttgttgtttttcttttttttttgtgcacctttcctttttttatgcacctttatgcttttgttctctctcttttattattacttttaacaaaaacaacctcaagtaccttattgcaagattatagggatttaaatgtaaatataaaaattatagggactcaaatgcaaaagtacaaacccaaaaattaaaatcatataaaaatggaatgccctccacctgtaggttcctttttgtaaacagatctttaatccggcacatcattttgtttcaccgagatatgtgagatatcacggtatagattgatttttcgtttttaaggaggaatcggatctatagtcggacttttttttcgtttctagagggaatcggataggagtcggacattttttttttatttttttgcttttttttctttcgcccgccggttttttttggataggactattttggtttttttttcgcctcttttttctggacgtttttctttcgcccggtttttttagatgggacaattttggtttttttcgccggttttttcgcctcttttttctggatcggacagttttggtttttctttttttagcacttttttcgcccggtttttttatcggataaatttggtttttttggtccggtttttttgacggacgatggaagcacctcttatttttttaaagtagtagagattaaaaaaatatgaaattattatttattttgtttgtgattttctttattatcaaaagtactttaagtatgacttctccgtttttatatttgcactaatttctcaaataagatgaatggtcaaacgttacaagaaaaaagtcaaagcgactactaatttgggacggaggtagcaaatatgtatagcaagagttagtacattggcaagcagtcaaacctagcatactaaatgcaaggctaaggcctggtttagttcctaaaatatttttcccaaaaacgtcatgtcgaatctttgaacacatgcatggagcattaaatatagataaaacaaaaattaattgcacagtttgtatggaaatcgtgagacgaatcttttgagctcaattagtacatgattagccataagtgctacagtaacccacatgtgctaatgatggtttaattaggctcaaaagattcgtctcgcggtttccaggcaagttatgaaattagttttttcattcgtgtccgaaaaccccttctgacatccggtcaaacatccgatgagacacccaaaaattttcttttcgcgaactaaacacaccctaatacttaaaggaaagctttatatagttcatttttagcataaagcaagttttagttcacaaacgtttgcaaggaagtctttaaagcatttttaaagcgtgaatataagtagataacatgaataatcatagcatatcatattattatccttgctgccctcctcaacaacatggcgcaaattccattacaaaatcatcaaactcaacacaaatctgcaattccaaatccacattccacaaacataatttaaaagcataaaactatactcatgacacttcaccaagtcgcttatgaccgcgagtacgactaatcgattagttttagactctacagagtttgcacaactttagtcacatgaaatgaacactctagtttgtctcgtactcgtgaagcactaccgcactttagagattgaatgtgatctagaagttgcaacgaagcctttacattacctaatgcctagtcttgcactagcacgataagtgtgaacccactctaggaatgacctagagtcgttaggtgacgggccaccaccttaaacttaaggccgtggcggtaaacgcatctgtttccatgaggcattgtactgtcatattggacaaacttagacacctaaactactcccagtgagcaaataggtagctcctctagatagccctgctataccattaacgggtcaataggcactgcccatactttcccggcctaccaaaatgcaaggctagatattaaataacttatttagctaagtccacaccataaaatagcacatgtcaatgtacgataaaacattagttagtggcacgaagttcagtccggacattccccctattagtgtacaactaccaccatttgtacaccacttgccgcccaagtctaaaaccattctatacacattttagttcacaaatacttaaccttttcacttctgtccagaaataaataaataccaaaactccatttgtaaagtgttaagaatgattatttgtatagttttaggcttggctaagcaaatggaagcatataaagcatttatagacccaatcgagcatttagaaaaaactcaaaccaaagctatggttacaaacagagggttgtcaatatttcaaggtggatcatgcagcaaataggttatatctaccattttaccaaattttaaatatcggtattaacaaaatacacgtgcgattttgcaaacaaacaatttcattcgcccaaatcatagggttcaaggtgataaagggaggaggggagaacctgcacgtaagtctctctttcaccgttatcgcaattatctatacaatttacacggtatgcaattaaataccaaaatatacaaaaaaaaaaacaaaatgctctaaaatgcatgatttgtgcacagtaggtaggtgatgaatttagatgaagaaatttctattttatctctttttatttaagacttatgaatttctaaagtttgtgctgatatagggtactccttccgtcccaaaatataagcatttttggactttgacacagtcttcgagatgctactttggccaacaatatctataaaaataagatgttttaaataaaaagagtagcatattatgatagtttgtttaatgataaatttacatgattgttcttttttattcttttgctattaatagtctaagttaaaaatgttttacttgatactatgctaagaccctctttgtttaggcttagacttattggcttagacttttaagtcagcttattggcttatatgatttataagccggtgaatttaatgtcctaagtttaatggtggagtcataatctacctcacataagccaaaaaaaaacttctccaatctagcttttggcttaggccctctttgtttaggcttataagccaacttataagtcgaaaagtctaagcctaaacaaacaagcagcttttccgtttggcttttttgaagccataagccactctaacactattaagccaaaagctaggttggagaagcttttttggcttatgtgaggtagatgtatgactcaactactaaacttaggacattaaatccaccggcttataaatcatataagctaataagctgacttaaaagtctaggccaataagcctaagcctaaacaaagagggccttaatagtgttagagtggcttatggcttaaaaaaagccaaatgaataagctgcttgtttgtttaggcttagacatttcggcttataagctggcttataagtctaaacaaagagggcctaaaaatgtttatattttgggacagagggaatatattatttatctaggtagtgtcgtgaaatactttttataggtgatttggttaaagttgactttgcagaggtcaagataattgttttctaagactaacccatttggtttcataattgttggagtttgtatgattttctgatgtattttacaatttgtagcgtgtccaatgttagtaatttccctatatttttaggtgtttatttgtacagaatgtgttactttatgttcttgttaaagaaagataatagttcttaacctaacaaaactgagttcacaagatttggagctaatatgaattttctacatattttacaaattgtgatgtgctttatgttgataatttgttataacaacttgagaggcattaaatgtactaaagctgagttctttccccaactataacaacccacttccctcgttttccacgcgcacaattttcaaacagctaaacgtcacttttttgcaaaaagtttctagaaagttgcttaaaaaaaatcatattaatccatttatttaaaaattagtaaatacttaattaatcatagaaaatatgttgctccgttttccgtgcttagggaatgagttcgcaactcaaaacaatgaacacagcctaagtgttttgagttttgggtaacatgaataatgttatagccttgctggcctaaccaagtcttattttagcttaattggagctatagcgtattttctataaattgcatcatttataatttgtgatttaatacttatttcacccattaaggtttagagatgattttcatattaaatgtactactttttattatttttattttactgtgattaaggagtacatgttttgtgcaactagcaggactccgttcactttattttgagttcactttactttcgtcgacgatgcggaggaagcactaggcctcgggggtgaggtgagtggctggactggctgggcagtggagacgccgaagtgcctacacgtgtttccccaggtggcggagtcggtggccatcgcacacgcgcaggccgtgtgcccctcctgcttcatcatgttgccgcccttcgcccgcgtcgcgttcatcgagtccatctccagcttggatgcctcaggcttcagctccgacggctcagacccggactccttgcttccatagcagcgatgggatggcaccaactgaggggaggaccgcagcgggaagacattcccactgaggagccgaggaggtcgacgatagaggcgacgctaccttcgcctccgatgtgtataggttggaggggggggtcctcttattctaggagcggtgattgagatcaatgcattgttatttctccacatgcactgcttgtcattggctcattgttgatttcatgtctacagtagttgttgaagctgttctgtaagttcgagatgatgaaggagaagatgcgagcaataatgaacctacagcacaacgtgtccgtgtcttgcctccacaattgttgctcaagtggcccaaggaagcgtcattctgtcagttgttgacgcaacttgtgccaacaacccgatcgaatgaagaaaataaagggggatgaggaagaagatgaatatgacaggtgggttccacatacagatgggaaagaagatgggaaacgtgacggtgatgccatggtttcgattttgtaaaaaaatgagttgcacggctacgaatagacgaattataatggcatttatctaaatagacacatttgcaatggcacgaatcaaattaacccaacttttttaggaaaacgctggggatcaggcgcccgacggtgccagaaaaattgcccccctcacgcgcgcctccgcctgcctcccacgcctccccaccactagggccccattacaacaaatccctcacatattacggaaacgctctattaagggatttcgtttcatttttttccactaacaatgtttcagctagtgtactcgtaatgtttcactatgtatagataaaatgttgcagtgaattgaattattcttttacaacaaatcacccacatattatagaaaccctttattaagggaatccgtttcatttttttccacaaaaaatatttcacatagtgtactcataatgtttcactgtgtatagatcaaatgttccagtaaattgaaacattctttcgatatttgctaaaacattgtttttatatagggtgaaacaacgcttaattttttttggaaaccgttgtttcatacgttgtagcaaaatgtttcatgagatgatttggttgtgtttcagctttttaaaaatactgaatttttttcgatttgtttagtgaaacatgttcgatctagttgatgttcataaatcgggtgcccgatttagaggcgcctccactttttaaggagctatttgtaaaataattttttaaaaggacctagaggtgaacaatccatggctaaacccaccgcgcggggcgcgcccgcagcgaaccaggcgcgcattaggcgccccccgagtttctccccccttcccttgttggcgtaaaagaaaaatctccccgtctcgtctcctccgctccttgcgccatctcgcggctgaacaggggagggggaggggcgccgatctccatccgacgagcagagcaggggaggggagggggatcctggtgagcatccacatcctctttctgattcatctctgtcccccaccggtagtacttttgtctggaatttgcttgcgttaaccctagcttctcttctagatctggaagaagggattaagagaagcatttcttaattccagagccttaatcttaatacaagtaacagtttgtttgttcccctaaaagtttgggggttcagtactgaacccccatgtcccaagttggatccgcccctgtggggagattgaatggtgcccttagggatctgtggtcgttcgtggacgaaaagcggttggtggtcgcaaagattagtttttaggtttctttttttctcctgaagtgattgcgattaccgtgcctgtgatgaagtggcgaagagaggtaatgatggcatagattttgcattggccgttcggggtgacgttcctgtattggggctcaatttgttgtttctcccagtaactaggtgcttcctggttgctgagcacgccgaggtgtagattttgagatatactcttttgactctttaactttgagtaattttggaaattatgatggttctcttgcctaaatgatgtttattattcaaatatctttatgtacttctcttttgaacttttattttttttccacattttgtttcgctctcaatacaacaaataagcagttctggtaattcttttattttcccatttcaggagatcatggagagtagttcttcagatgttcaaatgtcacattgtgctgaggacttgaatagtgagagtacaatcgagatcaaaataaagacattggattctcaaacatacaatttgcgtgtcaataaacgcgtaagtggataacaaatgcccatgccagagactatacagttgctttttacagtgctcttatggttccttagaaactattggctatttgcatgcacaacatgttgcaattctaatgatatttaattgccttctttcccgggaacaaaataccactcaatccctttcgcatagtttaattaaataataataagtgaatgtatgtcaaacttgcttaaatttccccaagtaattttgacaacccactactatatctcatatttttaccattttctgatagtttattgtgcagcctagttgcaagttcattttatgttcgaatgatgtaaattgcctttttctcaattttttctgttaatggtagttttgaatgtataaatagcatctaatgtagagcatgttgttatatgtatgttcttttgggcatgcactcacttctgatgcacaacttctgatacacatatggtgtgcatttagattcttttgagtagcagctggtctagtgttgcattaccataggagccctggatgaaatttatgattatataagattgttgtttgctagcagtgtttttcatagggcctttatgatctgtgaacgttggttaggtggctctagtagcactcctcaggtcctgggttcgactccttgtgggagagaatttcaggctggggttaaaaaaaatccccttgtctgtcccacgccaaagcacaggtctaaggcctggcccaggtcattggtcgttctcacacgggctacggtgctgctgtgtaagggtggggctggggttcgggggttttctcaacttgcgtgagaaggttttctatgcaaaactcccaggggctgtcttacccccccataggtcgattctttttagtggtctgcgaactggaatattatctttgaactccattgatcatttttagaacctgctcagaataattctatgtaccctttaattttcagaattaatgctgcattagtttgttcaatattttgttccagttctattttttgggtggacatgccatttattgttaatgctttgtcttttatacaggtgccagtgcctctgctaaaggaaaaaattgccactgtaactggaatattgtctgagcaacaacgtctgatttgccgtgggagagttctaaaggatgatgaactcctctctgcgtatcgtatcctcatctatttttggcttgtagcattttagttgttttgtcttccaaaatttgtttctccatctacaatgccatatcctacagtttcaaatgttagatgtcattcgacaaacaatattctagatcaagaaaacaatgcataatttttatgcacaattaaaagcataatattaatatttacaaatgatgatggtcccattgtttggaatttcggatgacatgttggaaataatggtattatatttggaaggtgttgtgtttatggtttagcaatttctttctcttctctttgtatggtatgtacactgatgttgctttggtgatttttgtccttttcttctatactatgaagaaagggttcagatatccctgtttactatgaagtctttgtcgccttttgattcctcccaggataagtcactaaaacctaactggtttgatcatattattggacagcacctgttttacatttgaagtacgtacttggcttaccttgtaaatggtaatccttaactgaagtttttattagacgtggaagatggccatacattgcatctcgtggttagacaaccaggacaatccgctacatcaggaaatgctggaaatgaaggtttgtaaactcattgtgtgtagttaaaaattgattgggaagtttaagagagcattctttggacacctgcattgtgtgatataatttatttagtttcttgggctgtttttcttcttggtttcaagatcgtgaataatttttattgaagcaaaaatcttccgcatttgcagtagttctaatggtagataatactgttatgaggtttgtgagtattatttaggttgtcagttttgactctatattgctttagttagcattctgaaagactgctgtaatggaacagatgctcgtatgttgtgattgcatgtcatgaacatcgaatctgatgtgttagcagcatactgcacttggtctattatgtcaactagttgctttgtacttgtcatcattacaattactttctatcctttccattccttttttatgtacccatataaagcagagaaatgtaccacagaccttctgtgttcccaccatcttcctaataaggattctatatgctattcttgttaaatacctaaaaggctaaaactttctgacacccatatgacttgttttgttgctatagaggcctttatgccttttgatgttatcttatacctatagccatgtcaattttgtattttgatctgttttgcatttgaaaatttaatttgtattagcttcatatttctgtaaagtcaagtcaagcacactgcagttaccatttggccactttgaactatgagctttattatgtggcatgcctagaccaaaaacttgtgacaacagctgcatgttttctatattgcaccatagaattcattcttccattttctccttccgtatttcttcattacgcaaaaactgtcaattttataggtaccacatcaaatcctgctcgtcgtcgtggtcccactatgactcgcagtattgtacttgaggctattaatgtgggtcaggggagtgaactcagtgttgcacaggttttccttgttcctatgcacctctatatcttctcttactgtgttcctttggttgacatataacttatttttcacttattttgttcttttggtagttgctccaaagcctgcttcgagctcctagtagcacacaagtttcggtaatccagcattctgaaagtctttggttcagattggaactaaaaggatcttatttgaaaataatttcccttgtgttagagtggaccagcaccttctgatgccagaccttcagaaggtgcacaatcttcaacgcaaaatggtgtcagggctgtacttgatcaaatgctggttcctccacttttccagtctgaaacgtcagttgggttatcagaaccaaacgttagtcttggtcttgtatccttcacaactcacatgccctgatgttgaaatattaataagatatatggctaataacatgttcttttgcaggtcattcctgattcgttgaccacaatttctcagtacattaactttttgagagactcctttagaagggaaggcttcctcgaaaatggtcttaccttgacttttatctgagttgcccacattctgaatcagtctgaaaatttagttatttacttccaatactctttacaggacaaactctgaataatgctgaccatggaactgcaggaagtgcccatggaggtggtactcaaaatcatgaaagccagcctgattcagcttcggcgcatgggcttcctactgcagcattgcttgctgaaactatgcactctactagacaacttcttgttgagcatgctggagcattgctatctgtccgtgccatttttttattttttctcgttatgaattagctaatataacagttatgttttagcttcatgaatagtttgatctcttttctgtttgttcttgctgagttgagaatactatgcatgtagctattattcttcaatgatagggaaagtattagtgaagttagatatatcaatttgagctatttgattgagggtaatatggtaaatgtttcattgggtacaacatatgagtttggcaggtccaatcaccctccattgtctcatagattccgacattcatagttgcactcaattaaaccctgtttcttataaattatccagctaatgttcatactccccaccaagagtcatggtactataaccttgtaaaatgtacaaaacgtgtacacatcatgtctgttgagtttttcatttctaaactatctttttttttgtgttagtatataacataatattgaggaatacgcggataccattatactttattttgttttaagtggagaacaagtgaaatggaaatttttgtaaccattcatgtatgcaattaaaaactaattgcaggataagttcatttcctgtgttaattatattattgtgctgtgatcacttcattatgattacttggtagtcaactgactcccatagatgctgaaatttgtttctttagtttggtttgctgcttatctgctttgttgagttgttaacttcggttttatacgttactagcgtgtctgaagttaagatgagttatttcaatgcagcaactaccaaaccagctaggagatattgtgaatgtaactgatgctacaacacggaggaaccttcaaaacagtgtagtcagatatggagttctcatccaataccttggttcattacttctagaacttggccgcacgacaatgatgctgcgtataaatcctgcaactgtaggtttttctgacagcttttttttttacctcgtttcacattggaatgattctgtactgctgtactgaccagtaagcattttactttcagtcagaagcggttgtcaattctggaccagctctttttatctctccatctggaccaaatcctcttatggttcaagtgagtaatttataaatcttataattttaatgagtaaatttcactaaacctcacctattatgatccaagttgcacaaagccacgggtattttggcacatgccactgccacatatccctgggtattatggtcctaaagtttcacaaaatcacactgttaaccattttgacatactcctatataaaaaaaaaacggatgtaacatttatatggtggatacaatgctcaaaaatttaagatgtgactgtagaactaaaaaagtatggtagaacaaagtcaaaatgagaagtaacgtagttttatgaaacgtttggaccataacacctagggttatgtggttatgtgccacatgccaaagtttctgtggtattgtgaagcttggaccataactgggggggggggtattatgaaattttgctcttaatattaacaggtagagaacccatttatcctatttccgtcgttgctaactcattttagtccagcctgctccttttgttccaggaacaggatctgttcaagtgggcccaatattttctagtcttacttcacatcgctctgttctgcacccaagagatattgacatccatgtccgcacgagtgagtaaatgttgctatattttgtttcttcagtctgactattgtagtttgaccagcatgggagttggatgtcacatttatccatctaggattgaccagcatgggagtttggatgtcacatttatccatctaggattaccatgtctattgttagctttgatatatacgattagtctgatcaatgatcaatgctctgatcttatcatgacaattaattgttgaaatacgagttgataagagctaatttagattagaaggttgtttgattggaggcatagtccagcatactaaaattaatcataacaaactggtgtgtcaactgaaaccagtttgctaatacctcagagttgatagtttagaatgagtgcaagtcccagttggtaaggttggtttagataataatacatttgaaccaatgaatgccgattgaatgctagaacgtgttcttttttaagcttctggacttatggattttgcacctttctacatcagcattacttagataacttgttctaagctatttattaggtttataattataattactcaattataatatttacctcatccctgtaagcaactgtccattatctgtccaatcatccatacagaacatgtcttaaacttattatggcatccatgaccacacttagtttgagtgtacatttttcctactgttactttggttgatgatggttaaatgcggtcctttttggttgttaggtgggtctgtgtctttaactggtactaacccacctgagcgggttgaggaacatcaaacacaagatcgtacagatagaagtgcaaatgcttcacctgcaaacagtagtgaagcatttgcaggggttacagctggtgctccattttctgttgaatctggagttaggctggtgccgcatagaacagtggttgctgtgcctgctggcatcagtcatcctccttcaatgtcttctagtggagttggtattatctacccactgtttgccagaattcaacaaagagcatacactaacgctcaagttgcccatagtgctaatcagataccgaatccacagacatctcagtatcatgaagcaggtgaatgagttttttttttttcactctatctgtattgtttgcccccttgctcgagtattttctgtttgctcactaaactgctatctactaggggtgcaatctggttggatagctcttgactgatcttatgttgaatctgaataagaccagattaggcaaacggtcacatttatagattttttttggataggtgttgtaaactagaaatgcagatttggatgagagatgtccagattctaataaaatctgaggtccaagattgaaatgggaggggagagaagtgaaatggatttatcaccgttgcaggaagtctatggcacgtttcttcaccgtaggttggttagcaatgccttggttggcctgccagtgttaagccagaggaaggagaggatgaggctagagactgctttccctgtttccttgtttgagttgtatgttcaatttgcctttttgaagtgctaagtagtgttcctccaagtgatgaggaacttgccacattcaggtgcactaaatatcacttttatttgctcaaattcttataagtattatttaagcatttaggctagcattttacatgcaaacttattgaacttcaatatatttgcaattgtattagcattgatgcctgtctggattcgtatctgtttttttttttaattttttacatttaactcattctggaatgccttttgcgtacttcatcttctagaatttgtctaatgatttctgcatgcctttgtttcaatgattcttcattctttttacgtatgggtactccaggttgacaggctcatgttttttgcgcatcaaaagaatgggttaccagttatttgccactgcaaatattggcatctgaggatttgccacttgatctgtcatggacatgtggtcactaatgacaaatcagtggcatattgccaagtgcataaaattcatctttctgtggcaaatactcatgtttcctctataacaaatgtatggttgacatattattccttttcttaccactgaagtatttgtctaataggtactctaggatctcctgttgatatcaatgcggaaaacggcactcagacttcccctggggagcagaatggccaggggcctttttctcagttgatggatagtatcccttggattgcatcactcttttctggggaaaattctcgagtaaatggcacaaatcagcatgcaccggcttctgctgagcaggtagatggtagaaatcatggagcaccagaagtgtcaggagtcagtgatgagggtctacggttcgctagcttagttcgccaaattatgccatttatttcccaagttgagtcacatcatcaaagtgcctcagcagtcagtagcagcaccccttcacaggtaactgcaatttcttcttattatggctgtaaatacagttaagctcatgatggactaatcagtactggcaggctgcacatgggaacttgaatactgcaagagctggtccaagtcattccaggagttcacatcaacataaccgtgatccagttgatggacctaattctaaaaggcaaaggtgtgtataatctgactgacaaatatactagtttcttgcattacgtctggtactgtaggaggttcaaatttagtcacaaattttatttaagcatatttattcggttaggtaacctcaacatgcaacaaacgcatgtacatgtttcttatgataacatactaccaattaatttcattatgttagtccaaactatctcttttttggtagaaaagtaggggtgtaggggaggacaaggaatcagatctgtacttttgctttctgttttgttatcaatagaatgatatgtgaattaattgttttacatgccttggaacatttttttttcagaacaagtgagtgataaagatcttcatgtcctccggggtcaccgttttgcaagataagccgagaattttgccgattctcactgcgaggatggactgtcatgaatgtcttgacagagttgagggcagtggattattattatttggcagtgtatagttggcatccggttcattagtcaaggcaccatctttttttttttgcccatttcctgcggatcggttgtaatgttattttactatcctatctgtagaaattcgattcaattggggttaaattatgcctgcaattaaccaaaagcttcgtttggtagtaattgctgtagcatgtggagaatttttgccacttaataataccctctatgatttgtacatttgagttccctttgttccgtatagggatggcaacaggccgggtcggccacgggcagagctaaaccatgcctgatccagcaccagagaatgcccgcttgaatcatgcctgatagggtaagcgtgtaaaacttggtgtccatacccatgcccaatgtacatgggcatgcccggtggatacccagtttgcacccgatggtcccttgcgtcgctgcccgccggtgttggccagagctgtgccacctgccgtcgtcaccttgagccgcctcgccgcttgcgttgagctaagccgccgtcatcggcctgtgacgccatcctgctcgctctgctccccattgtctgttgcctgtgccactaccgtcgtcacatgcccatgctgccactccttgcctgggccgccactgccttgcctgcgctggcgtcattgcttgcccacgccctacgcagccgccactgccgtggggatttgggtaggagtaggagaggtgagtgggggaattaggttagggtttctattagttgagtaagtgtgtgtattgtcaagagaaaagggtatgataattaagagatgagccaaatttagttaatacataggtaccgggttggacatggacatgtgttacctataggcaaaaatattacccaactgctgctcgctacgttctcgggcctgtccataggaaaaatattacacccattccctagctatgtagtaatatacactaatacccctattgaatggggccaaacattcctttttttttcagttataattttttccgtaattcagaaatttagatcagagtttatttgtcaaagcttagattaatgaaaattttgaaataaaaatgtctatgttttgactatctatataaattctgttttgttgtcgtttgaattcagtttgtgtatttctgggatttgagtttttttttctttaggagttatatttgtccgtgtttggagcatgtacttaatattcgaattccttttattcggaatttatattttttaataatggaataaaattcggaattatatggctacatactgttgatttagtttttgcgaatgtactactaatattcttcgttttttttcttgttacctgtcctcccgttatcagggcacaaaaccgacttgtcaggaccgctcccatcctccataagagaacaccatttttaagttggggcataggaataattcccttgaatcgtcccgtgtctttgctcactgcatctttccaaatcaccgtgcgctccttacatttgtttcagtcccctaaatcatagttgtctgacaattattaacgactaaatttggtaaggccatggatcgggttcaaagccagggtcaaaacaaattaggaggaattctgtttaggggaagcagaatgcgtatcgactgccatatgcatcggctgacaccaaatccgacgaagacaagccgatacaaccagtctcgaacagacggtcctgcaactatcgtcgggatcaattaaggcacttcatagacattgccacgcagggattggagtccagaaaatgtaattgtatctattaattaggatattttgttagtttccttagaaatatttttgataagagtccgcctaagggacttgttcgtattttaaattgtaatagagaaagagttgtgtctagcaaggacatgttatgtacttgggtataaatatggcccgacaccttgtaaacaagggacgacaattcaataatacttcggcgcatcgctacccttttctattttcattgtttcgacatgtttttgctttcgagttggcctgcatcgagttcgatctccgacgaagaggtaaagcttgttatggcggtttgcgttctcggaattagtgcttacatcttcatgacactctaatcctgtccatgtgaatcgccgagttatcatatacgctgtataatctagatcgatctcgtcatctaacctcattagctagcctctatcatcgaaaacggccgatagatttagatatcgacattgagttagattatacagagtatctactatataaaagaccagaaactatgtatacatctatcatttacctcaatcctacgtgcacatgatggaaaaaagaggttatagtagatgttttctctcatgtttttcctgtgaaatgagttgcaaaggaaaatttcctccaacttccctatgcctggatccaatgaatcgaaggctgctatagtgccaaatcctgaatacctacatattcctatgaaattcctataaatcaaaggaggccttggcagttcaatttgtttcctatggattggattaagccacatatcttcttcttccgtgctttcttgcatccaggaaggcttagggcatccataatattgtaaattaataaccataattaaaggccataagttggacgataaccattgtggctttaatcataagctgggccataacaaaaattaagcatatgtttgtgatcagtcacaagcgaaaaaaaagagaggagaatctctcttctcgctccaccgaataaaaggttggtttgaaatctttttcatttgtcaaagggttcacgtctattgttaactggcatagggttgagggttcaccttaaagttaggttggcaataaacattggccatatgcgcttagttgagctattaccttgttttctgttggcacgatttataaaccattaaacggtgtatcaattttgtgcaaaattttctgtacaaaaatcaaataaattattttttgaaaatttacaatagttaatacttcctccatccgaagttgatcatcatataggtttatgcatcaagattaaggataatttaaatcgcatcaattaagacactatgcacatattctcctactatgtatgcatcgattaaatcaccatgctaattacatcctaccatgcacacattctcccatgctgtattaatggtatttcaatggaattcgtgttcatacggttatatgataattaatttaagaaattttagatttgattatataatgatcaaaggagggagtactacctaattaaatatgcagtaattacctagctatttttatttgtgtatgttttacgtgcgactgattagctaaatcaacaagctctaccgaatgcataggcgcaaggcaaacaagcgaacaacactagctctgtaatttcttatagggtgctggtagaccatccagccatcatggtgcccggcatgaaagatccaccacacaccactacaacagaaccactcatttataatgggtggtaacctcgtcaatgattggtggacaatatgagaaaactgttaggatacacgtaggctacgatagcataaactaaaaatttttcaccgcgtaaaccaggaaccatataaatattagatcatagatcgttaccactcgacgcgctgcgcagcggaagtaattaagcgctaagaaggcgaggaacccgcgtgatgtagtgcgcatcgatgtagaggaagtagtcgatcacaccggctcgaccttctccccctcgtgcgttgtcctcgccgtgctcccacgccgattagcaccgcaaagcagcggggcctctaccggtatccacaaaggaacaccacgcgtagatgtgctagcatccacgcgcggttagggtttgctcggggaggggagtgacaactagggtttcacgtggtgtgttaattccgccggtcacatcccctcacgaatataaaggatacacgactgggccttcgaggcccatatgagtcctactcggatccctatccgattgagtgcatattagatctccatccaatccctttattccggccctttaagcgtgcaaccctgtaggttcatatacactcggttgcaacctgaaaactccttttcggtccacgtgtcaacagcggaccctagcagaacgtattgacccaccgagcatacataaagatcatatcggttgaacctctagtgtaaacttgtatggacccctttgcctcacgatatagattaagctcaaggctagatatgtgccatcatctaatagctcaaccattcactcgaacttgtgatagattatataacttgtgattaactcctcaatcacctttggcatgactatgcacttccataatctataacatcgagtggcccagatatatctctccataggaggagcaaatcccatcttgattattcatatcccactacatgttttatagtatacccgaaaactacttttataactacccaattatggagtagcgtttagcagtccctaagtaagctactacacatgttgggaaccatgataatctcaggtctaaggattcaataccaacactaaataagatcactgatgacacaacacatacggctcttgcagtgtctcatgttgggtctatctaacaacatgttcaccaacatgtgtccacattattaatttggtatctctataccatgatccatgagacatgatcatcaattaatacatgtgctgatcatctaaacatatttgttccacatatgatatttgatcagggatcctttagaaatagcaacatataatataaagagtctcaagaaagaatcacatattcattaacaaataatgagttatctatttcaaggaacaatgtcggataaatatgtaaacatagtatgtgatacaatcatctttatgatttcctctagggcatatcaccaataaaaacctcatccgtgatgagtgaataaccgttaccaataacccatcgatgataggttttaacttatcacacaccaaagatgactcccgtcacatatgagagttatctatgatggttcgtaattatgaaccttcatggatgagaatttatgatttttaaattataataaacaaaaaaacccttaaaatattcaaaatattattatattatttcaaccatggtcgtacatcactagccacaaattcatgattttttaagagatatttacaagcacactatggtgggatttcaaccgaagaccttccaaagcacataaagcatattctcagccacatgttgctaggtctttggatattgttattttggctattctggtccaaatatgaaatactaatttgactctctagatgacttaaaaagaaaacttttcaagtacaaagttgtagatctcattgagctcgtttgaaaaattcaaaaaatattgtgaaaatagatcacattacttataacacatatttggtgatgtaaacaatctcaaatgaaaatattgtcaattggaaagttgtagatctcatcgaacccttgcactctgatataggatatgtctccaaccgagatcatttgaaaaatttaaaattacgtttttcaaaatagatatcatcctaggtagtcatatcttagtcatatcttacgtgggatagtttagatccgttagacatgagtcatcagaacgggttgcattagcccatcacagataccgggatctgtggtagtgatagtgacgtttagaacgagcagaagttgctgcccttgactacctgggaagcctcatgatcatctcccttgattcattgtgatacggggtgcctgactttcttagattagaatacgccatacaacttgacgaactagatgaacgacatgcatgttgcctatgtaacgcacctttcacaacgaattcgcaaaaccacatacaagagatgatcatctacttgaccgcacaaaagtggatctttttctccctcaattcccggctagcaaaagtaagaacaacctatggcagaaactgccaatttctctttctaatttggtggtgacaggtcaaagacttggagaagaataagagcaatatttcatgtgaattttcttttcattaaatgttgtttaccctgttaggtcatgtgtacaaagtcatatattgccattacatgtgttacaaactaattaataatccaatacacacaatttcaaaacctgtcaagactatcgacagtgtagtgaaaccagaaggaaacctatccattatatcaggtgcagccataggagggttccctccgtgttgttgttggtatttgttacgaccacagataaatccgcaagcgtacggaataccgctatagcacttcaccttcgggtgacccctaaaggatatcgaactcagggaacgtgtgtaatctacgtaagcataagactatccaaggacaacaactataggtaggctggctaggcttgagaggactttctatgtgttttaattatctaagctaagttgaaggtaattttctatctgttgcttcgggcaccgactcctgctagtttgccagcgtggtttcggctatagctctatgatgtaaccgaacgtggaggattactaggacgggattcagggctgtcaccacctgctgtctacctctgacaaatccgtgggatacgcaacaaacaaaggtaatctctaacctagacaccacgcctaagttattaattactactctaatacttgcgtaggaactttcttctctatccggagtcctagtactaaagcacttagtacaaatactaaataatgaacctacaaagatggaaatctatcttacttaaacaaagtatttaaataacataagaaaagaacatgaatgcttcctttatagaagaagtttctccgaacccggagcagagtgtaccgacaactccggtactcctccagaattcttcctagaaagctacacccatcgaggtagaagtcggatgagcgccaaacttccgggcactccttcagagcttccctcccctctctccacctaattctaatgtacaaaagatacaatagagcctcttgtaattcagctcaaagttgtgtttattgaagtgagtgagagctcctccttttataagctccaaatgacggttacaagtatgggaaatgatcaatgtgccctccaaccatcattgggacttcattagcagcgtacatgtggaatgctggcgatcaacggccacaacactggtttgtccgaactggtggttcggtctaactagaaaaatatcatcctggcctctcctatggccagtaggtagcttaatgggcccccaacatcatgtactatgccaaagcccaattctaagtggttttgatagtcttatggggcctccaatccatgtaaacgcgtcctgatcgtgcggaggttcatcgtgtcgcatgacgggtgtgtttcctccttaaaatacctgcatacatatatttcaccaacactagttgaaatgattagtaataaatcctaccactaagttgaataccatattttatttcattatatgcaggtattgacggtcagatattataacttaaggaccgtcaacagttgtgaggagaagtggaggctcatttaggaggagattgagaggagaagctggcttgagttatcggaagaagaggatgtaatgaaggggaaaggtaccaagtagagaagtgggtaaggccgcaaggggtatgctgtacgccagcaataaaatacaatttatatattacgcataaacgaagctaaaatattttggattatactgtgattgttatttacctatgatttatgacgtaatactcttgctcgaagcacctaattagacatatagaaataacgtgtgataagtatagatgagacaatgtaattatagttcgatagttcagggtgtaaaataagtcaaaaaatagtttaaggggttaagtgctttagtgaaatagtttgggggagtaaaatgatcttttttcttttaaaaaatatggcagaagattcgtttgtgttaaacatcgttgtatatatgaaaaaaaatatattgttttctccttggaagttcgtactagtttttgagttaaattatttatgaacaaaaataatatttggaatattgttgtaacaaaataaaatattcaatccagttaaataaaatcatgattataagttgaacatattttattttctgtaggaaatatatttttttgttggatgtgaatatcctgatttttttaacggaatttttttggagtttattcggataattactgagttcaattcagtttttttttctctttaaataaattccgacatcatcttaaaaatctagtagatctcgaaaacccaaattccaaactcgcgggcaccaatcgccgcctccattcgaacttgcccccccccctcgcgccctcgtttactccacaaacactccctctctcctcaccgtcgccgccacgcgtttggctcgcgatccgcttgaaactacaaatcaccagtctctcccggtccaccgcggcggcgccgcctttgcagtttcagcttcactaccgtcttcttgctccggcgaggtacgtacgtacgcccccggccgatttattccatggccaacgaggagcagtacgactggtacgacgccgatggcgatgtcacgcgctacctgctcgacccgaccacggatatcgcgatgttctccgagccgccggtggttcgtgcccgtcgccgccgccatcgagtcccatcccacgccggcgattcacgtcgtcgagcgggagtggcccgctcaggtccagatctcgcgattcgatccctgctctcctccgcctccggcgaggatgcttcccggcggccagcagcagcaacctcatccagcgccggggggactggatctccgctcggatgagattcacgccctgaaacaacgacgccgtccgccgccaaatcctcagtcctcgtcaccgcctgaaggtttgctcggcgccgcaaaccctgaccggcctgacgatgacgagcttgatgctatcctaagcagcttccgtgatgaggccgcgcacggcgacagtggtggtggcgtggctcgcgtccaagtgctccccgtcgagcaagatgccaacctggtgccttccctgccgctccggcatggccaactggactgctcccgctgccaccttgtcaggcatgtcatgcacgtcgctggtaagatttttttttcatctatactactctttcttaggggtcctttagatcagacgagtgaaaaaacggagaaattgaaaaaacataggattctaacaggaatagagaattataaaacacaggaaaaacatatgaatgtccgtttgattgggccgtaggaaaaacacaagaatttaagaagagataataattaaaagattattttcatgaagttctaccttatgttaaattttctctaaaacttgtatgggaagaggcatttcataggtattttattggactccatagagttcagtcctttgattcatagggctatgtaggaaaaaaatcctatagaaataaaatcttctaaaactcctatgaatttcctttgaataatcaaagagggccttatacataattacatatacaccctgcctgatatttgaccatgataaattaaccgatctctgcctgatattgaatcagaatacggagaatgtatgtgatatcggttcgttccaatgtttacagcctcagcaagtggacgcaggaatgggctagcgagttcattgcgagaaacattgacacgatgagaaataatacaaacgggcagcttctggacagcggctactccaatttagttgaatccgtccgcaccaatgtgaatgtcccacacacggcggtggaagtgaacttgctccagacgatcatgtccgccccatcggctgatcatcatcagaatggtgagtttgtaaaaatgtatgcatgaaatgtttgcaggaaccatttcaattagttgtactgatatataatttgatattaattgtatgcactgcagctgcagatcaggtagcagccccagcggcgcaaccattctctgcagctcctccagtagcattacctccaaaggcggcgccgcgaaaagcgcgcaaggatcgggattatgctagcatgctggttgcagttgaagaattctatgtcgccgcaaccagtcggcctgtaccaaactcagacgtagagatattggaatcttctcatgtctcccagcagcaggatggaggtagagctatcatatacccaagcttgcaagccagaaggggaaagacgaagcaggaggtaccgagaaggaatgcaaaagatgttctagagtatctgagcttggcgaggaaggagactgagaaggaaatcaatactctgtcctccttcgatggaatttaccggaacgacggaacattaagctacctgatgacagaggtatatatcagctgtgtgtacgtgttaaaggaaccattttattttatgtgacatttggttcttaacttgtcatatcgtaggtacgtcgactcaacaggaagatatggaggctccagaagaatgctccgagtacactgtcgagtaggctgttggcgagcgtgaaggagattgatgatattaaagttgagaagggaaggctgtatgcgcaattcataagtgcgttaaagaagctttgccgaaagaagatggacgatggtggtagtgccccatctgccaacaattaagctagccgatcaacaatgattgcctcccagtgatcgaagtattatcagccagtgaaaattgctgcatggaaaattttgcgatacttagtgcaaatggagagtgattgcatgcagtggcttacaatccgatggcatgcaggaatttttccacgatcacctcatcacctccatctctgcgagatgatcagctgacatctgatcttacaaacactactcatgggtaaacatggataagtgacagtacagttgttccaactcgagagaaggtcttagccgcgtgcttctgagaatattttccccctttttcaaatgtttcatctggacaacaacaatgaaataatagaagtcatggtctatgcgaagcccaataaaaaaaaaattcaactatgctattttattttatttattgaatgtgtttcatgttcacccatagtaaattttggatgtgtttaattattagtttaattctctacaaacttcactaatagtaaatttgaatttgtaactcaagctcacatcttcagatttgaaaattttttgtccaggaaagacgaaggtttctttgaaaaggttcttcatgtctagtttacaaatttctaatttaatgacagtcttgcattttattttgccaaaataaaagctttctgagaagagtttaagcgtttggagtaaaacatttcgaaataatctggacggtttgcaaaacatggtcacttccttcacagacaagttggagggacagatgttgtgtttggatgaatttaattaaaggaatttaagaaagcccaaataatgagctacttcaattcaaatgaatatatattaacaaaaaaaaaagcactgaaaggagggttcaatctggtaagaaggcatactgcgcattcatgctataataatatatggctaaaaagaggggagtgagcgtaccgggtgagaaggaaatgagagagatgaaaataagggaaatgtcatcgtaagtggacaaattccgtaatattttcttggaatttgatttcagaagtattattttgattgagattttgattctagaacatgaattctaaatttgacggattttgaaaggaaattgatgattttattttcaaaattttaatggttttttgcatgttttatttcgagagggattgttgctggcctgggaggggggggtggcggggaataaaatgtataagtgcgtatgtaagcaagagaaccgtttctcattaggaagaaggaggaattcgactgaaccctggtgatcaccgtccgatttagggtttggtgtgcacggtctagatcctctcctgatggcggttgcagggcaaaaatgtcatttcgcataggcataaccgtcatacctgtcctataaatagaggagctcatttcacttcactcacgcactccaagcttgagttgaattataagaggctctattgtactatattgtatactagaataggaagagagtagagtagaagaagtcggaggaattttggagttgtcggtaatcctctccctatttctttatgctctgttaattactctgattataatagaattatcttttgagtaatttagttttgctcggtaagaattatttcttggttagttcctattcagagtacatgatcatcgttcactataatcaactaaaatatagtgatttggtttagtgtgtagctagcattaaagtaagtaattaatctgcttagacatggtgtctaggtagataattgccggtgtttgctccgcatctcacagtaggtgtgaggtgggttagaggtggtgacagccctcaagacactaaagtcatccctgtctgggtgcgcagtagagcgatatctaggagcagcgagctggccagtgcccgaagtacctcattaggattaaagttaagctttccgtacacactgttattcaccgacgaaacctctctatcctttgcctatctatagcttcgtgtccttgcatgaatctaaattggagatagcatacacgttccctgtggaaatcgatacctgagaatactcccgggtgaagtgctacatcggtatattccgttcgcttacggatttatctgtgatcgtaagaaataccaacaccctccaccactgcactgatccaccaccgccaccgctggacctaaagccctctccactgctccaagccttcccatgttggatctaggggatccagtcgttgatccacaacctccaatcaaaacctaggcgccacccctgctgctagcagtaggagtcgcatcgctatcaaggtcgtcgtcctggggtcgcctccgctggatcctcatgaggccgacgatggtggtggtggaggaggagccaaggtgcgcggcagccgctcccatcgctgccaccactagcagtcggggtcaccgtcaccatcgaggtcatcatcccggggctgcctccactccggctttcacgaagccaccagcactagatctagccatcgtgaggccaccggtggtggaggagccgaggcgcgtggcggccgctcttgttggcccatgcttccattacaagatacacccattgctggccactccagtcaccgacaaaatggggaagaaatgataggggtagaaaaaaggagaatgaagggggagtgagtaatagtgaagtgatgggggaaacaggagaggagaatgaaaataaataaagggtgaatgaatggaattgcgtccggccgtatgatcctatctcaagagcggtcgacgcctcgtcctgtcttctcagaatccccttccatcagcgcaaaatccttcggtctcgtcttctgacatcgttcacctgcacttcaccgaaagcaattgggaagaagtcagaaagaagcattggtggcgaaagtcttcttcattcattcaatccaacaaccaagtgagcattcaatccagaagagaaaaattccttaaacacatggatggcaaatgcttttgctgcctgagcacccatcatcaaatttttgattgcagagaacatgtccgttgttggttctgtctgaaatcgggacaccttgtggctagttgtcacaagcgcttgagctataagagcaaccctcccccacctgctatgtccacagaaaacttcccagcgcttggtcccctccatttccctcccaaatctttctctgtctctgcttcttcctccatggacgaccttactgcccggcctttgcttgactctgtggtcgtctctaccactggggagatagagaggcgcagggagcgtttctctgcctgctccttagtagcttggcaagtcggggctttgggtgataaggtagaactcaatgtctttgctgatgacgtccgttctgccttccacattagacgtgctgacatccaatttaccaaattccaccccgaagacttctttgtgacttgctccaatcagagtgatcgggatgccattctccgccaaccaagacttgctacagcctctggtcgggtctttctctttcgtccttgggatgaaagtctccacggtgtccaagtccgctaccgctatcgcgcccgtctatgtatcgagggcgtccccatgcatggtcgtattgacgagacgatgacaaaggtgatcggtcgcaagtgtgctatccactatgtggaagagtactcccgtcgtggcaactacaatcgcacctacgacttgtggatgtggacagatgagccgagggctatccctcggggtggctccttctccatcaccgctgctaatgaggaggtgctaggggctttccactgatatccctcttccggaactagagccgcaccgcaaccctcctccctccgagccaaagaagggctagacctacaatgtcctggtccacgtcgacactctggaagatcttctctctcgcaaagcccgtgcttacaaatgggactatgaagttcaagatgatggcactcgctacaaggagtacgcacttccttgtagagctgaaccagacccaacccgtggccccgaggatgaagatgaagacggagacagccactccaggggctagcaccgtagtcgctctctctgggatcggcttagtggtcgctcctccagtcacagcagggatacggatcggtgggacagccagcgccgtgatcaggacaaacgaggccaatcacggggaaaggaacgctctgatcataggagtcgcagccaccggtctcgcgatccaagtaaggtgagaccacctttttctgcccaacctgtctctcattcggatcaatatgctaaagctcctcctcttgtctccccctctgttgcggccacaccttgcaagtttccgtcccctctccctagttcgaagccagatggagatgcggctctcactgtgcgctgctctgcttctgaggaacttgcaatcctccaatctgatgattccctcccctcgcaggtccacggggatgttctgggaatcctggaagccacctcgatcccatgttgcatgaagcggtagttcagcattctatttactcaccggatacagtctcccgtcgtgtttcttcccctatttttgtgccatcttacacagggtgggtggcgacctccaacccatcctctcctgcagtaggcaaggtgtcacagatcgacaatttcatcaacaacatcgcaacaccaatccaatctcccctccttccggctcctgatgttaaagcgtggaaaccttcccgtgcaaaggtgaagatccgtgccattacctcagcccaacaccatagtgagcgtttgctctgtaagtgccatgcgggcgcaaagctagagaatttaggtcaggaaatactttcaaaaaatttcggtctcattgatgattatgcatccttcgatgataatattaaaaagttgtatttatagcgctacaagaagccgctctccccggcttctctgaagaccattgctgatctggttgaaaagggaggatgcaagacaatccgtctgaagaccttgaagaaaaaagcggctatagcgccgctgtgaaggtcttcggcatgaagacagttgctgtgaaacactccatgtcaagtttcaaacctttgtcagagttcctatgctcaagctgtctgtgttgttgtcacgccctgaagttcccctcccttgctttaaatttgctaaataaatcgcatgaagaaattggttcaaattaacctagagatgaatccctaattaataaatgcaaataataattggaataggcatatggaatttttcttggattctacatgtcaaaatatgttaacaggatttttagtggaattttcagagctccagagataattttaatcaattaaaattgagcacaagcattaaaaagtccctggaaatccttttattttcctttttccctttttccttccttttgcccctcttttctttctttgggccgccaacccatttcttctccttcccctccctaaagtccatccgagctccccctctcctcccgggcgccgacaggtggggcccacctgtcgggttcgcccctaacctccagccggagggacggcctccctcctcaaccgccgctccaccccacgcccccacgccgcctgcctttcctgcgcccacgtcgccgcgacgccgcccacgctctcgccttcccgcccgcgccgcgcgcccacaaggggcggattcaacttttgaatccccttccctctctcttcctccccactcccccacgtcgccggcgaaatcgggagcctccccagccacgtccgcctccccctccgcttataaaacgctccccgtgtccccctctctcgtttttcactttcgccgtactcccccgtgccctcctttgctcccacgccgcttcacccatcaccaccgccctccggccgcgctccggccgccgctagccgtcgctagccgccgcgccaatcctcaccgtcgacgccgccgtgttcaccatcccgtgagccaccgtgtccgccatccgcccgtccaaatccaccgtcggggcctgcttgtccacgcgcaccggtgagcaccaccattgccaccgccttcggccatgggtttcgctcaccgtagaacgtcaccctctctctaattttccccgttgtgttctttaggtcctcccggagcccttccgcccgtcgccatcgtcctcccgtcgctcgtcatcgccgttcgccgtcgctccttccctgcgccgaccgagcccctcggtgaggactgaggacccatctccctccttcctccctctcctctcctagcgccgggccgcgcagccgccttcgcgccggccgctgtcgcctcccgccgccgtttgctgtcgctggcaaccgcgtgccgccgccagctccgcgcgcgccgccgcccccatggccggccggccggcttggagccgagataagccaggcgccacctcccctcccttggagccgctgctggtggggcccgcccacatgccgccccctctccctctctttgtgccactgacccgtgggtcctgcatgtcggtgcccccccttgggtgacgtcagccttgggacatattgcgcaataaataattaaggctttttcttttatagtaataaacacagataatcttctaaaattcatatctaattcatccgagctccgattaagtccattcaagtctcagtaaattcataaaaatgcatagaatccattaagaatggttttatttcatgtttcagtagacttgtgtgctttgtttgtcgcgtagatttcggccgtttcgtcgatccgcggtttctcgaagacgttgttgtggtctcatcagtgcgagagcaaggcaagtcatgcattacaattgatcatattgtacccaatttacaaatgtcccgcatttctattaaatattgcattcttttacaacatcatgtgggatgggtcctactactcagccatatattgtttaccttatgccattgataacttgggtattaaaatgactagatgttggtttaggaaatgcttagccatgcttagttcaactagtacacaaagggggaatcatattaatgcatagactttgattattggcatagctttggaatagagccaccgcaatggtgttagttaattaaaatacactacatggtgcgttgtgggtgcatggttttgctagtcgtgcccatggcgattaaggaccggttcacgggataccctggaagaacttatcgtacttatcataagccagcgtgggcaacgactgggcttgtagtgtagctttcctctagctgacgtacccaagcaagggtgggcgtgatggagttgggtcggccggggtgtccggttgatcggcttccgaattcaccgtggcacgagaggggactgcccgctgccttgcgaggagtgggggtgaaacctgaggtgtggtgcgattggttagagggggttatgcgaacggtcctgtcacggcctctttccggtatgccgtggtggcatgtcggcgcacggaaacgtgtcgtggggctgtgtcttgtgggtacagttgtacacctctgatcagagtaaaactattcgaatagttgtgcccgcggttatgggcggtcgaccagattcaccgtgattagtctcacccctagttagctaatgaactggtgtaattcaggtggttggttgggcttgttgcaacgtggtgtagcgttggacaatgattggttaatattgattaattactacaactgttttactgctttcaactattgcttttaaatgctagctttatgcaaaatgacctttagcctcctttggatatatcctgcatcatacatcctcttccggtatgacttgctgagtacagtgggtagtactcagtcttgctctcttttcccccacaccagagcggaagttcttcccagtttgagctgtctcagaaaggttggtttcgtcgctgccgtcaaggatgcctatagagtggagtcgcccgctgtaggagtcaagtctttaggcttagctcgttttaccttttccgctgcatttgtaatcttttatatttttgtaagacatggatctgtatgtcaacaattatcgtttgtgtaccctggttggtcctggacaggggtttaatgcacattcagcttagaaattctggttcgtgaatttctgggcgtgacagttgtaggcttttgcttcccgtgtatgactggggtcagttctatgatgtgttacccccctgtctcaaagtctctgctctcttctatcacctactcttcaggctgtgtttcttctagactttctagttgtgtttctgcctgtttgggtgtgatagctgccactttaatttatgtcgcaagataatgtgtacctgttcaactggaatgtaaggggtttgaatgccaaagctaaacaagattctgtcaaattctgcattcaacaacatggggcttcaattgtttgtctccaggaaacaaaagttgcggcgatatgtctgaccaacacatccttaatactcttggccaacgttttgtacatcaatatgcatatctgccagcagatggttccaagggcagggtgattttggcctgtgatgaaaacttcttctccctctctgatgttcacctgggtcaattaccgccgccgtcgtcaaatggagaggaggagggcgccgctgccgcggcaccaccgtcgccgccgccgggccgttggaccaccgccgtctcccctcccgccgctgccgtatccccttctgccgccaggccgtcaccgccatctcccctcccgccagatctggcggagggggagggcctcaccgccgggccatcggaccaccgccgcctcccctcacgccgctgacgccacctctcctcctgccagatctggcggaggggagggctccgccgccaggctgcaacatcccctcccaccgccgcacaccaattcggttgagggagggagggggagagagagagagagggggaatggataaggagaggagatgaatggataaggtcgatgtggccgggggttggttcagctcggcttatgtgggtgtcggttttataaaaaactggcacctataatatattatacgtgtcagtttttaatgatgctggtttttataaaaaatcggcacctatagaataggtgtaggttcttatttagaaccggcacctataattggttaaatgtgccggttttttactatttccacccgcggagatagggaaaaagcttataggtacgtgttttagcacttccggcacctataatggcgacacctatttaatgttttgtagcagtaagattggatttgccaaaaatatatactccaacaattaatgaatggacaggaaacaaacaacgatcaagtctaaataatgactattattagttgcatcgaaatagtggtatataactaagcatgccgtgatgatatcacagccattgaagaaattatattggaaaggttgacaatttgtaatgaccaatcgagccagcctagcaagctagtataaattaactggtacctcatcgattgaacatatatatgcattaatccatcctgtagctggctactaactaaactcagagagagagagagagagagagagagagagagagagagagagagagagagagagagagagagagagagagagtgtgagtgtgtgtaaatacaatgagcaggtcgagcatgaccgccgtcctcctgcaggtagtgttgatagcgatcaacgccggcagcttatgcagcaaaggactgggtgaagctcagccttgagctgccaccgcggacgccgcctgggcaggagccctccccagcggcgtaccagttctcccgtaccatctgcagaatccccaaggatcctatctacaagatctgctgcttcggcgaactcctcccgtacgccgagtccttccaggacaaccaaatgaaggccacccaagtggccaccatcatcctgctcaccaagatccaggccctcgatagggaggtgggcgcggtaagaagcggggcatcagggacaagaacatcgacgactgcacatcgttcttcggcattggctccagcaattcagagtccaccaactcggtgcttgccgcactcgaccgcctcgccgccgccggaaaaggcagacgcaagaaggaggacgtggaaacggtgctcaagtggaccaagaatttggagacccaatacaacggggccacaagcaagtgcaagttaggttatctgttcaagtactgtgacatggttcccaccgttaaggagattgacgcggcgacgaccatcaccatcgacctcctcaatgccataaagctgtgattgatcatccgatcatcagttagtgatatgtcctgaggacaaaatcatagagattattgtattgcacactatatttatttatttgtaataaagtgttgcttaaatagataacttaggctgtgttcttaccttcaagttcccaacccctctccctcgtttttcgcgcgcacgattttcaaactgctaaacgtgcgtattttgcaaaaagtttctatatgaaagttgcttaaaaaaatcaaattaatccattttcgaaaaaaatagttaatatacttaattaatcatgcaataaggtgtgctccgttttgcgtgccggaaggaggggttgcgaacgcagccttatatattatccatcagtgagcatgtgatttgttaatgaagctctttgtgtatgttgctatttctaaatgatttctgattgtatgtcatatgtggaacaagtgattacaagatcaacacatgtaatgattgatgatcacttttcatggattatggtaaagatacctaatcaataatgtgaacaatgtgttggatagacccaacctaaaatactgcatgattacaatggccaacaattgtctaggattatcatgattcccaacatgtgtagtagcatttagatcctttgttgatgctcctcctcttagacgccacagtgccagatccacctctcctagcaccaccactgtcaaatacaccacccttgaggccagccggtggatccacgaaggagggggagaagctactgtccatccgccaccgatggatccgcagttggctaggccaaccgtctgttggtatttcttaacgaaattattagaaatataattcccagcaatggggacgaaatattctcggtatactttatggctacagatacaatccgcaaacgtacggatatactgttgtagcatttcacctcggactattccaaggtatcgtatttatttaatcccaagggaagatatgataagagattattatgctaataatttatatcacttgtatatatcaaagtctaatgcagaggtaattaattcgtgggacacttttatagaatgtgttgacacacagaagtaactaaccaaaatttgagggtagaatgtgttgacacactgaagaaagtaaccagaatactctcattaatatgtagtccaaactaagtgaagaaataataagaaaagtgtcatttctgtacttctaatatatagtcaatttagtctacatttgctagtatacaactatgcaaccaataccacctaactatatcctcctggtgtatcgagaaaccatccctgattgccgacttccttatgacaacctgtcatagacatccaaccggtaatgaatacgtaggagtatccacactaggaaatttgtggaaattctcttagtattatatacacacatggaggatacccgtactgagctatcaccatcagcggtctacgtctacagaccagtagcacataacaccatttaatggtatataataatctaagcaccgcacttacattactaaatactactctacatttctgcaggtgacatagagcaatcatataaatgaacattaaacaaacaccattgcatatatccaataagctagctacataattataacgagacaaatatgaactaaagtcggtattcgaataattatacaagtgaagtaaaagaccgaaactatataaagaataatatttcattaatgagtaaagtcttataatagaaagaaaagctactagagccatatccgaaatcttttgaagacttgaagaactaaggaaactattctattcctactccactagcactagaacaatgtaaataaactagagagtgtcttgaatttgatccttcttggtgcactttggaatggagaagagaaaattccctgtgtacccctgaaacttcaaccaatcccttctatgtcccctgagatttgcccattcccttccatacctctaaatttcagtttggatcccttctataccccttccattagttgaccgttaaatttctatcataaagtccattttgctatttggtatcaagaaaatataaatttatgaagtatattgataaagtgtataaatttattatatgcgactattatatgtatgagtttattttgtgagatattatttaacaaatgtaatattttggtttcgcctcacgaagggaaaaaataatttttatctatgacaaaatttatttgagataaaacaaaaaaaatattttttaccattaaaaactatatatatagcatattttgttagagtagtatgaaattttttataagataaatcttgttatgcgagataaaaattatttttgttaaataatatctcacaaaataaactcataaatatatttaggagtataaaagggatccaatctgaaatttaggggtataaaagggaatgagcaaatctcaggggtatagaatagaaggggttggacgaactttcagggtacacagggaattttcttgagaaggtgagctccttttataggctgctaatgacggttgtgacagttgaaattgtcctaaatgccccgtaaccgtcattggggagtgaccaggaatgtccggtattttacaattggtcgtagcatcatcgtttcaaacacacatatacactcatcatacaaaaaatcataatgagagggcattagccgcctaagattcttccatcgcctaccatcggagccggtcctcaaagtcgttgcgtgcttatcgtggctcgaacctttgcccttcgtgttggccgctggcaacaagcgtggatgatgcccgggtcgaggacgactaccaggatagcattccggtggcatcaccaccactggcagaatcttctcatgttctttttctagtttcctgaacacaaactaattcataatttaaaagaaaactcagatatgagtgaggaaggatgtttggaatgagcatcgaccgtatggggttgggtatcgaggttctaaatgagcaacccaaaaaataattcagacatgaatttcttcggcggaccattgccaacctccaggcacatgcatcgagatgtgcctccgcctgtaagagtgcacacagcaactgctaccaccatggtcacaaataaattaaattcagaacattctagaatgaagaaatttattgtcaaaatattcagagaaaacctagcgtattcaacagtgttatatgcagtgagcaagctattaatcatattcctcgtaccattcaacttttatgttatgaggaatccacttcaatttctctactattcaaccagaaaatcacatcacattaacaaaatcccagtaaaaaaaaagattaacctacaacttctcctagaatcttcagttgccagaagctccctcaaacagttcagcttttatccagattctgagaatacatagttgtagtcttttataatctggaacatgaattagaagccggaagcttctccagatttttaccagctagcttctcagcagctgcttctcagaattttaagctccccaaacagatcctaagatgcattgcaatcacttacaaccggaagccaccagatcggagtgattaggaaaaacgacagaacaaacaaaagaaaaatgatcatcttcctttgctacatccacaggctgcattggggcaagtgcattggcctccttcatcgacagcctctgaccgtggagggaagtgccaccaggaacgagacctggttctcccggcggtatcgtcgtcgtcggggctcagggcctcaggggcgatcccccgtgttgtgtgagtcggaagcatcggtggctgcgcgcccacctgcatgaaccgttctgatcctcttacttgccttcggattttggtgtcgaggacacgtgacaaggcagaggcagcatgggcggttcccctgccgtcctcgccgaatccagcgtctctcgagccggtgccgctggatctagcgctcctttcttcttcctctccgtctctcttcctggggcaaagaagcaggtggctggatcggtgaggctggtgacaggtgccgagagagggatatggaggacgccgcttcatcctcgtcgccgctgctgctccttgacgttgccgcaattgctccgtgacgctagcgttgctgctacatggatgccgttgctcctagccagggtcgtcgccactgccgtcgctcaactgctccaccgagccgccggagccaccgccctctcacatcccaaaaaatatacgatcgggattgatagggaatgaatgtatatgtggttggttagccggggccgggggaacccaaaccttataatccagtccatttaactccctaaactgtttcacaaggcggttttgcacatatggcgggctgactgaaccgtatttgccacgttgtcatgctgaccaggcaattgcaaagtaacaagagggaaaagtggagcgatcgcgaaataacatgagggagggaacgcacatcagtctatatatcattcttgcctcatcgtactccctcatcccatcttctaggtttcttctctcgagtgttgcgcccatggcgaccatggctgcgtgaatcgtgatcacgcacggacgggaagatcaaggtgatcgcggagtacgtcttggagtaggtgagatccctgactccattgcagtgtttgatgcaagaaggtttcttccctttttatctagggttttgtggtgattgttttactcacattggttgacagcctccacgagggaggcatggagtcaagatataattatctttggtttctttggttttgatttctttagttctgtcattgaggtttagggctttgatgtttttctgttgcatagtgcagatcgatgtgtgtaggatgatcttttctaatcttgtcaagtctagtataaattaaattaatttcgtcttttataatgcagcacaagctagaaagaatgaataatttggagatacttcttgtcagattttattatagtggggagtttgtcaattctagaaggattgtgcaatacgttggtggagatgaagggatgtcatatatagaaaaggacaagatttctatgcctgaaattagaggccaccttgcagaccatatcgaggtcaaggatgccatgcagctccactggttgtttcccctggaaaagaattaagcacaggattacggttactgacagagtgatagataacaaggcatgccttgatatgtcaagttgcattgctgaaggtggagtggctgaaattttcgtggaggaaacaatgtcatattataattctgaagaaagtgattgggaaactgacaatatgaaatctgatgagatggaaaacgtggaagggacacaatacgatgcaaacaaagaaggaagcgtgggagaagatagtgacactactgatagtgactatcaaccagaaagtggaaatagctctgcagatgatgagtaggtagtaaaccttacagaagtttgctgagatgtataacaaaaagttaaaagcaatgaagctgattctacaagatcctgatgcaaacagtgtgcccgttgagttaataggtcatggagatgatagcttgaatgagataactgatgaacctacatatatgattctagtgaagattattcttgtcgaggagtgatcctctctagtgggaggttgtgagaccctccttttgtgagttcggccgggggataaggcgcgatgatcaagagcgcatctccgcttaaggtcgggctactagatcgcttacgaatccgtgagagagacaagggattatacaggttcgggccgccgggaggcgtaacaccctactcctatgtgtgaaattatcgtggagatcttacaagagatcttgagctcctgggaaaccctagctgtgcttcctttagagttcgagctattaagagtcgtccctcttttcggtgggtaaggtcctcctcttgtagttcaaggggataccacatgcaccgttcatccctacccctccatgggaggggggcccacatagcctgagtcagatcactatccgtgccttcaaccggaagcaaagtggttgcccgcccctaggtggggcccagcgccgtcctccgcctgacacggaggacatccccgtcattccctcttaaatgcatggagactttggtggattcaccatatataggggcacacttggcagcgtgccgatgggacagggcatacctgcccctactctgccagacacaaagcgggacatggaggcactgccactcgtcccatccgcctgcagccggtcgcaggccggtcaagaccgattgacatgcatcaatcgggcggcgccgcacgcccgcccatgccgcattaaatgcggtgagggacggttgcggcgccgcgcatttaagacgctggacagcgcctcgtgctccgcccactcaccccgccacgtggtggccggatgagggcctcggggtagtatgcctcacgggcccgagtggtgtgacgtggcaccccgaggccccctggccacctcataactacctgacctccccccgagggggtgggggaaaaggcaggccgcacgaccacgtggccagatgggaaggttattctcctctaccgtgcgtacccccgggtccatatcaccgacaattcttatgacgatgatagtggtgaagacaacgaccatatagtgaggagaaagagtaggtggagaaagtatgactctaattatgctattccccatttttcggggaaagaggaaatgaagaaagctttacttaagtaaggaatagttagtcttaataggtgcttattcaaaggagcatgtaatggagagatgctttgtgccttaagaagggatgcaaataatcaaatgtatcccatagcatgggctattgttgagaaagagacaacaagctcatgggaatggtttttggatttgctgatcaaggatctaaacgttggcaatgatggagaaggatgagttttcatctatggtcaacaaaaggtaatataaaattcactagtcaattcatgttttagtgacttgtaagtactttcaattaatatggccaataaattttcttatgtagggcttgctccatgcattcaataccttcttgccaagggatgagcacatgatgtgtgctaggcatatatatgccaattggacgaagaaatacaaagacctaaatctccaaaaacgattttggcgatgtgctaaggcatcaaacgtagaggatttcaactactacagaccaagcttgcacaaaagactgtccaaggagccaaggatatgatgaatactgaaccaaaacattggtgtagagcttggtttgaattagggtcaagctgtgactaggttgacaataacatgtgtgaatcatttaacaattcgattgttgatgccaggttttatcctgttatatatctcaatgctagaggcagttaggcgtaaggtaatgatcaaatttcaagagaacagaggcaaggcaaataagtggcagggcatagtgtgtccaaatatatttaagaagctcaagatgaacattgagaggtcaagtcagtgcaatgtattttggaatggaaaggatggatttgaggtgaaagaaaaggagagaaggaggtacacaataaacttgcaaaatatgacatgttcttgtagatactggcagctatctggactgccttgttgtcatgccttaagtgctatttgtaagtcaggacatgccacaaatggttttattgctcaaggctattcaattgaagagtataagaaaacatatgatcattgcatggagcctttggaaggagaggagaggtggcctacatctgatcatcaccccaagccttcgccacctagttatgtcaagatgcctggcaggccaaaaggaaaatctaggaagaggaagcctggtgagaaacctaaagaaactaaaatgtcaagagttggcacaattatgaggtgtgggctttgccataaaactaagcatagtagcaggggttgttcacccaaagagaggggcaagaagaaaaatgctcttgtcacaggagctaatagaaaaagaaatcaacctaatggagcaaaatcatcgactgctcatacagaacaacaggcaatcacatctccctttaacttttttagataatggaaataaatccggcctttgctcaaaaagagctacaaccacttattacacaaacttgttcaaaagcgaacacaaaccacagagttcacaagacacactccgaatttaacaatactcataacacaaactaataggcaccaacgcaagatagagaaaacacaattattaaatcctatttgtaaatctccacccgaagttggcgaaaatatgcatgaccgttgactcaagtttgtgacatgcattctttattagctaactgcaaatttaattttaatgtgatcctgtgtgtttcaaataaatgagattatagagaaaatgagattcagtatgacttgtgtacattaaaggcatcacatagcttgcaaggagcaggggaaggaacaattcacaggctaggaaaggtacctgtaaggagctccaagaaggtttcactgaagggcaagccaactagaccaacaatctgatcagcagtgttttttgtgtttatacatgtattcttgtcaagatctatgttccttactagtttactactattggaattaatagatgggtcttagctcacccgaagattaattctttggaaaatcacaaaagcccacctcatgggatagcatgcatggggagtttagtaccaccttgcttattgtaagagggggacctccttaaaaggaaagatgccctcctagccacttgaaccatgctcgccaggcctggcctggcagcgcgtgcacgacgtacgcatcaaatggtccgccaatgtgttgcaccgtcgctcgtagattactccatcccgctcaccggcgtgcactagctatcgggagagtaagtctccggaacctctgcctttgacgtcctactccaggagaagacaacaataaggtttttgggaagcactccgcgagactgctccctgtttgtccacgacgacttgcgtcgtcctcaacacccgcaacgcaagtaattcctgctgagcaactggtcttccggtactctcggtacgtgctcaacatgttgcacatatttgatctgttcatgttgtgctgtctagtttacatgtaaagattttatgatgcattcatgctagtttacatctgcaatgtcatgatttatttatggaataaattaaatcattatgtgcttaaaatttcaacaatccaaaaaaccttactataggcactgttgttttactatggctagttttgctgatgcactgaggttggataaattcaccggtgtgcattttaagagatggcagatcagggtcactctgtggctgacagctatgaaatgcttctgggtgagtattggcaaacctgtcatgcctggaatttctatccaaaattccaaacacttacatgtgtgtaaaccctcgtccaggaatcagccgaggcacacaataacaaattaataatagagtacaattattattctaattaataagcgaatataatatcattacagaggtagatagttcctctcaaacaataaagttctaagcagcggaaaataagataaacggcgcagacgactccatcccacaagcagctcaaccagggctacgcctaatcctccacaccatcaacatcactatagaactcctcctctgatgaatgattgcaaggtgagtatatggcatactcagcaagccacgcagcaaatatgcaagtgcaagggattgcaaaggatggcataatatagtctcatttgcataaatagcatttaataaatatttcagaatttaataaaacaatagagtatttaaaaacaatattaatccaacgctatacaacataccctgttgcataggcccaaccactctgaacaaccaatcccggctgcacagttctatctccaaaccaggaatataccattccaaaccaggagctaaacaagttattatctattacagcatcattttttatggtgagaggtgtgaaactaatcacgaaagatattgttagacccgcccataaccgcgggcacggctattcgaatagttttactctggccagaggtgtaccactgtacccacaagacacaacctcaacatcatgtcaaccatgcgtcgcgatacttaacaagtacccgaatagagattgtgacaataccctctgcataacacaattcaaagcaatgcaccgttcccggatcataatcacccccttgtaaacaaggcatgtgtcacgtcctgataaattcatcccgaaataaaaatcatcctctaaaaagaataatagaattaattaaaatttgaaaagaaattggcaaacactaaaatacgtgccagaaaaattcgaatgtggtccggagaatttttgttaaattctccttggtctaaaaagagccctccaattttacttgaatttttagagcaccggaaatatttattaagcaacaacaactatgatcaaagtttactaaaaagaaaagctaaaaataatccttcttcctccctttctggcccaaagtcctctctctctctctcggcccgcggccaaagtcctctcttcctccctctctttctctccctcgactcctctccctccttctcttgggcctcctctccttcccctcggcccagctccctcctccaccctctcttccccaggccgccactccctcttctcctcctgggccggccgcccggcccaagccacgccacctagctgccccagcctcccgagccgcccccccccctcacgtgcgccgcacgcgcgttgcatgcgcgctgaccgtgtggggcccacgcgccggtcgtcttcctcctcccgcacggcctcctccctctcccgtgaaccctagctcctttcctccctcaaatccgtgcgatttaatcatgggattccaaaattaaatagggggaattaatccccattgattcctctttgatttcccccgttttcccccttgaatggcgcccccaatcgcccggaacggccgcgccattcccggccgccttccatggccgccggccatgtttcccgtcgccgttccgccctctcctatgcccagctccctcccctcacctataaaatggaaccccctccgtgcgttctcttgttttagcctcttcccgagctcccccgtggccgtaccacctctccccgccttctccttctctctctccggcgccgatcggcctccagccgcctctccctcctcgcccgagcgccgtccggtcgcaccgtcgccgccctcggcctcgcagccgcctcctctcccccggtcagccctccgtttcgcggggaaatcaccggagacgcgtcctcgccggcaaaacagtggcgttgccgccactgtactgcctccagccgcccctgccgtgccgctcaggtgcgggccggctgcgccgtctcctcccttggcgtcaccgcgtcgacctccaccccggcctgccctcggtttcgccggaacgccgtcgcccgcgtcggtctcgccctccgccttgccggagttccttcggcaaccccttccgccgtgcccgtgtgccggccgacgtcgccatctcctcctccggcatcgcagcggtaaggtcgccctcggcctcgcctccccttcgaccgaaccccgccggtgttcgtcgtcgtcgtcatcgttcctcctcgccggctcgtcgtctcgcggcgccgcctccgtcgtcggattcgcagcggcgtgttccacgccgtcctcatctccgtgcagctgctgctagctgtcccttgtcgcctcctcgccggccccggtcgtcgtcgtcgtcgtcctcccgtcgttcccggtcgtcgtggcgttcgtccctccgtcaagccattctcgtccgtcgtccgcgtccgtcaagtgtgccgctgcagccccgtcgtcgtcttcgtcctcgcctccgcgtcgtcaagccttgtgccggccgcgtctcgccttcgtccaaggatcgccaccgaagtcgtcccctcacctttcgtctccgtcgttcctggccgtctccgccgggcccattcgtcgttgtcgttccctcgccacgtcgcgtggtggtaaggatctctcctctcgctgccccgtcctcgtcctttcggtgccgcccgtgcccgttgtgcggttgtcgaccccggtacccgtgtaccggtgtcggtagtcgtttgcttgtgcgtgtggtgaccatgttagtgtgcccgctcggtagccgcgtggtttccacgtgtgcagcccgtgtggtgtctagtggagttcgtttgtcggccactcgcctcggttgacacacaggatctgcttccgtcgacccgtggaccgtctctgtgtacccggtccagcgtggtcccttaggttggcatgtggagtccgcatgtcaacagcgcagccttcctgtcttttccaggctagcgcttacacatgttttatagttgtaaaacctaattacaataatccgcaaatctccatgtaacagcattaaacttcggatgatcatatcttggtcatacgagctccgaatcgatccgttcaagtctcctaatgtttgttatatcctaaagaaccctgtgctttctttttatgtattgttattgcttctttataggtttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactggtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcatacctcaggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctgcctgtcccggaggttccggccgtaggtgggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctaatcagagtataacctattcgaatagccgcgccctcggttatgggcaagcctagcaatgtacccaagttagtgtttcaattcttaaaatttgcttaacaactaaaatgtggaatggttggcctgggttggcttgggacgagctgggacccagggttgggttgccagttcggtctgaatcatcgtaggccttgggttaaggtaggttcgtgagggttcacggccttgattaataacactgtgtaactctaggatcgtctttataaaatggctttgggcaactaagtgacttttaaatgctgttttctgcaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctatgaagatggagccgtaggcccgctagtccgctgctgtttatttttgattgtcaggccttaagtgcctttgtaataatgtaaatattatcgatataataaagctgtgtcttttatatcatgtttgtgtggtgtaccccggcttttcctgggacagggattaatacactagcgttcgggaaaatgtatttttctcggtcgcgacagcatggactccccagcgacccccgtgggcttatctccgccacttcacagtctggtgctccgcaatgaaccatactatacaaaaagtaaagccgttgcccacgctggcttgtggttggcacgattaatgtttcacaaccgaagatcgtgaaccggtccttaattgtcatgagcacgaccatcaaaaccatgtgctcacaacccaccattatcagattttagttggcacattaattaattaaccaatcacgattaaccatcgtgaactatcattaagccatcattaaatattagggaatcataagtatcccatttatatgagctagtgtctctaagcaaggctaagcatcctattcactttagctaaaaccatataatgttctagctaatccaattgttaaccaagtgacaaagaataggtaatcaataacaaaagggctataacaaggcaataggttatttccacccaatgacattcgaaaataaatgcaatagttgaatagaaacaatagctttaaacgggatcaacatgctcaaagggtcgtttgggatctgtgtgacttgccttgctggccttggaactcttcaaaatcttctcctgcaaactcaggctctccgggaacgtcggaatctaagcagaaaagaacaaaatcaccaaaatagcacataaacactcatgaacagtacatgtggatatttttaacatgtagatctcaattttagaaaaatttagagacttgaaccaactaaatccgagctaagatgaattagttatgaatttttaaagattaaatcggattaaaccatttatatagattttaattgaattatgacgcaataaagaattatttttgaaaaggaaaagagatttattgctcagtgggctcgggtttacggtggaccgggtgcacgggacggtctaaggaaacgaatggccgagatcgatcctatccaaaacgaacggccgagatcgaatcggtctaccgcgggctacggctgatgtcgatgatgacgtcggcgatgacgtcaccaccggcggcggctcagccacgcacgctcgcaggcgaaagacggtgcgacggcacaaacggaaggcatctacgcgaagagggcgatgcggcgaaccttaccgaggcacggacggcggcggacggcaaccggacggcgacggcgacgaggttggagcggcggtgatgatcgggtcgacgacgacggcggtgctccggcgatcttcggcggaaacggaggggtggacgaggacggcgacgacctggcgaacccgacggtggccttctcgagcgacgacgacgaccggagcggcggcggcgcacggcttgacgcggctagagcactacgagcggcggcgagctacggcgagggtggcggcggagagaggaggtctcgagggtccttataaagggctagagggcggcgatggagacccacggcaaccggtgacggcgatggaaggtttagtgttcgggaggaagaaggaatccgaatcgagctcgaatcccacgatttccaaacgaatttagatgacgattccaaaagagaaaagatagaggggatcccgaggatcatttcccctctattgattcgatcggatcggaaaaggagcggtcgaatttggaagggcggcggcggcggcttgcgcgcgttagggcgcggctgcggtgggaggaagatgacggccctgacaggtgggccccaccggtcagcgggagagagaggggagcgagcggcggctcggctcggcggactgggccgggcgcgattgggcggggagagaaagagaaggggttttgggccgactttcggcccaaagccaaaagaggacttttaaaacctttttcaatttaaattattcatgaaatgcaattccatttattaaaaatacttccttggctcaaataaatccccgaaaattctaggaactgtagaatcaaatgaagtatttaataaaattttatctagcccacttttatattggaatttattatttaaaattagatcttttcttctagacttttaaaatcatttctaataattccaattaagcaacaatttatatatttggggatttttagcgtgtgacaaacctaccccccttaaacagaatctcgtcctcgagatacagaagagctggcgaatagatgcggatgagctgattttaattcatcttctcgctcccaggtagcttcttcttccgagtgattactccattggaccttatagaaacggataactcgattcctggttcttctctcatctgtttccaggatatggattggtttctcaacatatgtcagatcctcttggatttctatctattcaagattagcttcttcagtgggtacccttaaacactttttcaactgtgacacatggaacacattatgaacacctgccaaggattggggtaactccaactgataagcaacctcgccacttcaactaacaatcttataaggtcccacaaaatgcggtgccaattttcctttggtgtgaaaacgatgaacccctcgaagaggcgtgacacgaaggtacacatgatctccttcctaaaaacttaaatccctgcggcgattatccgcataactcttgtgacgagactgagctatacgcaatttttcttgaatgatctttaccttctcttctgcttccgtcagaatatcagtcccgaaaacctgatgttctcccgtttgatcccacaaaagcagagtgcggcacttccgaccatacagtgcttcataaggagccatttaaagactagcttgataactgttgttgtacgagaattccgcgtatggcagattcttatcccaacttctaccgaagtctaaagcacaagctctcaacatgtcttccaaaatctgatttaccctttcggtttgtccgtctgtctgcgggtgataagcggtactgaagttcagcttggaacccatttcttcatgaagtttcttccaaaactttgaagtaaactggcaacctcgaccggatactattttcttaggcacaccgtgcaaacacacaatccttgccatatacaattccgccaaatgacttctggaatatgttgtcctcacagggatgaaatgagccactttggtaagcctgtcgactatcacccaaatagagtcatggcccgatgatgttctaggtagaccgatgatgaaatccatcccaatttcctcccacttccattttggtatctttaaaggctgcagcaaacctgcgggtttctgatgttctgccttgactcgctgacaaacatcacacacaactacatactctgctatctcacgcttcatacttgcccaccaaaatttctccttgagatcttggtacatcttggtattaccagggtgaatagagtataaagtgtcgtgagcttccttcagaattgcatctttcaactccttgttcctgggacacaaattctctcgcccatccatacggttccttgctcatcttccaaatacccgatagcctttcctcttctcatattcttcttgatctcttgaatatcaggatcattgacttgagattctctaacctgatcaatgagagtgggctttgcttctaatgctgctacgaaacctttactgacaattcccaaattcaatctttcaaattccttgcataattcccacgacaactgtcgtccttctgtagcactgcaatagcctttcctgctgagagcatctgctacaacattagcctttcctggttgataatgaattcccatgtcatagtccttaatcaattccaaccatctccgctgtctcatgttcagatccggctgggtaaagatatacttcaaactcttgtgatccgtgtacacctccgtacgagtaccaaagagatagtgacgccaaatcttcaatgcatgaaccactgcagctaactcaagatcatgagtagggtagttcttctcatgcggacgtaactgacgagatgcaaaggcaaccactttcccatcttgcatcagaacacaacctacccaaacttagatgcatcgccatacacttggaaacccttctttggatcaggcaaaatcaaaatgggtgctgatattaagcgatttttcaactcttgaaaactctgctcacattcttctgaccacttgtacttcacatctttctaaagcagtcgtgtcatgggcttagcaatcttggaaaaattctctataaacctccgttaatagcctgcaagacccaggaaactacgaatctctgaaactgtcttcgattgtttccagttggttacagattccacattactaggatcaacggcaactcctccggctgagatgacgtgtccaaggaactttacttcagacaaccaaaattcacatttgctaaacttggcatacaattgatgctctcgtagcttctctagtgcaaggcgaagatgttcttcatgctcctctttggttcgggagtagataagaatgtcatcaataaagaccaccacgaacttgtccaggtattccataaacaccttattcatcaagttcatgaagaaagcgggggcattggtaagtccaaaagacataacagtgcattcaaacaacccatatcgagtggtaaaagccgtcttaggtatatcttcctctttgatcctcaactggtgataccgtgatcgaagatcaatcttggagaaaacggtggcacctttaagctgatcaaacaaatcatcaatcctaggcagcgggtatttattcttgatagtcacctcatttagtgcacgatagtctacacacatcctctgggtatggtctttcttttccacaaagataactggagctccccatggagacgaacttggtctaatgtatcctttctgaagcaaatcatctacttgcctcttgacctctgctaattcattggctgccattctataaggtctcttatggatcggagttgttcctggtaccagatctattctgaattctatatctctcttaggtggcatgccaggtaaatcatccgggaacacatccgggtagtcccgtactatgggaatctcttccaaagttatttgattcagacttgaccttaaaggctcggaaggcaatgcatgaacagttacaacttgcccgtcattgttggtgagagttacttttctattggcatagtctatcacacctttatatctggttaaccagtccatccctaggatgacatcaaggtctttggattctaatagaataaggttggccagaaatggtacaccttgaatctctatactgacgttgtgatgagagtgcctggttactcggggtactaaccatcaaaggacgtctaagatcttctatctccatcccatgatttcccgcaaaactcaaagataaaaaggaatgtgtagcaccagaatcgaaaagcactgttgcaggaactgagttaacagggaacgtacccaaaatcacatctggagcaccttgggcttctgcagtagcaacatgattgacacgagcctttgtcgctggtgcggtggagttgttctaggcagggacaaccttcatgcggcggggcttcggacacttgtcagaataatgacctggctccccacagttaaagcacactcctagcttgttaccttgctccctcttggcaggctggtgctgggttggagttgcaacagggcgtggagcttggttgcggttgttgttgctagtattgttgttgaagaactgacgctgcggacgaacaacagacgaagatcctccctgcgacactgcctgaggtcccatagcaagacgcggcctctaactattcccctgttgagctttgaagtgagcaatcctgcgtttcttctgctccatacggttgtacttatcctcctagcgaatggccttatccaccaacttctggaaaatcatgataatccccagtcattaatgggtaagagagctcatcattcagtccttccaagaacttctcttgacgctcttcatcggtgcacacatcttccgaagcatagcgagccagacgattgaattcatgcaagtattcggtgacagagcgagatccctgagtgagtgccctgaattccttcttcttgagagacaccactcccgatggtatgtgcgtcttccggaaagcagcagtgaactcaagccaagtgattggttccacggtagtcctatttagacggaaatgatcccaccactcagaggtagggccatgaagctgatgtgacgcgaaggagactttttcttgatcggtgcactgaagcaggtccaacttcttttctatggcatgcagccaatcaccagcctcaactggattggtagtgctagaaaaagtgggcggcctcacacgaagaaattctgctaacttgttctggggaggtgcatggttgtttccctggttctgttggttctggagttgctgcatcatcatattcataacctgtgcctgttgagccaggacttgggcaagcgtgggattctctccattattgttgttggtggtgttgttgttgttggggccattcccattgctgcgagtaaacaccatctggcatagacaggagcacaagaagagaaacaggggaaaaactacttaggacaggaaattaattttttacaatcttgacttttattgatcttaactgagtttcattattacatatgtctgaagactctcacaccacaaaactcaccaacttcctaacactcgaaagcaaacaaacgcatgcacttacatcccaccaatgatgtaaaccacacgcaagacccacacacacaaccaaacttaaacaagcaaactaacacaacgatctaaggcaatgacttaacaagacatctaggtcttccgggcatcggagttgattgaaggctcgtttggctcgtccccatcatctcgagtagctccccactcgacctttgaatgggtgcgcttcgattcttctccatcatcatcacttacgttgacgatcggaggatccgctggggctgaggcggcttctttttccaccacacgaacctttggcgccaactggtagcgagggacaaatagagctctcttccttgcggtaagacgaaccctagctttttgtggtggtgcttctcccttcaatgcggctagttccttctccaaacgatccaccttgtcttccagcttgcaaatcttaccacgattccggccttcgcgatcttgagctgctaacataatctcagcgcaggtctcatccatggcccacagcatctcaaccaaatgcctggtggtagcatcattctcaatccctgcaggttcaaggtagctgccacggtcacttccctggggttggcgaggatgatagcgatactcagtgtcggccaactgatcattgtagctttcgcggagctctcctatggtgatccttgccacctcctgacaagcatgaatgtagcttccccctccagcctcgaacatcaccgatgggatatcttcacgattactgttcaaggtgactttgacatggcacttctcttcatcatgatcatgaggaatctgggcatacaaaggggcagtcccgaatcctatggcaaaggacaacgtacgcaactcctggacaaatccctcagtaccgaacaagtactcaggcttgaagcgcggcatctaaagacaagtgaaaggagggagttaagacatttatccaattaatagcacaagtttttggattaattgaataaagttagaaaatcaaagtgaagggtaaattaataaagtaaaccaatcttgcaagataagttgaaacagttgaaaacaggataacaaattttgcacttttgagtaacaggtttcaaatagaatgaaataaaagagagttataaaatcaacatgctaagttatgttgcaacatgattaaataaaattatgttataaaacttttactggtaaatgggccattagtacagtaatagatgtacagtactaacaacacaggaataataaataaattttgaatgagaacaattaaagggactataaactgcatgtgctattagcttgatttaattaaaagagaaagagaggagaacagttctacttttttaatatttttagagggcttctataggtaaccatttggcataacctagggtcaaggaggctctgataccaacttgtcactcccggaatttctatccaaaattccaaacgcttacatgtgtgtaaatcctcgtccagaaatcagccgaggcacataataacaaactgataatagagtacaattattattctaattaataagcgaatataatgtcattacagaggtagatagttcctctcaaaataagataaacggcgcagacgactccattccacaagcagctcaaccagggctacgcctaatcctccacaccatcaacatcactgtagaactcctcctctgatgaatgattgcaaggtgagtatatggcatactcagcaagccacgcagcaaatatgcaagtgcaagggatagcaaaggatggcataatatagtctcatttgcataaatagcatttaagaaatatttcagaatttaataaaacaatagagtatttaattaaacaatattaatccaacgctatacaacataccctgttgcataggcccaaccactctgaacaaccaatcgcggctgcacagttctatctccaaaccaggaatataccattccaaaccaggagctaaacaagttattacctattacagcatcattttttatggtgagaggtgtgaaactaatcacgaaagacattgttagacccgcccataaccgcgggcacggctattcgaatagttttactctggccagaggtgtaccactatacccacaagacacaacctcaacatcatgtcaaccatgcgtcgcgatacttaacaagtacccgaatagagattgtgataataccctctgcataacacaattcaaagcagtgcaccgttcccggatcataatcacccccttgtaaacaaggcatggactccccagcgacccccgtgggcttatctccgccacttcacagtctggtgctccgcaatgaaccatactatacaaaaagtaaagccgttgcccacgctggcttgtggttggcacgattaatgtttcacaaccgaaactcgtgagctggtccttaattgtcatgagcacgaccatcaaaaccatgtgctcacaacccaccattatcagattttagttggcacattaattaattaaccaatcacgattaaccatcgtgaactatcattaagccatcattaaataatagggaatcataagtatcccatttatatgagctagtgtctctaagcaaggctaagcatccgattcactttagctaaaaccatataatgttttagctaatccaattgttaaccaagtgacaaagaataggtaatcaataacaaaatggctataacaaggcaataggttatttccacccaatgacattcaaaaataaatacaatagttgaatagaaataatagctttagacgggatcaacatgctcaaagggtcttttgggatctgtgtgacttgccttgctggccttggaactcttcaaaatcttctcctgcaaactcggactctccgggaacgtcggaatctaagcagaaaagaacaaaatcaccaaaacagcacataaacactcatgaacagtacatgtgggtatttttaacatgtagatatcaattttagaaaaatttaaagacttgaaccaactaaatccgagctaagatgaatttttaaagattaaattggtttaaaccatttatatatattttaattgaattatgacgcgataaagaattatttttgaaaaggaaaagagatttattgcgtcagcgggctcgggtttacggtggaccaggtgcacgggacggtctaaggaaacgaacggccgagatcgaatcggtctaccgcggtctatggctgacgtcggcgatgacgtcaccaccggtggcggctcggccacgcacgctcgccggcgaacgacggcgcgatggcgcaaacggaaggcatctacgtgaagcgggcgacgcgacgaaccttaccgaggcacggacggcggcggatggcaaccggacggcgacaccgacgagtttgaattggcggtgacgatcgggtcgacgacgatggcggtgctccggcgatctttggcggaaacggaggggtggacgaggacggcgacgacctggcgaacccgacggtggccttcccgagcgatgacgatgactggagcggcggcggcgcacggttggacttgcggcggcgatggcggcgcacgacttgacacggctagagcactacgagtggcggcgagctacggcgagggtggcggcggagagaggaagtctcgagggtccttataaagggctagaggacggcgattgaggcccacggcgaccggcgacggcgatggaaggtttagggttcgggaggaaaaaggaatctgaatcgagctcgaatcccacgatttccaaacgaatttagatgacgattccgaaagagaaaagatatagggtatcccggggatcatttcccctctattgattcgatcggatcggaaaaggagcggtcgaatttggaagggcggtagcggcggcttgcgcgcattagggcgcggctgcggcgggaggaatacgactgccctgacaggtgggccccacctgtcagcgggagagagagagaggagcgagcggtggctcggcttggcggactgggccgggcgcgattgggccggggagagaaagagagggggttttgggccgactttcggcccaaagccaaaagaggacttttaaaacctttttcaatttaaattattcatgaaatgcaattccatttattaaaaatacttccttgccttaaataaatctcagaaaaatctaggaactatagaatcaaatgaagtatttaataaaattttatctagcccacttttatattggaatttattatttaaaattagatcttttcttctagacttttaaaatcatttctaataattccaattaagcaacaatttatacatttggggatttttagggtgtgacaaaacctatgggagttcttactgctgaccagtagaaagcattcaatgaggccactactctctttgtgggatgcattcttagcgttcttggcgatcgtctggtcgagctgtatatgcatatgaccgacgttaaggagctatgggatgcactgaataccaaatttggtgctactgatgctagcaatgatatgtacgtcacggagcagtttcatgactacaagatggttgacaactcttttgtagttgagcaggcccatgaaatacagaccatggtgttgacgcgaaaaacacacactggcctgggagatctgcttagctccagcgtaggtccaaaggttgatgagatacgggcataccagtcagtttgaccctgcaactgacaagatatacaaatagcagatcaatgagccgatcggctgacaagccgatagattaattccagccgatgccgataccggccgatagcgatagggtttcgagctatcggctatgtgttgatgtggagtctcacacttgatgtaaataatgacatatagaaaatcggctgatgatgatgtaataaattaacaatataatcgagtagaaaccaatcggctaataatgatatgatagaacaagtattgatccgaaggttaaagcatacatcggctggaggtccgatgtcattaaattcagaagattagataaacagtaaaatctttgttgctatcggctaaatccaataggtatgcaatccttgtaagccgatgcaacgtccagataactcatcagctgaaaccccgatgaaacccttattggcaatcaagaagcaggctagagattatggttctaagcacgacttagtagatcaaacttagctgatgcagcactaagtatgaaaagaatcataatatctagataatcaagtcgttgactgagtttttagggtggtagatgtctaagctaatctaatctagcaacatgatttagccgataccggtagaaatcctaaaatgagaagcagccgatagagctaaattgataagctaagactagattaacagatacatatgataaataggtaggcaaatatatcatgcaaaccagagcaatccaagaggtcgaatgtactgatgcagccctgaacgacgctgacatagacgatacaattgcctaggctggtagaacgtaggacttactccttcgctggagatcgaaccgaatcgatgcagccccgcgtcacgtgccaaattccgccggttgataagtaacaacctcggtaaagagggtgttgatgcgccgagagtagttgtattgatcgagagatattttacaatgaccccgggtgtatatatttatacccatagggagatattagtccttgtaggacaagaaagaaactttcctaaagataaaaagaaaacataaagtccttataggacactgaacacactttcctaaagataaaaggaaactaacaaactattcctaattaatagataagttgccatgccacatcctcctttaactcggacactactagataagcttcctttaatagattaatttccttaacagaatatagcaggaatccgactattggcgatgtgataattctcttaggggcctaccaaaatttgtcgttaacacatggctaaggaactcgaactccttaagtgtgtcttacccgaaaaatttgtggccgggtgcattattgtgaaactacctctatcttggagaggtttcggtactgcactcaaacacaagagataggaatactccgttgagaggttgatagagtctcttgatgttgaggagaaagctcgggaaaaagatgccgcgtctaaaggcaatggtgggcagtctagtgccaatgttgtgcacaaggccgaaaacaagagcaaagggaaatacaaagcccagcagaccaccaacttcaagaagaagaagaacaataacaatcctaaccaggatgagaggacttgctttgtgtgtggcctacctggtcatttggccaagaagtgcccacaacacaaggggatgaaggcacttgcagggcagacttcttagtctgcaaatgtgaccattagcaacaatggagatgtaagcgggtatggtaatttacctactgttttttcagttaatcagtctactaactagtgggttgatactggggccattgtacatgtttgtgctggcatctcattgttttcttcttatcaggtcgcacaagattccaccgtcttaattgggaatgggtcacatacttctgttcatagtgttggcacggtagatctgaagtttacttcgggaaagatcgtgcagctgaagaacgtgcaacatgaccctactatcgacaggaatcttgttagtggctcccgtctaactagagacggatttaagttggtttttgagtctaataaagtagtcgtgtctaaacatggatattttattggtaaaggttatgagtgcggaggcctgttccacatttccctttctgatttctaccataagtttgtgtcacatcctgattttcgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcagatttttcggagctcaactcttaattttaatcatacaaagaacatttcagtaattacccacatattaaattaatcattaaatggtctgattataatcttgttaagtactttgagtgtccaagtattttcaggattttacttgaaattacttgagcattggaagtatttttaacaattcaaagatcatttcagtgattaatttaattggaaaagttattaaaattcctcttttccttttcgggccgaaacaggaaaagtcctctctctttcttggcccaatctcctctcagcctgcagccctctccctccctctgtcgaagtctgctttgtgtccctctatcaatcgggccaagaagtagaagcccagcaacaaagtttaatttgcctccctgggcactgttcatcttcaacctctggcagccgaactgagaccgagttggctcggtttttctcctccaaatccaaccttttctcttgtgttttcctaaaattagttgaggggaaatcatctccaccttatcctctccctttcccctaaagtgtcggagattaattttgcctggataaaccaaatcgaattcgtttttgagtttatctctccaaactaaccctcggattttccggctcaaatcctctcgtttggagtccgatctctctagtccaagcctatataatgcatcccctcgacatcctcttccgtttgccccaagtcccaagcagagccgtcgcccgtagagttgccgccgcgttgttttagccgccgtcgggtgcgcacggaggagaggaatcccgtccaccccttcgcagccgccgaacaccatcggagcgccgtcgccgtcggggacccgagccaagccgccgtcgaacctcatcgctggccgtcgttcgtcgtcgtccgtcgttgttctttgcaccggtgagttcgcgtcgtcgtcctctacgcgtaggtgttctcggatagcccaaccgagctctcttttgccggtggtcgcgtggaagccgtgccatggccggcgatgatgtcattaatccttttttcttagttttctctattagttgaaaatcgattaaacttcggaaattcataactaaatcgtcgtaactcggatttgagtggttcaagttgctaaatttttctaaaatcaagatctacatgttaaaaatatcaacatgtactgtttatgcttgttttggtactgtttatttggtttttattagtctttttctttgttttgcgtgttagcttgtcgtttccgtcgttgcgaaggttcgtgcgtgcgttagaagtggtcaagaagattaattgaagaccgattattgcaaggcaagtcacacagatcctaaacacaatcctttgagcatgttgatcctatatttaaattctgtatttatttcaactgtgcatttattttcgaatgtcaccgggtggtgtgaacctattcctttgttatggccaatttgcattgaatgccctattccttgataccttaggtaataaattgattagcttgaaccttatgtattggtttggtcagctaaatgttatatatataattgcttggccatgcttagaaacattagctcactaatgggatgaatcatatatactacattattatttatggttatatttaatggtagctcacgatggttaatcatgttatgataattaattggtaattaaatatgattaatggtgggttgtgagcacttggttttgaaggtcgtgctcatggcaattaaggaccggttcgcgagctactgttgtgagacattaaccgtgccaaccacaagccagcgtgggcaatggctttaccttttgtatagcatgattcattgcggggtgccagactgagaagcggcgagaagtccgtgggggtcgctggggagtccatgcctctggttatatttatagagggggcgattataatccaggaatggtgcactatggtgagttgtgttgtgcgaagggtattgtcacgatttccccctttgcagtgccgtggtggtacttcggggcatggcaacatgtgtggaatcgtgtcttgtgggtacagtggtacatctctggccagagtaaaactattcgaatagccgtgcccgcggtcatgggcgggttgagcaatgtttttcgtgattagtcccacactattcattaatgataataatgtgataataaatttgactcctggtttggaatggtaaattcctggtttggaggtttgatctgtacgactggggttggttgttcagaattggttgggcctgagcagcatgggtgtgctgttcagtgttgattaaaatttctgattaattactctactatttcactactcttaaatctttactaaatgctgcttttgcaaatgagactatattatgccatcctttagtatccttgtgcacttgcatatttgctgtgtggcttgttgagtatgtcatatgctcattctggcaataatcaatcaacctcagttgaagagaaaggatccggaaagagcagacgtttggcttataccccagttgagctgcctgtgggagtggagctgaagtcatcgctagaccgttattccgctgctgttttcttttcttttgtaagtatctaaggcgttattattatgatggatttgtatattaaattgtcagtttgtgtacctcggctgattcctggacgaggattttatgcacaaataagttcggaaattactagtgaatttccgagcgtgacagtttgtgaatcatatttgtggcagtgtggatgatgaggctaatgtttggcactcatgcttaatggagagctggatgaggagatctatatggacattaagacagcttttcttaatagagagctgaatgaggagatctatatggatcaacatcaaatggacattaagacagcttttcttaatggagagctggatgaggagatctatatggatcaacctgatgggtttgtagttaaaggttaagaaggcaaggtgtgcaaattgttgaagtctttgtatagtctaaaacaagctcctaagcaagagcatgagaaatttgatagaacattgacatctgcaagcttcgcagtcaatgaggcagataaatgtgtgtactgttaggggtgggcattaaaaccgataatcgaagaccgaacccgaaaaaaccgaacccaaacccaaaaagaccgaactctcgggcatcggtcatttgttcgggtgtgacatctgaaagaccgaacaaacttcgaaagatttggtcatcgtgcaatactactcgaagaaaccgaggaccgaagaaaccaaatcaataccaatcactaagcagacaacgtgaccatcccatggaccaaaacagcccaacaacaaggtgaggcccaaatccacgtcaatgacccaatccccatgaccccaccattccattgaccgaagcactcctagccatagttaggccacgcgccgccggcgcgccacttatctcatcacatcgcatgtccccttccttccgcgccgctgtcttctgcagtgctgccgcatgctgctgctcgccggcattgccgcagtgtcacatacaatcgtgtggtcacgtggaagccataaggaggccacaggctgttggcttgctgatcctgcagcacagccgcatgccggccgctgcgccatcgcgtgccgtctgcgtcacgtggctgatttctgccgcgtcgtcgccttccgtcccgccaacacttgtcaccatgctagtggatatccgtcccatgtgactgagatggagccatggaggttttcaggagcaagaagacaagaagattgaagaggacgcacgttctggttcggacacctcggtttagaccgaagactgaaccgaattttcggttaaccgaagtagcggttagtaatttttgcttaacaacttcggtttcctgtttccaaagaccgaatttttaaaagaccgaactaaccggatcgaaatttcggtctagaccaaatgcccacccctatgtacggtcgccatggtggcggtaagggagttattttgctcttgtttgttgatagcatactgatatttgggacaaaccttgaggtgatgaatgaggttaaattattcttgtctcaaaatttcgatatgaaggatctgggagtacctgatgttattctaaatattaagctaattagaggtgagaatgagattacactcttgcagtcccattatgtggacaagatcttgaatcgctttggctacattgatagcaagccttctccaaagccttatgatcctagcttgtcgcttcgcaagaataagagaattgctaggaatcaattggaatactcccaaatcattggctcgcttatgtacctggctagtgcaactaggcttgacatctcctttgctgtcagaaagttgagccggtttacctctaacccgggagatgatcactggcatgcgctagagcgagtaatgcactatctgaaaggtactatggaattggggctttactatactgggtatcatgcggtactggatagatatagtgattctaattggatctctgatgtgtatgagatcaaagccactagtggatatgtcttcacactaggtggtgatgttgtttcgtggaggtcttgcaaacagaccattttgacgagttcaaccatggaagcagagctaacggtactggatactgctactgttgaggcataatggctgcgtgatctattaatggatctgcctattgtagaaaaaccagtgctagctattcttatgaactgtgaaaatcaaacggtaattgccaaagtaaacagttctaaggataacatgaaatcgtctagacatgtgaaaagacgattgaagtctgttaggaaattgagaaactccggggttataacattggattatatccaaacagctagaaacctggcagatcccttcacgaaggggctatcacgtaatgtgatagacaatgcatcgaaggagatgggtttaagacccatgtgagttatactatggtagtaaaccagtctatgtgatcgaagatcctgtgaattagaacctaggaagaacaagccattagttaactggaggagagtaccaatctataccctctctaagtgaagatgcatgtactctcgtgagctgcaaggcaggttggctatgccttaatgagttatgttggctttaattagcgaagatgttgtcccgcagagcattcctgaaagaactcacctttgtgagcttgactgttggtcacagtctatggagatttggggtgaatcttctaggaagcttactaaaagaccaaggagtatgacttacatgctccacctgagggatagtctacagacgatctagtcctagataagactctgagtgaaacttgcttgcacaagtgtcacgcccggaatttctatccaaaattccaaatgcttacatgtgtgtgaaccctcgtccaggaatcagccgaggcacacaataacaaattaataatagagtacaattattactctaattaataaacgaataaaatgtcattacagaggtagatagttcctctcaatcaataaagatctaagcagcggaaaaataagataaacggcgcagacgactccactccacaagcagcttgaccagggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaatagttaagtagtaatttaaacaatattaatccaacgctatacaacataccctgttgcataggcccaaccattctgtacaaccaatcctggctgcacagttctatctccaaaccaggaatataccattccaaaccaggagctaatcaaattattaccagttatagcatcttttattatggtgagaagtgtgagactaatcacgaaagacattgttagacccgtccataaccgtgggcacggctattcgaatagttttactctggccagaggtgtaccactgtacccacaagacacagctccacaacatgtcaccatgtgcctcaataccaccacggtacctcggaaaggagctgtgacagtaccccacgcacaacacaatccaccacagcgcacctttcttggatcataatcacccccttataaacaaggcatggactccccagcgacccccgtgggcttatctctgccacttctcagtctggtgctccgcaatgaaccatgctatacaaaaggtaaagtcgttgcccacgctggcttgtggttggcacggttaatgtttcacaaccgaaactcgtgaaccggtccttaattgtcatgagcacgactctcaaaaccatgtgctcacaacccaccattatcaagttttagttggcaattcaattaattaaccaatcataattaaccatcatgagctatcattaaatatccatcattaagtaatagtgaaacattagttatcccaattgtgtgctaatgtttctaagcatggctaagcaatcatatctaatatctagctgaaccaatatataaagctcaactagtcaagttataataacccaaggtatcaaggaataaagtaatcaagaacaaaaggactataacaaacaataggttaattccacccaatgacattcgaaaataaatgcaatagttgaatagaaacaatagctttaaacgggatcaacatgttcaaagggttgtttgggatctgtgtgacttgccttgctgcccttggaactcttcaaattcttctcctgcgaaaacgaactctccggaaacgtcggaatctaaacagaaaagagcaaaaacaccaaaacagcacataaacaagcatgaacaatacatgtggatatttttaacatgtagatctcaattttagaaaaaattagagacttgaaccaactaaatccgagctaagatgaattagttatgaatttttagagattaaatcggattaaaacacttatatgggttttaattgaattatgacgcaataatgaattatttttgaaaaggaaaaaggggtttattgcatcagcggctagggtttgcggtggaccgggtgcacggcggcggctcacggaaacgaacggccgagatcgatcctaaccaaaacgaacggccgagatcgaccggtccacggccggaccacgacggatggcaacgatgacgtcagcggtgacgtcaccaccggcggcggctcgggcgcacaagctcgccggcgaaagatggcgcgacgacgcgaacggagggcaccagcacgtagagaacgacgcggcgaactcatcggtgaccaaaacggcggcggaagatcaacggacggcgacggcgtcgaggaagaagcggcggcaaccttcggcttgacgacgacggcggtgctccggcggtctacagcaacgatggaggggcggacgaggacggcaacgcgacggcgaccacgacggcggccttcccgagcgacggcgacgactggagcgacggcggcgcacggctggagcggcggcgacgacggcggcgcgaggctacacggtgctagggttctaccggcgacgagagacgaaggcgagggtggcggcaggtaacggcgggcttgggggtccttttataggggcaaggaggcggcggcaaaggcccacagcaaccggcgacggcgaaggaaggtgtagggttcggggagatagacgaatccgattcgagatcgaatccacggatttccaaacgattttagccgacgattccaaaagagaaaaggtagaggagatcccgaagatcatttcccctctattgatttcaccggaaaaggaaagaggcggccgaatttggaaagagacgacggcggcgcggcgctagggttcgggcggcggccggccggaggtagacgacaggcctgacaggtgggccccacttgtcagcggcagcgagcgcgcgcgggcggctcggcttgactgggccggcttgggccgaggaggagagagagagggttttgggccgactttcggcccaaagccaaaagaagacttttaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacagtagatctcccagcccacgtgttttctgtcaacacgcttttggcacgcccagtgggacctgtaagaagtcagacgtcagttcttcctcatggccgagaaacaaccaccaccaccatctagcccaggttctgttaaaggcaaggcattgaagttgggattgactgacatcattgaagaaaacgttatgccgatcgatccagagaaattcacgcctgagcagaaggaagagtttgaagcaacgttgcagcaagcacgggatcagtttctgaactcattcatgcagacccgcaaagggacacttgttcagaagtataaaataaaagtggttgctgatagtcctaggaccggttcttctaaagatggagaagtgaaacaagctccaggcggctcggctcagccgagtaccaaaggtgctaccaacggctctctaggcgatcaaggtgacaattctcaaggagttcatggcgttcaaggtgatggtgctcaggggccacaaggaggaaatcttaatcagaatagcgaagtagcgcaggactttttcaataacttccaagatcgggttgattacgccgtgcatcatgctttgatcaatcagtccagggtattagtcaataccttgtcaaacatgatgaagacaatagccgatagttcaatagctaagcatcaggccgcatgcccagtttatttgcaaggaggtgtcttcccaaattatcgatctttgatcaccgatgttcagccatctattcaagcagttccctccgttgcacccacaactcagccgacggcgccagtgtcaactcctctgcctgctacactagctatgacgccaggacagccggtgaaccctcagttgttaatgaggcaacagccacagcatggcgggcaagctgcgaatcggctgacccaagatcaagttgctgccatgtttctgccacctccacctattgttgatccagtgcagcagcagccgattcagcagacaccaccaatccagccggttgtgcaaccaatccaacaacaggtcgtacaaccagctcagcaaacaccaccaagccagcagcctctgcaaccaattcagcaaacaccaccaaggcagcagcctctgcagccgatccaacagactccattaaggcaacaaatcgttcagccgatttagcaccaggggtcaatgaacgcatcggctgggttcgcagcacctggtagttagcccatacaacaatttgtgaaccaagtcgtcccagaacatttggttcaccatgtacagccagacggcacagtaatgcctcaggttgttcctgagcacttggtgcgcaacatccaaccgaaccttcataattactaagggggtaacttgagttatcaatatcagcctccttccccgcaagcccaatatcagctagggggattggctcaaccccagttcgcatctcagcctccttccccgcaagcccaatatcagccagggggattggctcaaccccagttcgcatctcagtatggtcagtttgagcccatgcaacaacagccacaaggggcagctcagcaacgaccgtgggccgatgtgattgttgatgtaatgagagaacagtttgggcttaaaccaaaagagactggaagcttgtatcggcagccttaccctgagtagtttgagagagttcctcttcccaaccggtttaaagttccagatttctccaagttttcaggacaagagggcgtgtcgacttatgagcacattagtcgattccttgctcagtgtggtgaagcatcggctgtagacgctctgaaagttaggttattccggttatctctgtctggatcagcttttacttggttttcctctttgccatatgggtcgatcaatagttgggccgatttggagaagcaattccatagctatttctacagtggggttcatgagatgaagttgtcccacttgacagtgattaagcagcggcatgatgaacccgtgcacgagtatattcagaggttcagggagatgaggaacaaatgctttagtttgagtttaaatgatgctcagttagccgatttagccttccagggtatgattgctccaatcagggagaaattctcgtctgaagactttgatagcttatcatacagaaggtaaccttgcatgagcataggtcggcggaagtcaggaaaagctctaagaaggttaatcatgtttgtccgtatatgtatgggtcggatgatggggaagacgattctgaaatagctgcagccaaatgggtgaggagtaaaaaggtcataccatgccaatgggtaaaaattcctaaaaaagagaagtatgactttgatattaccaaagctgacaagatctttgatctactactccgagagaagcaaattcagcttcctgctggtcatacaatcccatcggctgaggaattgggcaaaaagaggtattgcaaatggcataattctggatctcattctactaatgattgcaaggtttttagacagcaaatccaggttgccactgaagggggaaagattaggttcgatgattccaaaaagccaatgaaagtcgatggtaatccttttcctgttaatatggtgcatacagctggccaaacagccgataggatccgtgcaaagggttttcaagtaaattcggctaagattatcaacaagtatcagaggaagtatgacaagtagcaggagaagcattatgaagaatacgacgatggttttgatcctcattggggttgtgagttctttagattcttctggaatgaagggatgaggttgccatctatcgaaaactgccctgggtgcagtgatatcatcgagagctcgagccggtcatataataagggtaatcggctaaggcaggcaagacttcctattcatcaaagattgggtccgatgaatcaagatcatggccaagaggatgaggtaatcaggaagaatcaatggtgtccttctggtattttcacaaaaaatcagaagagaagggttcaaagattgaggaacagggagcgccttcaggaggttgaacaagaaatcaaccatcggctgaggaaaccaaagccaagacaggagtggcgtgttaagaatcaggttcctgtagccgatgatgctgcagccgatgaggcgaagaggttggcaaaaggaaagagtgttgtagcggcaccaattaacatggtctttacattgccagctgaattcgggatagatcaagccgatgtcgatgaagtggaagaggaatcggctaagttggttctgtcaccagaataggcagtattcgagaaacccgagggaacatagaatcggcatcttaaaccattgtacataaacggctacgtcaatgggaaggcgatgtctaagatgatggtcgatggtggggccgcggtaaatttgatgccttatgctacgttcaggaagttggataggaacgccgaggatctcatcaagacaaatatggtgctcaaatactttggtggtaatccatcggaaaccaaaggtgttctaaatgtggagctgacagtcggcagtaagactattcctaccacgttttttgtcatcgatgggaagggttcgtgcagcttgttgcttggaagggattggattcacgccaattgttgcattccttcaactatgcatcaatgcttgattcaatggcaaggcgacaagatagagatcgtgccagtcgacaggtcagttaatgttgccagtgccgatttagccctttgggagatggatggccttgattgtttatctggaaaagtctgggatggagattttctaaaagtgtccgattctgatatacagccaattgaagatggagaacccaagctattactttgagggcgtcgtggagggttctaatgtctacaccaaggatacagtggatgatctcgatgacaagcaaggtcaaggtttcatgtcggccgatgagttggaagaaataaacataggtccaagcgatcggccaaggccgacatttattagcaagaatttgtctccagagtttagaaccaagctgatagagctcttaaaagagtttagagattgcttcgcttgggagtattatgagatgcctagactcagccgatcgattgtcgaacatcggctacctatcaagccaggggttagaccacgccagcaacctctgaggaggtgtaaagctgatatgcttgaacctgtcaaagctgagatcaaacgattgtatgatgctggttttatccgtccctgccgatatgctgaatgggtttctagtatagtttcagttattaaaaagaatggcaaggtcagggtgtgcattgattttcgagatttgaataaagccacaccaaaggactaatatccaatgccagtagctgatcagctagttgatgctgcatcaaggaacaaaattttgagttttatggatgggaacgcaggatataatcagatctttatggctgaagaagatatccataagacagcttttagatgccccggtgcaatcggcttatttgagtgggtcgtcatgactttcggtttgaagagtgctggagcaacatatcaaagagccatgaattatatatatcatgatctaatcagctggttggttgaagtttatattgacgatgtggttgttaagtctaaagaagtagaggaccacatagccgatttaaggaaggttttcgagagaaccaaaaaatatggcttgaagatgaatccgacaaaatgtgtttttggtgtgtcggccggccaatttttgggatttcttgttcatgaaagggggaccgaggtaactcaaaggagcgttaatgcgatcaagaagattcagcccctggaaaataagacagaactacaagagatgatcggcaagatttctaacttgtctggaaggttagagccttttacacccttgttaaggttgaaagccgatcagcagtttacttggggggcagagcaacaaaaggctttagataatattaaggagtatctcaactctcctcttgttttgatccctccacagaagggggtaccgtttaggttatatttatcggctggtgagaagtcaatcggctcagttttgattcaagagttggaagggaaggaacgagttgtattttatctcagtcgacggctcttggatgctgagactcggtattcccctgtggaaaagttatgcttgtgtctgtatttttcgtgtacaaggttgaggcattatctattatctaacgagtgcactgttatatgcaaagccgacgtagtcaggtatatgctatcggctccaatattaaagggaagagttggaaagtggatattctccttgactgagtttgatcttcggtatgagtcgccgaaagcgattaagggacaagctatagccgattttattgtagagcatcgtgatgattcaatcggctcggttgaaatagtgccatggactttattctttgatggatcggtatgtactcatagttgtggcatcggcttagttataatttcccctaggggggcatgtttcgagtttgcttatactattaaaccatatgcgaccaataatcaagctgagtatgaggcagtgctcaggggtttgcaattactcaaggaagttgaagccgataccattgaaatcatgggggattctttgctagtaatcagccaattggcaggagaatatgaatgcaagaacgatacattgatggtttataatgagaagtgccaggaactaatgaaagagtttcggctggttactttaaagcatgtatctcgagaacaaaatattgaagctaatgatttagcccaaggggcatcggggtataagccgatgatcaaagatgttaaagttgaaattgcagcgatgacagccgatgattggaggtaagatgtgcatcaatatttgagtaatccatctcaatcggcttctaggaaattaagatataaggcattaaagtatacactgttggatggtgaactttattatcagacgattgatggagtattacttaagtgcttaagtgccgatcaggctaaggttgcaatcggcaaagttcatgaaggaatctgtggtactcatcaatcagcttataagatgaagtggttgcttcggcgcgcagggtatttttggccaacaatgctggaagtttgtttcagatattataaggggtgtcaggattgtcagaagtttggagcaattcagcgagcgccagcgtcggctatgaatcctattattaagccatggccgttcagaggttggggaattgatatgatcggtatgataaacccaccatcgagtaaaggacataaatttatattggtggcaactgattatttcaccaagtgggtagaggcggttcctttgaagaaagttgattctggggatgccattcaatttgttcaggagtatataatctaccaatttggtcttcctcaaactattactacggatcagggttcaatcttcgtgtccgatgagtttgtttagcttgccgatagcgtcggtatcaaattgttgaattcttcaccttattatgcacaagctaatgggcaagccgaggcatctaataaaagtttgatcaaattgattaagcggaaaatttctgattatcctcggcaatggcatactcggttggccgaagcgttgtggtcttataggatggcttgtcatggatcaattcaagttcctccttacaaacttgtttatgggcatgaggctgttttgccatgggaggttagaatcggctctcgccgaactgagttacaaaacgatttaacagccgatgagtattacaaccttatggccgatgagagggaggatctggttcagtcacgattgcgagcccttgcgaaggttaccaaggataaggaacgtgttgctcggcattataataagaaagtggtacccaaagatttttcggaaggagaacttgtatggaagctgattttgcggattggtacttgtgatagtaaattcggcaagtggtcgccgaactgggaaggaccgttccaaattcataaggttgtgtctaagggagcatatatgttgcaagggcttgatggtgaagtctatgggcgagcactcaatggcaagtatttgaagaaatcttacccaagtgtttgggttaatgcatgataggctcgtattgccgatgcatgatagccgatgtgcttacatcgccttgagatggctgatattgttatatcgcccttagttgtttttcatggtgtaatcggttgtggtttgccgatgtacaatggccgatattcttatatcgcccttagttgtttttcatggtgtaatcggttgtggtttgccaatgtacaatggccgatattgttatatcgcccatagttgttttataattttatcaatgcttttgacattgtaaaattaggggggcacatatatgtcaaaatgcaatggaaaatttttgaacaagttttcaaagtcatattaatcggcacaaaggattgttaagacagtacagtattagaatgtcttagccgattacaaaaaattctaagtcctattacacaaaggttattgagacaagtatcgctggatagccaatatagccttctgcctaatctattctacttcttctatggcttgggcatcttgagcgtcggttccagggataactttcagagacttggtcagatcagcaacatgcttgatagccgatttgagtcttgctttctgttcttcaatagtatttgggagatcggctagttttttgtgctccatatccagctcagcgttgcattcttcaagttgtgctaagagttcaatcttgcgagcctcgagccgatcaatgttggacttgattgggccttcagatagttgatcaagcttggacttctcttcatgcacaagttgtcggttagcttggatagtagcttcaatgtccttgcgctctcgccgttcggccagtcttaacttggctttctccagtttgaattagtgttgctcaaggtaaacggctggggtaaggatatcggctaactcatctgggattagagcctgaatctcatgtagccgagccctgattgagccacaatcaaccaccaagctatctagtgatgatgcctctagccgatcagagatactttccagagttttcttcacatcatcagataaagaggctaaggctttgcttgtggtatcttcttctccttcatcaagataatctctgatgttaaaagagaaaagatcggctaatacctgcagcaacgatttagaagcagttagaggttaaataggcatagccgatctgaatgtttgttgagacaaagagaaacttactgggacagcaggagcagttggttgttcttcttcctcaacgtgatgactccccacagccgaaggagtctggtcacttgacgattgctgtacagaaggagaaggaggaggaggaggctaaaaggaaacaagtgttagacagagtcggctgagaattaactaatgaaagttaaaattatcttactggtggagctagtttagatgttgttgcagccgatttcttcttcactgcagtcttctttttctgcaattataaaacttggaagtgatcggctataagacaaaataattatgaaagggattaaagagagatacttacccttgtaaagtgaacgggggcagaaggagttgggggcgtttgcttgggtgaagccgatggtgttctttctgtgtcactcatttcggctacagcctggtcaacatcttcgccaatttcctcttcatctaaggcttgttcaataaatggatccaaggcgggcagatcatcagccggcttatcagtcggtttggttttcttgaacttggcctttttctttggagccaagaccaaggtattcacggctgatggtctggttttccttttttggcctgcatcggctagttccctagttaggccgtgaaggagagttgaagtcttgggggcatgatagccgataacagggggagatagcccacctccattcagaattaaacccgaagcatactcaatattcttgccactattactttgatgaggaggggaggactctgttgtctgcaaagcaggagcaaaagattggtcaagtaatgaatcggctaattgactatgcaatttagtaatgacaaagtttacctggggtatgacgtcggggaacagatctgtcatatacatcgtagccgattgatgaaacagatgcagcttccattcaccccaccatctgtcaaagtttttgcttctaaatcctgccaactcaatattttcaatgctgcccagaggaggcccaggtaggttaagtagccgatccatcattagagtggatgtgatttgtcctcggcactgaatcttgtcggcaaaaaataagccgattgggagttggcccaatccaagttgtctggccgagctcattgggtgataaaactcgtaggagtcttggatgtttctcccttgatgaatgccgacaggaaggatgcatgggttgattgcggctataaaaacttctctggatttttggaatttcttgtgattaatatcttcgaatctaaaatctgatggaagttcgaggtctgcggagtcttcataagggaaccagattcgtgcatctttcttaaaaccttcgtagaagctacagaaccagtccttaagcagctcggccgataactttgctcctgcatcggttggtgtggatgcatattctccatacgacatgcacctgcgatgggtgcgctcttctccgtcatcttccacgatcggccctggcagtgtgaattcagcttctgttatagagggccgattgacaaccttcataactatcaggtttaaccaagtttgcagcagccaccagggtccacctgctccaaccactgagccgacggctattctagccgatgcattgttcaacatctgatacagatagccgagaaggattttgcccaaagggaattctttctttgattctaaggcttcagctacgaactgccaattggttgtagggccacaactggatccacagaagaggaacttttccagccacatgagcaaaaaggctacgtgctctcgaggggtaacagatccttggcccatgtatgccgccacatagccgaaccaaccacctatgctcttggtcttcaagtcaaattggttcttgatatttatgctcatggggttagccgatgaagtcacatctaatccggtaatcatggtgatgtcgattaaagttggagtcatcggcccctggttgaataagaaagcgttgatggtgttcgaccagaagtaggtggcggcagccattagaggttcatccttagcagaattggctatggtgagagcaagtgcttggccgattccaatctcgtcccaatgaactttcttactagccgcgttgataccaagtagaccagctcttatcaggtgtgagtttttcgagagatggccaagacttaaaggtattcttccagtgacccaagttagggttggctagcctaaaagggatccggttggtttcaccaatgatgaaatcagtggggtcgagattgccgattgggccaaggaaatagtggttctggtgcaaaagactgggaattgcgacttggtgggagagatgctacaaatccaaggcaatcgatataaggaaaacgatataagataggagaaaatcgatctgctgataagaaaggggatctagccgatagagacttacctcagtgtactcggttgatggcgcatcagatgggttggtggaagacgacatcgttgcaggcggaggtcttgccggagacgaagtcgcccgggagtcgcttttgcatcggaggaatcgccggagagagaggggattaagattcgcttgagcggtgaaaacggaagtcacggtgtgagatttctcgagggtgacggttagtatttaaagcacggcaataacggtcggaaaacggcaaagtgcgaaacttcgtcggagtcgatttacagcaaatccgaaacatttccaaatattccggacttgggggcgtgtgttaacaaccaaatttggtaacatcggcattgggaaagaagattagatcgaagcaaagtcggaggcggagatcgagttcgaaaacagagcaggaatcggctggagtccagatcggctacgatgagatcggctgagtctgagacgggctaggtgagccgatgtagccgatcccgacaatacgacttgtatacgacatcgggtttaagttaatgtgcttcaagatgattgccatgcacggatagagtcctgggaaggcaattgtatctattaattaagatattttatgtaaattccttatagataaatgtgggcaaaagtctaccgcaaagacttatggtattttagggtttgttagatataatagtcgtgtccggtatgggtatatcttgtaattctcgggtataaatagaccccgagccctatgtaattgataacacacacgttcaatacaattttggcgcatcgccacccttttgctttagttttgtttcgacgagttcttactttcgggttgagctgcatcggattcgatcttcaacaagaggtaaaacttgttatgatgacttatattctcgggattagtgcttccatctttatgacactctaatcttgtttatgtaattcgtcgagttatcatatatcttacataatctctggcaatatcgctatctaatctactatcggctaacatctgttagcagagggcaaccgattaggttagattttgacgttgatctagattatataagatatctaccactctatgaaacttctagcggcttgattgtctagatatcgttcttcttttcatacttaatgctatatcagttgagtttgatctattaagtcgtgcttagaatatcgatctttagcctgccttctagttgctgattagagtagcgtcggagtttcagccgatcttatctgatttaactatatttgttctatatgcttcattgacatgttaaatctgtcctttatatcgagatattgttgtatctaagtatattaggcctttgtttgatatattatacctgctttaatttcctgatatagagtagtatcggagtattagccgatacatgctagatctatctgatcggctatgctataaacatatatagtcctgttattgatatatatatttcgatctaagtgatttatactgtctcggcatggtgaccgatctatcccgatcacttgatttaagtatacatcgatataaggggtatatatcgttgatatctacagctgatcgagtagatttagttctttcttacttattcatgactgccgaccgatacacagatgacatcagctcaaagataaatgatatgtcatcggcatctagccgatcggctatcatttatagttttaatcacggtttctttgcttctatttcttgttgattacaggatcaaatcaattggcacgctcatacattcgaaggcgagctttggacctgcactggagttaagaagatctcccaggccacgtgttttttgtcaacagatttatgctattcgtagcttacgcgtatcccatcatcagcctgtcacgggcgctggggtcgtcgcgctcgcggtggctgcacaccagagccgctgctatgattacccacgctagagtcgccacgcctctaggttcgggatttgacgctgctattaacgtgcgggaagaactcaagatggggaatatgaaccctagagcgagaggaactctcccttcccctcctattagtttgcaaccgcctggtcagcatgacaacatggcaaatacggtccagtcagtctgccacgtgtgcaaaacctcctcgtgaaacagcctagggggttaaatggactggattataaggtttggggggctagataccccattttatagttctgggtactatatagactcttgggcatagtctagggggatttggacttttttctatccagtaaaagtactacttagaatataaaaatgaggaggaagagtctcttttagtagaatttttactaagctattatgcaaattgaagcgcgggaggaaaggagctggctgtggctggggagggggcaagtgcgggtgctcgtgcgctcgcgtggtggtttggcccccttagtctctcatctctcctctctacacacacacgcacacacgcgcgcgcgcgcacacacacacacacacatatatatatatatatatatacactttatataaatacgtataaattttgtatatacgtacacaaattatatatacatatataaagtacgtacatatattgtaatatgtatatgtatatgttttttatatagatatgtttaatgtataaaaagatatatacacatgtataatgatttataggtgcgtataaaaactttgtatacgtacataatttaaaaacaaaataactgagagaaaagaaccaaaagaaaaacatatcacaaactttatatacatacacataaaagtttgtataggtatgtattaaaaaagggtgaattggaaccatctagagaaaaaaaaaagagtgagaaagctgaaaaaaaaatataaaaaaaagaccacgtgcctctttcccacgctccgcccccttctccgcgcaagccacgtgactgcgccattagatagcctttttgccaacctagtatttcctcagctgctcagctcgtcagttgtcctataccacgtaatattgaaggagggatgacctcgaagctaatgccatctggatcggtctcagcttctcgtgccgtcgtgtatgcttaattatgtggagtatcttttatgattatgcacgtgacaaaactatatgcaaaaacaaaagactatatctaacgaggagaataattttgacgagctaatagacagagagaacagtgaaaggttattaaaacttggccgacaggaagcacgtggcgccggtggtacgtccgacgaaaggacggtacccccggctcgcagttataaaactagcagtacaaggtctgctcatattgatacagcagctacacagctagcaccactaataacgagcaagctagtcgtcagtggcgaatctataacgaaaatataggggtgctcctttctaatgcgttttaggaagtatggatgaaagcttgcatgtcatctaaatagttctaattaatttgaaaaaaaataacaatatgtattgatatgaaatatattactccataagtatataacttctacgagttacaacaaaaataacaaattaaattgaaaatagttatcgtacattcacaattatatttattttttttgcaacatgtagaagttgaattttaactttcatgtttgtggagtgatatatttcacattaatcatttttttaattttttgatgattatttagatgacatgcacaaaacgatgtgatatcccctcgagggataaaaacgctttcccatgatggaagacaatacgacaagggcacaaccacaaattcaataacacaattgttgataattgttggattactttgtgagtaaaaaccactcacttccctaatcccctgatcgttccatccattgaagtaggaaaaaaaaaagaaacaaaaactaatacagtagcttaataaggaaggtctagcagccaattagtccacttaatcacccatggatcgcgatatgttgtctttgtttgctccttccttgcgacctggttgatctgcacttatgctatacgctgcttctctcccgaaaccatgcggctgctgctggttctgccgagatggagctggggctcaagccccaacgagccccaacgagccccaacggtgaatccgcccctgctagtcgtagctagctagcgagtgaatcagtggagtgacgagagatctcgcgatggcgaaggcggtggtgctgccgctggttagcaagcttcaggaggtggccctgagcgaggggagggcgctggttggcgtcggcggcgagatcaaccgcctccgcgacaagctcatgtggctgatggccttcctccaggaggcggacccccagaggcgggcggccgacgccggcggcgagctcatgcgcgtgctcgtgcaccagacccgcgacgccgcgttcagcgccgaggacgccctcgacgactacgccgtccgcgtcgacctgtcccgctaccccggctggtcgcgcgccgccgtcggcttcctcgccggcatcaccacccagctgcgcgtccgccacaggctctccagcgacatcgcggccatccatgcccgctttgaggagatcgtcggcaacaaggacaagtacaggctggagggctctgcgccctcgtcgttgctgacgtggactgcctccgccgcctcctcgagtgaatcaatcctctggttagtcaaacacagtccttacacgatcgaaacgctctattcacttcatacgtcctccttccatactcgtaaagaaaatcgacaatatttaacaatataaattataaataactcagtcaaatcttgagaatataaattataaataactcttaagttattgtgtttaaaaatataaaaattatataaatagatttgtcttgaaaaaaactttcataaaaagtatacatatatcatttttcaataaatatttttatagaaacaagaagtcaaaattatattttgaagaccgtgttaatatcctaaacgacttcctttacgagtacgaatagagtactcgtacggggatacaagcgagctaagcggcgaacccgcttataaacaaaactagtgcataacccacgaattgactcataggttaccttctaagggtttgttcggcacctccttttcccaacccctctatctcgttttccgcgcacacgcttttttaaactgctaaaaggtgtattttttgcaaaaaatttatatacaaaagttgctaaacggaggaagtactcggttaattataattacatgctaatgcttcatgtctttgtatacgccattcaaaattccagtgaaagattcatatctcggggctgtgtttttttgggaggttgggaaccctcccatctgcacggaaatcggagcgatagattaacacgtgattaattaagtattagctattaaaaacttgaaaaatggattaatatgatttttaaagcaactttccattataaacttttgcaaaatgcgtaccttttagcagtttaaaaagcgtgcacgcgataaataaggaagatgagttagagttcatgggaaagaacacagctaggcttttccttggtttcaacgattaggcttagattttcgacacgggcgtgaaacgtgaaaaaccgttagcatatactctatgctaattattgaaaaaccactagagtaactaatctagtagcattaatttttttaaacttgaaaaaagttatttatttgatttttaaagatactccatagaaaaattttacaagaaacatatcgtttaatagttagaagcgtgcttacgaagaatatgaaaagtttataagaactcacacaagagtggttttctggatggcatggtaatatatatgtagtgaaacgttttctttatttttgtaaatccaaataaaggaaattatctttagacagttttttccccaaatacagtatagaatctcatgtgtacacacagagcttatgatcacatacacgcaacctaccaagtatttctgagaaattgagctgtcatatacacttaaaatataataacccataaatactaacatatcagtattgagtcggttacaacaatgcatggtagatcatttgtgatcatatggacaaatttggtatgatttaaatagaaatatgtaaatatcatcagttcattttttttatattacatgaagtcatttctcacatgagaaaaacttatttcactatatacagatgttaacacagatactctatacagcaattgtgtgtatgttcataatgcatgtatatagaagtcagtactttaaaaaaattgagaagaagtcgcttactacttaattaagattccaaattaaagtggttttagcattgtcacgcattagtaaagctacagtaaaattgtgcaaagttaattaggctcccatcggatggcctaatcagctaaagaaaaagccaaattttaaatttcatacttaattttgagattgattttcagatgttttcaacgtagtttctttttcaaccttggcttttaaatcacccagaacacatatataaaagttttacctacaaattcatttgtattccctaataagccgttttggcttattagagaaaaagccaaacgatggggaccttagtttagtactcccatccgttcccaagtagttattattataaattgtttagcatatattaatgtgttgggcaagaaataaccatagtaccttaatatttgattcatgtgttgttgggagtgagagggtggttaaaggtaggaaggaaaaactatatattgaggataactgaggtaacaaaaattactctgaagtaagttactctaaagtgataagtctttttagataaattacgaatccttaaacgacgaccagctatataggacggaaagagtatgataaaaaacagacttgttccgttttaaacgaacgtcgataagacctctttaattaatttgtttttatatcgattcttttgaactttttcttctgcaaagcttccggaattattattcaatctcttgcggggaattattattcgatctcttgcggggtacgggttgtttgcgatttggctgcatcactccgttgactgaccacaaaagtctcgtcaaatcacgtgtctggccagtaaggggatagcacatacttgcattcaaataaccttgttattaagacaaaacgaaataggaaaacttgccacttggactaaatgatatgcaccacttgtacttaaaagaacgacttacgtacctttagtctcaaattaaactttggtttcttttatgtcatctattcttcaacaagcaacttataagaatattctaaacacaacatcatctaactatcgcaacagtacgcatgatttacacccctaaacttctatactgaatattttacaccctccaaattttcaaattgaacgaattaccctctaaccaagccaagagcagtttgatgccaagtgatatacgcgtggtaaccgagccaggggattttttttttcaagaaaagtttaactagcccacgtgtatattcttcctcccaatccacttcctttctttctcccctttctctatttcttgtctcagttgcttcgagcacatgcctagctgttaaaaaaccggtcccaaaatcaccattggaaaccgaacatggaagaaacgccataggagatccaagcacgatgagaacaacgagacacgatatttgttaacgaggttcagccgaagcctacatccccggggcgctgattacaagcgctatttcccgatccagcatattaaaacgtatcagagttacaacgaccctcggccggacgccgcaggcggccgctccctctcgctatattaagtcatcatatggttacaacaggtctgactctctatttaagagagatcctaagatagagtccgactcttactctagacctaatgcctattacaactccaattcctaaattgtaacctactttgtacacatattcgacacaaaacactaacaaattccacatcggtgaatatgccacgtcaacctgaatttgtcccatgtatgaacctctgcttacccagacttgagttggttcctttttgccgttcatgttgagccgcccccgacgaaccttcacccggctcaccgttaacgagagaccttgctatccccgtaaattatctctcttgactccacccgcaacagggctccaccttctctcatatcactatagtcgtcttgccaagtgaaattaaatttcttcttagtggcacacagcagactccgcaaagaccttgttcaccttcactttccattttaagtttgagttgatctaatccatgatgtgataatacacgtatcaccaaaatagataaatcaaatacactagaaatgaagagaaccctttatgtatcctaaatatatcatgtactgtcaaacagtccgttgacactccaaatgatattcatctgctgctgcgtgggtcctactcgcatgctgcttgacaggtcgagtctccctgcactgcttttctgcccgaaccaatactttgacttaatatgacaccgttgcatagccaatgcaagaaattccttacacatggtctgaattgtagcatgcggga

SEQ ID NO: 73360 - DNA, 611 bp, Oryza sativa
cctgctcagttgcaaccacagaagattcaacttttgccttggggcaatttctcagggtaccctgcagataccaattaggcaattaccagacacagggactagtgccagcaaaggcaaattgcaaacatcagaataagaagtcacatagtgatgtttgagatatgttccttgcacagagaatcagtcaacaataacatgaaacaagcggcttaattaacaacaatggtaggctctctttacttttatttttttcgtataccccctaatttccaaaatgaccatacccgcaattctgacatatagctattgaagtcaacggcgtacctagaaagccaacgaaaaataaaagaaaaggtacaatatgacagatataaccatgtgtccatgtcttcataatatggttcaaaaaccatgactctttttaccctagttggtactgcatatacaccattgctgcaagtgcattatcaaccgcataagatagcaaaacagggccactgccttaacatgccctgtactgtaacgccataacaagaggcatgcatgccatgaataatgtttttgccagttgaaccaagcaatgtaattatgcaatccacctccacgagaat

SEQ ID NO: 73361 - DNA, 2882 bp, Oryza sativa
tatagggagattgtttgtttcgttttccgtacgcacgcttcccaaactactaaacggtgtttttttgcaaaaagtttttccagaaaagttgctttagaaaatcatattaatccatttttaaagtttaaaatagctaatatttaattaatcatgtgctaaatggctcacctcgttttacgtatcttctcaatcttctctatctcctcctccaacacagccttagtacttccttcggttttataattcttgacgttttagacaataacacagtcttcaaaatatatctttgatcttgtttttctattataatatatagaataaataaatacatgtttatttttattatagaactttgaacgacaaatacatatatgttggtctagttcttttaaactaaatacttttaaaattttgataattaaagttataaaagtttgactacaatcttatccaaaacataaccagagagagtaattgattaactctcaatgattatgagtttaaatatgtgcatcttctgtcccataaaagccaatttctgagggtaaacttggattggatgaatgtttgttcagattcgtgtattgtagttattttttgtgagacagaggaagtatttacctccttctactgagacagtttccagggtgcagatgagagccaggaccaacaggagcaccttgcagagggacacaacagcagcagaagaagaagatgaacaaggagagcggctttgcttcctcatcatcactgactgaaattttagctcttggtttgtttgttgtgtacgagctagctgttgggttttcagaatttatagagacagctaacttagcaaggcagggtacgtagtgcagttcgctatcgtttaccaggggtcaatgcgctccttttaggacaaattaggcactggccaatatagtggtcatttttttccacgatatgcaatgcctcatcttcgtggaatgttgagtaatcagccatacaggcggattagggatccaggatttggaaaattgggcattgcactaagatctcgctggctatgctgtaaatggcagcagagaacatcgccggataaacgatggcaggggcttaatatcccaatctcccagaaagaaaagaatctggtcgcagtttccactttgatttcggtgggagatgggaatacgacgttgttctgggaggactactagatagatggaacatcgatacgctctttggcgccagcggtttatgctattgtccctgcgcgtttgtggagtcgttgaactgtggccgaggcgctccacgacaggcgttggatacgggacatttctaccgcactgggtgtccaagcaattttggagtacatcaacctttggatgacactcagatcggtgcagctctcagatgagcctgactcattgtcttggagatgggagtccttaggtgagtattcttctcgctcggcatatcaagttatgttcttgggaagaagtcgcttcctatacaaaccaatctggaaatccttgcccctctccctcccaggtgtcattactttctttggttggttactcttaataggtgttggacagcggatcgactttggaaccgtgggctatcgcatcctgaccgttgtgtcctttgcgatcaatgtgatgaaatgatagatcacctcttggtcgcatgtccgaagtcccgacaactttggtggactgcacttcaagcaattgggtatgcagtttgtttgccccacaatgaggcttattttcacttgtggctttgtgatgcccgaaagaaagtgatcaaaggcgcaccgtcgaaggttcgacaccattacggccctagtagcatggacgatttcgaagaagagaaacaataaaatcttcaatcaggaaactcgatcttggacagagattgcgagggtcatgacaaatgaagccgagctgtggtggctagctagggcagcgattcccgccttggttgttcctgtagttggaacggggtcgcaaattcagtcgtagagaataggcttttgatctttggtctttcctgtatcatgtctccgtcttcttttattttcttaggttacccttgtaaataacttttgctcatttttaatgtaaagatgcgctccttacgtattaaaaaaacagtgggcagacccatattcgaaatttttatgagtgggacaagcctaacaatagacagagtccacacaagtttatacaaaatccatagatcattttagagcaccgttacggtgctctctacctataatattctactagcactaccggtagaagtaatctgagccgttaatttataagggtacattagtattttactaattaaaggttaagggtaattttaacatttacttttctttttcttaatagaacgatcagttcgtctgtgtcaccgctcctttcgttctggcgtgcacccaactccggcggcagggcccactccggcaagtgagagctcctccatcgaacaaaactactgaacaaagctatatagtcaaatcgagcagcaagggcaaatgtgctgttataaactccgtcgagcagaattcagaattgttgctacctctacgggtccatcccggaggcttgaccgacttcactaaagtacactatatctaatccatcatatgtgtgaccaggctgtagcgtcgcccctgtgaccaaacaacatcttatcagctgtaggtgaggagaaacctaggtaggtgatagtagatatgtggtgtgtacaactccttgtctccttgttacttgtacatgtactgctaatgttccatgttgtacaagcagcacaaacaaaatacatggggcaacacttgttcactcggaaaatgtttctgtgtggatctgtaatacaatgggtacgttcat

SEQ ID NO: 73362 - DNA, 700 bp, Oryza sativa
acaaaagagaagagaagagctattagagccatacccgaactcttccgaaggcttccagactcctgatttatactctattcctattccaccaactagatactactaaactaaacttgagagaaatgagagcccctgagcccctgattcatatttaatacatcgtaaaatctaattcgagagccatctcgttttagcgttatcgcacgacgctgggagagtcgtcctattgcgcgcgtcatcgtggagtccatctgcgtgggcctcgcagtcacatgcgtggctttctggataaggatcgagattaaaccactccaaccgcacatcacacgtaattcttgcttcaaagagagtcagagagagagagaggatggccactggcttctgcgttggccggtggtgatggcaatgaggacggcgacgacgtatccaccaagcggagaagggcgacagtgagcacgggggtctccgtcgttgccgtcgtcaaggttgaggtaggaacgagtgggggtgatgatgatgacgagtgcgaggcggagcggtgaggcgcactgtgtaagcgatgtactcgcatctcagcatattgtaagagaggggtgaggcaaggtgaccccctctcgcctctgctctttgtactaggagctgagcttcttcaggttattgtcaatagagctcatgtcaatagagctcatgttatggttac

SEQ ID NO: 73363 - DNA, 3268 bp, Oryza sativa
gactactatagggcgaattcgagctcggtaccctaatgttctaaaattggatatcaaaatgtatctaatcgcatctgtaatggctgttggccaaccgacgactcaactcctctcacacgagcacacacacaagaatgaaaggcaaacacagtggattagagaattttggtgctgcacaccagcaaaccacaacactcaccagcacgctcctgttaatcaccacacaaaacacaagctaatacacacacattaagccatgttctggccgcactacccagccaaacactgcatggcttaaccactaatcacttccctacatgcaggccacatctcttgcatatagagcaccacactcacacgttcagttgctggtatccaatccgccgatgcatgcgtccatgcaaaacagattgtgacctcttcctgctcctgaacttgcgccatgactcaatcgaccaaacgcctggccacacacatatgcaaaactaattctaacacacacacacacgtacatacacatcatgccaccactcttggccactaccacgccgcacgatgagcatatatactactaactacagcttaacacaaccaaacactaaaacaacaagattaatttctaacaatgacaagacccagaaattttcactacgattttacatcttattttcctatgatattttggacagattgaatgcctagaaagtaggtcgttcaggtgccaagattccacccactttttcaagtgatttaatggtgtttatttcgttgctattctcttgacacatatcaagtctttgactcctaagttttaataaaataaaatctctgattcctgcttactcattgtgaaaaaattatttaatttctttgttttttggagtatttccgagcacatcaagacgcgcgccttaataacccctactcaatccgaatccaccctccagctatatatggccatttgggcggcacggcccagcacggtgctggcccatgtgctgaagcatcggcccaggcacggcccaacacgactcgggccgtgccgagccgacccgaagtcacgacagcccattgcgcttcttcataaaaaagtctaattttcatcccttatttctttgggccatgtctgaatgattgtattcagtctattttgctttggaaaaagtacaccgaaggacctcggacgaccggttttgtattgttaagggacctcgtatatctggtttgcggttcgaggatgtttttatcccaatgacaagttgagggaccttcggtgtactttttccttttgctttccttctctcttgggccatgaattgtatggctgcattaagtctaattttagtccctaaactatttttcttccctcctcattggatcgagccgtgccggaatggcccaccgtgccaaggcatcggcccaggcacgacccagctgtcgggtcaggccggcctaggcacgaccccaatcgggccgtgatgtgcttgtgccaggccatcgggccttgggccttatggccatctatacctccagcagtattttatatgattttgtttctctcattcagaattttgataagcaaacataactttttttagactttatctttatatttgtgaatttttttggccagtagcagaatatgtttttataccaccacctatcatgtgatgatatataattactataagataaattctctattatttacgctaatattgcacactgggaattactcttttatacccacatcaacgcgcggggtatcaacttagttaacatagaggattgatgactcaattagagagcaatacaaatcttgactgttactgttgattgatggtgttaatttggctaattaccagtaactgatgctcatcaacggaagtaattgtgtttcggtttcatcatcctctcatttacctctgcacacatataaccaaagaagggcctagctcctgaatgtatcaaagagacacaattgtacaatactccaccctctacttttgtcgttgcactactgcattcccctcgctagtttctgcgcgcacagaaccagcgagagcaagcctccgaaaccacgccccgctgcaacgtttgcatggacattctcactaatcgtctgcttcatcttatttctagtgttgttcacaagaacaaggactatatccacgatggcgaccgatactgggaacgtcaacaccagcaccgctgcttctggatttgggggattctcttttgggtatgtgtatctacacatggtgttaagcatgttccagatgatttagttcttgttagcacgaacatgtttagcactacatttggatcacttttatgcttaaatgtcatatttattcttttgtttttctagattaaattacgaagaaaaatgactagattttcaccagcaaataggcagcgttgccgttgatggggctggaaacccggtggatggcagtggctgcttggatcatggatttgccttgaagtggggccttcgctttccaaggcaggtggcttcagtggcaccggcggtgacggatcaaggagacaaggattcggcggcgatggctgctctccagcccggatctcttgttttgatcagtttcttttttttccttgtagttgtatcgtttggggattttgccggatgttccataaacaacattgaacagaacatcaacacactacagaaatcgacaagttgggggaggacaggctgcggcggtggctagtggtgacacacatacggatgcgagctgatgaaacgacgtcatgcttggaataggcctgaaggtgatggtgtcgaccttatgcccatgagatcctgaggactaggaggtcgtctctatctgtctgctttacttagttcagattgtactcctgttaaatgaactaggaaggtggcccgcgcgtatgcacgggcacttatattattgaaaggtaagattattgtttgttcagaaattttgtcttatagattaagggcaaactaaagtttagataatattattttataataatttaagggttctatttttcttaacgtatcttaaaaaaccattcacaaacttaagtaggagatggattaagtacttacgatttttgaatcatgtttcttttttctcgaataaataaaaaactattgctagttaattatcatataatccatctatacacataccgtgtagtacgaccacaaatgaaaaatgcgagtgcaagatactcaaaattcttttgattaaatcgtctcatcaaggcgcatgat

SEQ ID NO: 73364 - DNA, 2427 bp, Oryza sativa
gtctctatctgtctgctttacttagttcagattgtactcctgttaaatgaactaggaaggtggcccgcgcgtatgcacgggcacttatattattgaaaggtaagattattgtttgttcagaaattttgtcttatagattaagggcaaactaaagtttagataatattattttataataatttaagggttctatttttcttaacgtatcttaaaaaaccattcacaaacttaagtaggagatggattaagtacttacgatttttgaatcatgtttcttttttctcgaataaataaaaaactattgctagttaattatcatataatccatctatacacataccgtgtagtacgaccacaaatgaaaaatgcgagtgcaagatactcaaaattcttttgattaaatcgtctcatgaaggcgcatgatatagtaataaagagagggaagcatatgcatgggaaaaaaaggaagaaggagaaaaaatgaaaaagggaggggaagcgtacgtacccatgcacgtaggtccgtacctatgccgcgggaggagagatgggacctcgtactatttagtttgttctaagatcaatttaatctaacggtttgtaatattggaccaaccgatttaagtgaaaatcaagaaatagatactttgtttttttcttagaatttctaatatttgccctaatttattagagcaccacgtcgcagcttgagagcattttaaggaattttaaatgacttaacacatgtaattagaatattaactgtgcaatatatatgtatgggacatatggtaatatttgttccagtttcgtccatgtttatatacatgtagagtgaaattaattttgtggcttgcaagcctctaattaatagcaattaattttgacacctatttacaattgttcaaagtaactcttacatattcatcttacgactttaataatttatcaccatgactcgcatgaaaaaaaaaatgtagtacttaaggtttacgatagctgaaattgatgaattatataatttatgtgatatattttttttgaaaatggatgaattatataatttatgtgatatttttttgagggtataaatgaatgaattgacttctaaaaagttagaatgtttttaatttaaagaagacactatttagaaacttggaaagcatgcaaacaaaattccaaaatatggaatcgggaaaaaaagagagggccttaaactccctttatcacccttgtcgtagtaagagttctatcaatattcgtcaatattgcgctcacatttataacataatgattcatttcacctatacgaacaaatagtacaaaatctaaatatgacataacacagatacattataattattatgtaatcaactctcggtttcaacttaaacaaagctaattagtgttgagaaaagcacaatccatggtacttaattattctctcactgcatcacacatttaattttcttttcatgttattaacaaaattaatcatctccatatatgatttgatttgtggcaaagtggtagctctacagcggttgtgatcaccttatatgtctcagacactacactttgtcacacatgcgaaaggcaaaggtgcatacgtgtattgtgcagtgggcaaaaagagaatttcggacgctttatttattagcaaacaatagatccgatgattataataataagtccaccagttctagtgtaagttaaattagttaatatagattttaaattgttaatttaatgggtacacaatatagtggtgtagaccttattttgaaacagtgaataatagaccaaggtaatgaaaagtagatctgatgatttatgtaatggggccatcaatttatgtgcatgtataaattaattaatatagatattgtttatttaataggtacatatcaacataatttattttaaaatagtgcattatttgaaaggaagattctttgttatatgatggtagattctttgttttgtaaaattatgattatttaaaaaatatatccattatatatatatatatatatatatatatatatatatatatatatatatatatatgtaaaaaggaaaaaaaggaaaagaaaggaagcatacatacatgtacgtacgtatatactccacctgccacctgccaacgcgcgggaggaggataggtgggacccatgatatttagtttgttttaagatcgatttatctaacggtgtataatattggactcaccaatttaagtaaaaatcaaggggtagatgtttttttttcttagaatttctaggattttctctattttattagagcatcacttggcggcttgagtgcgtttaataggtaaatgtgtaaaatttattttaaaatagtgcaatatttgaaaggaagtttctttgttatatgatggtagattctttattttgtaaaatt

SEQ ID NO: 73365 - DNA, 3239 bp, Oryza sativa
cctttttaaaccaagtgccaggacatctagcttaaagacttaccaatcatggtatatgccaataagacctcgctcgtaaatgataccaagagtgtcttctcagatattgtgggccaacattcattacccaagatattggagaatcaataattgccgcaaaacttccaagccctgcgttcatgtccataatattcctatacctcaaagaacctatcagcttgtttatcctcttgtaagtactgacatacttcttccacaacttattatcctcctcaaaaatttcttctgtaacacctggggtgcgaccctgtagaattctgggaggggcagcaaatagtctctctgggaatttccgtagctgtgcttcttccgggaaaggtgttatacaaccttccattttcttatacctataacaataaaccatataaaaaatcattaatgaaacaacatataaatactgtcagaaatagaaatcttcagataagcatctattcttgattccaccattaagagagcatttgcatatatcagcagcgatcactgtaataagttgcccctgacaaggagtaagggcaatcacctacaaatcctataatctagtggtatatgaaaaagctagctgtttttcttgtataacaaggattttggaattatggcgattataacttagtcgagttgatatggcatgttagaggttaacagcacgcatatagtagaactagatacatagagaacacaccagacatcatctgcatcttgaattttgcacatcctgctaggatggtcatccttattatgacattcatttgaatctgcctttttgcgccaaataacagtatctcccttctcatgaatcttaccccagcacaacatttcagcaattttttcgattacattttgttctgcctctaaatcttccttggatcttttccatgcttggtgatttgtcttccaattgatgggaggaccagacaatatccaatagccaccaggcctcagaacccgatctactttaaacatgtacatcgcatctgcatgaagcgaaataatatagcatatgcaaaaaagaacagctgatagaggcactacattttgtatgcacagttgacactactaaccatttgacttccaggagattaagcagcgtgagcaatgggccatatcaaaagatccagaggggtatggtagttttatagttccaagcactccaattactgcaggaacacctcgctccaatgcaaattgaacctgagcttcatgtgagtctcgaggtgcaaatgacatggttaatacatttctgtccattaggtaagcaccccagctggcaacctacaagtggcttaaattgttattgcagctacaacaggtgatcaagaaaatactaacataaggtcaatgaaactaaatggcctaattatacacatgaaagttcagagaaattgggctaagatgcactaatatttcatgaattactgctatgaggtacatcataaattaaggaaagaagcaactaaaaagacgctaacagagaggctaaaagtagctgctcaatgtttatacatgttcaagaatgataggatctgtttagatgacataccccgcatccagtatcaagtgcagtcctaatggtgccatcagtaaatggaatgacggatgcaagctcatcaatgtaggcatttgctccattgggaaacattgtcccccctcctggaaatctaaacacatctccctcaaactggacccagttctgaacagccttctcaactgtcaaattcttatatggtgcatttgcatatggaacatagtcacggctcttgggccaaggaaaaggggtgacatagcctttgggtgctgggattagacagcgcagtttcttagtctctgtaggacaatgcctctctcggtagttcatattttctctaggaaagttcattgctcggttctgatcctgacaaggagtatagtcactgtatcgaatatggcatggctcaaagactttatcggtcatgaccaaaggattaacaccacctaagctatgatgggtctcaaagtgcaagtttggcaagattgtacagtcggtctcttttgtcaccctcaatgcaatactatccccccttccggtcccacttttctgccaagctcctagtatataaaagaagcagcacaaactcatcacaattacgatggacatcgtgctccgcgttctacggtcacctggattcatcctcgagcccctcatgaacctgaaattgttgcagggaaacaattttgaacgaatttcagaaaattattacaggaaacttagttattctaaatgaatttatgaattgaaatatttgcagaacatgcagagactgggagtttcttccataacccaaaaatgtttgcagtgtatatatgttagtagatggcaaaagcacaaacaggggaaacattgagtcaattcaaaaagtgcttggtgatgcctatttgactcctaaccaattagtatgacgttaactatttccaaaatagcatatacttcctccgtttcacaatgtaagtcattctagcatttcccacattcatattgatgttaatgaatctagacacatatatatctatctaggttcattaatatcaatataaatatggaaaatactaaaatgatttacattgtgaaacggaggtagtatgtaccaattcaaatcgaacctggcatgggaccctttcgaatgcctatatagagttttctgataatggattctcaacccccgaggcagttcatcagcagatattatgctagctaacacgggagatcgaatgatgaaacaaagcaactgaactgaaggagcgagagatttagtcgtgacaaggcataaccaatttaaccagttcccatatctacaaggtcaatggccacctagaaatgaccaaaaatcagcctgtcgcggaagcatcgggggcttcgccatacaactcagcaagcaaaaggtaagaaatcgcggatactcgctgcatagcttggtcggggaatcatcatcacacaactcgatccgcaacaacaaaaaaccacctggcaggtgcagattctctctacacagtagaactagaactagaagggggctaagctctaagctaactcggaatcccgatccccacagcccagtaaagaactacacagagaacggattggattcgagacgaggaaggaagctctcgatcggaggaagcaaaccaaacgaaaccaaaccgatacc

SEQ ID NO: 73366 - DNA, 2155 bp, Oryza sativa
ggggtagatgtttttttttcttaaatttctaggattttctctattttattagagcatcactgggcggcttgaatgcgtttaattaggtaatgtgtaaaatttattttaaaatagtgcaatatttgaaagagagtttctttgttatatgattggagattctttattttgtaaaattatgattatttaaaaaaatatccattatatatatatacatatatatatacatatatatatatatatgtatatatacatatatatatatatatgtatacatatatatatatatatatgtatacatatatatatatatatacatatacatatatatatatatacatatacatatatatatatatatacatatatatatatggaaaaaagaaaaaaaaggaaaaaaaaggaaaagaaaggaaggaagcatacgtacatgtacgtatgaacctgccacctgccaacgcacaggaggaggataggtgggatccatagtatttagtttgttttaagatcaattttatctaatggtgtataatataggacccaccaatttaagtgaaaatcaaggggtagattttttgcttttttcttagaatttctaggattttctctattttattagagcgccatttggcggcttaagagcgtttgtaggaagtctcatggacttttagtatataatagatagatagatagatagatagatagatagatagaagatagatagatagatagatagatagatagatagatagccagattttgtttggttactggtagtacttagtacctcgagaggtacaacaaacctcactatcacgagttgttggatcaaaccataacatggatattgtgtagctcaacgtcccaccactagacgttgttgtgtaaagtatccatggctggccggacaccctactaaatagcgtccttcctaattttctaattccctccctcgatttacttatttttattcatgcatcattgattactacaaataaaaactcagttttccttagaaattgcaagaaaaaacacaaaaatatattagagaacgactcaaaggaaaatatccattacgttatacctctttctaacttttcttcagtatctacatgaatttagtcattcctaaggaattaatttgataggatttgaaaatatccaaccctttgcttttaagtagcaaattatttttttgaatagaagggcaggatgactcactacaagaaatatgaccttctgtgatgaattcctcatgacatcggagctactcatcattagcacattccattttatgacgattagtatgagatggggtggcttagtgacgaaaaaaaggtgttcgtcgttaaataccaactagaaatcgtcattgtgacaaatattaatttgtcataaggggcaaaaagcaaacgttacggatttatatatgcatttctagaattaataaaaaaactaaaattttcctttaaaagtcatggccggaaatatttttgtaatattctatgtggtctaaattattctctaaaatttttcgtgaattttcgaagctcaataactagttttaattccccaaatttcatttaacctactaaaataaatgaaaaataaattaaaatccctctctctatccttgggcctttttcggcccatgtgtcactctatccctccctcagcccacagtctctctctccctcctcgggccggcttcaccttcccctcctcccactttgggccaccggcccagcccttttgctcctccctcgctgagaaatctattttgcctccctcctcgcaattcaaataatttttcaggtagtaaatgatttttaatgaaaaagttgtgaacaacaaagttgtataacttatcaggatctacaacttttgttttggtcattttgctatatgactttgtttcaataatttgaatttgaatttcaaattatgacaacttcaaacaatattttcaaatactaaatgatttcaactcaaaaagtcatcaacaacaaagttgtatgactcacaatatctacaacttttgttttggccattttgctatatgactttgtttcaataatttgaatttgaatttcaaattatgacaacttcaaacaacataacattgttcacaaaatttacatctggttttatgtaaatt

SEQ ID NO: 73367 - DNA, 5347 bp, Oryza sativa
ggtcgctccccgaccacgtccgctccaaccgctgcctgcaaaacaaaaaaaaaaaccagaatattcttttattaagctcacagatctgagattatttatactggagtagcataattcaatgtgtttgaactggtacactgtatgactttatttttctgaactgaagttttattggttagatctagtcagttagagaaacctctttgttttttttttcaaaacatagtacaatgtactctatttttatgaacacatttgaagactagattgatatatttttatcttcagatttcatcacaggtgactccctgtcaaggggtatatcatctataaccaacagaataatatctaatcagatgagttatgctcgctttgcgaaaatctcttatgtgtttgtttacctgtgacttaaatgcattcaacttacttgacactttacgaaatatcaaatcgaggtttaattctaataatgaaaaaaatcaaacagaaacatatatatttttcatactctagtagtaatttattgttatattgacatattcgcatggtagtaactaattgcggaatagctaattgaaagtccgtttgatatctgaatgaagtcatgaaccttgcatatcgttgaatggagagcatagataatagggttttgatttcctatgttagatagatggggttgcgaggtaatggctattttatttatatacaaatattgcgaggtaaaaataatgcttcggtgtagaactacttaacaggtttcagtgtagatcatctacttagttgtgtagttgtgagtgtattcgtttgtactgttttttttataaaaaagctacataaattaaccagatccatacttctccaaataacaaatcttaaacgatttattgaagaacttcgcaaatttgaagatcaagaaaaaaccgatttctattttatgaacgatgggcttgggtttgtgctggtccatacttatgggcttaatatggcccgacccaaaagtcacagaggcccgagagagagagaacgcgcgcatctactggacttctgggcccacctgtcggcgtcagtcacaaaggcaatagaatcccgaaccgtccttcacagcgccgcttcaaaaccctagccgactcaatcccggccacactcccacccccacgcttccctcgccgccgccgccgccgccgccgccgccgcctctctccccgcaatctcctcgccgccgccaccgcagtcaacgacgccggccgtcgctgtctttctcgcgcgcgcgtggaggattcgaggttttatgtaggcgaagatggcgctagaaatctccatggaaggcatcgaagcgcgggcgcgggagcttggggtcgacctctccaccgtcgatctcgactccgtcaccctccccgccggcgaggacttcggcatcctcaggtagccaccgcctctcgatccggccccaacaaaactacctcacgccgtcgtgcgctttcgctggataccctagtcacccccttccgtttcattcagatccgattatagcatcgcgtgactgttcgatctgccttaatcaacgcggcagctagtatctgatgcttttagctcccactggtagagattttgatacggttttttagatgtgccatgatgttaatctgcatgagaactcgtaatgtgtcggtatgctaactatgtataacattataagtgacatagcaggcactgattgcatatatttgtatataccaaggttaaacatgcaactggtgtgaatgactgtatttcttatctgactaaaattgttccatctggtagcttatggcggctgatgcttaagctgactcacaattacatggccagtattgtttgcatttaacgatttttgtttgtccagaaaattttcttgagttttccttttatgtcgctgactgatttgtaatgttcagtgacgatgaggatttacttcggattgatgaccctatggagcttgaaatggggtttgctaacgttgttgtcgtggacaacctgcccgttgttccaccagagaagtttgagaagttggagaacgtcatacgcaagatctacagtcaaattggtgcgatcaaagaaggtggtctttggatgcctgtaaacccagagacaaagaagacatacggttactgcttcatcgagtataataccccacaggtactttgccacatgtcagatgcatttttccccttagagcatgacacatggcttgattcttgtctttgcaagtcatccctcagatctgtaccatttgaacatggatcacacatgagtacatgccttgagaacgccatgggcccaatcatttaaatattgttttgaaccatcattatttgcttcatccatgttcatttagcttttaatcgtttaatatgatgtaagatagaaatattgtgatctttacttatagtcaggtgaggaaaaataggaaattgaacgactctgtcggatgtttcgtttttatgttcatttttaagtctagtagggtttaagtttgtattactttgtttgacattatgtcaggaagctgagcttgctagggaaaagacaaatgggtacaagctcgacaagtctcacatctttgcagttaacatgtttgatgactttgacaagtacatgaaagttccagacgaatggatgcctgctgaaattaagccatacactcctggagtaagcattttcaactttacaccccccaaaagcgtgtttattttttaatgagcattttaattttgaaaattattaagatcctttttgtgacattgcctaatacctagattttgcacatgttttgcaggagaacttgcaaaaatggctggctgatgagaaggcccgggaccaatttgttatccgtgctggtactttcactgaagtttactggaatgatgcaaggcagaagatgcctgaacttgtgttccaaaagcaggtaccttgggtttcttgaattgaaattgaaaaatttaaggtcatgaactgtgctctgcactcccaatgcataactgaatatactcatcactttacctttttttttactcgtctagtactggacagacagttttattcagtggtcccctcttggaacatacttggcaacagtgcataggcagggctcccaggtgtggggtggcgacgataagtttgagcgtctaatgcgatttgctcatgcacaggtacgtgatttacgctgcactgagttatgtcagatatgtaatattttatctacctaacactgcttgtaacaggtgaaactgattgacttctcccctggtgagaaatatttggtcacatatagtagccacgagcccagcaaccctagagacactcatgtaagggaccgtcttacattcatttatctgctcatagctttcccttctgacttttgtgctggatgttgtagagggttgttcttaatatctttgatgtgaggactggcaaagtgatgcgcgactttaaaggaagtgctgatgaattcagtgccagtggaaatatcagtgtttctggtgtttcatggcctattttcaggtgaacacactggtttttgtatttgttattgaatgcattacctctttgttaagttgttgtacctgggggtgcttactatattttttgtgtctgaagatggggtggtggaaaagacgataaatattttgcaaggcttgggaagaatgttatatctgtctatgagactgaaacattctcccttcttgataagaaatctctgaaggttgagaatgttgtcgacttctgctggtctccaactgatccaatcatagccctttttgtccctgagttgggtggaggaaaccagcctgcaagggtaagtgcaattttctgtgcttcatcccttttgaggaagttccgtcaactaatggtgaagactaaaatctataatttttattgaaaggtgagccttgtgcaaattcctggcaaagaggagctgcggcagaaaaaccttttcagtgtcagtgattgcaagatgtactggcagaacagtggagaatatcttgctgtccaggttgatagatacacaaaaaccaagaagagtacttacactggatttgagctttttagaattaaggaaagggacatacccattgaggttcttgaattggacaacaagaacgataagatcattgcctttgcatgggagcccaaaggtcaccgctttgctgttattcatggtgatggccctaagcctgatataagcttctactccatgaaacatcccaacaacatcagtcgtgtgtccaagctcaccactctcaagggcaagcaggctaatgcattgttctggtctcctggtggaagattcattgttttcgctggtctgaagggctttaatggcaagctggagttttacaatgttgatgagcttgagacgatggcaacgggtgaacatttcatggctactgacattatgtgggatcctactgaaaggtaagcctatacttggtcagaaatttgtagtcctcaccatgacactggcactttattatgtcaaattttcaaaaaccaagtatcatatgccctacgaaaaatgttcactctaaatgaaaatttcaaaaccaactcttagaatttaaaatatttgagttttggttgcaatttttttataatacttctcactggtgtgactaaacaagttaagatggatttccttgtatgttagtggaactaaaatgatgttgggatttttttttgttagatatcttgcatctgcagttacctcagtccatgaaatggagaatggtttccaaatatggtctttcagtggcaagcaactttacaaggtgtcaaaggaccacttctttcaggtatggaggttccatcctacccttttctggactctcatgtctcattgctttacaccattgtaatcctttgtcatttactttaatttactggtacagttcctgtggcgtccgagaccaccgtcgctgctgacccctgaaaaggaagacgagattgcgaagaacctgaggaagtacagcaagaagtacgagcaagaggatcaggatgccttcaaccagctgagcgagcaggaacgcaagaggcggaagcagcttcaggaggaatgggaaggatgggttgccaagtggaagcagctgcacgaggaagagagaccatacaggatggagctcagagacggggaggccagtgacgatgaggaagagtacgacaccaaggaagttgagattgaagaggaggtagacgtccaagaagaagttccattcgagctggatcaggagtgaaaagcttatgctagcatctgctgagatctttttctgttgttgcctgtcttaagttaatttctgccccctttgcataa

SEQ ID NO: 73368 - DNA, 685 bp, Oryza sativa
ctcctactttaacttagatttggtacatcatttaataaggagtatcatagtacttcttttcaaatattaacatatgctaaacaatctaattaaaattataactattttgagacagaagtagtaactttttttcccccacccctaccacccacacctttgagaccaaaagacagtgagagtgcttctgccagtcatccggggtactggatcgggctatacaggatttgttcaatctcaccgtcacgcgcgttgtcgagagaatttgtacttggttatagtttcttcttcacacttatacattgagcgcatcacagcggatttgatttgcatgtactgataacgattccttcttttgatctggaatatcttttaaaaaagaacagagtatattatccaaattatataatcccatgagtgtcaatgccgttgggttttgggggcaataggggcacacataggccccgcacggtgctgcccaatccaatcatttgaccattcgtacagacccataccatggacatactttcctcgtaataaaaaaaatcaattatctacgtatatagttaggattaattttttagacgaagatagtaaatacacacgtgaggtggcggtaggtctcagcaagcaaacaacggtgagggtggactccactactccaacgtcccatccacggcgagagcgg

SEQ ID NO: 73369 - DNA, 13483 bp, Oryza sativa
ggcctgggcctcggcctgcggccggcccaacaaaaagggggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacatgtaatctcctgcctcaaaagtgagctcccttcgacggttatccgcgtagctcttctgtcgagactgggcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgactcgctcggtctgaccatcagtttgcgggtgataggccgtgctgaagtttaaacgggtccccaattcttcctgcagtttctgccaaaactttgaggtgaactgactacctcggtcggatactatcttcctgggtaccccatgcaaacacatgatccttgcgaggtacaattctgccaatctctttcccgtataggtggtatgtactggtataaagtgagcaaccttagtgagtcgatccacgactacccagattgaatcatgtcccgatgatgtccggggcagtcccgttataaagtccattccgatctcctcccatttccattccgggatttgaagaggttggagtaaacctgctggtctttggtgctctgctttcactcattggcaaacatcgcagagtgcgacgaattcagctatttcccttctcatgctgacccaccaaaatttttctttaaggtcttggtacattttggtgctgcctgggtgaatggagtactgggtctgatgagcctcggtgagtatcagatccttcagttctttgtcgtcaggtacacacaatctttctcccatccagattgtgccatgctcatcttcgtggaaatcccgagcctttccgactctcatgttctttttcagttctgctatttccggatcatttacttgagcggctctaacttgatccacgagcgtaggccgtgcctccagagcggctacaaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcgcaatagacttggaagtctttcatctggtcgggcaggatcaaaaccggtgcggatactaatttcttcttgagctcctcaaaactcttatcgcactcagctgtccatttaaacttctcatctttcttaagcaactgagtcatgggtcgggcgattctggagaaattttcgatgaatcggcggtaataacctgccagtcctagaaaactccgaatctgcgacacggtcttaggtggggtccatttggtaactgactccacgttcgatgggtcgactgccacaccctgagctgtaatgacatgacccagaaattttacttccgtcaaccagaagtcacacttgctgaacttggcgtatagctggtgctccttcaacttttcgagtaccagacggagatgttgctcatgttcttcctcggattttgagtagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagaaaatactttagctcctttcagttgatcaaataaatcgtcgattcgcggcaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtatggtctcttatagattggagcggttcccggtgccaagtcaatccggaattcaatctctctcttgggtggcatggtagtgaggtcttcggggaacacttctggatactcgcagactatgggtatatcttccaattttctcaagttcttctctacggtatccactgggatttccgtctcaatctgattcaacgagacccctttctttggtgagactagagatttgtacaccactgtttctcccttctcgttggtcaaggtgactgtgcgactcgcacaatcgatgactcccttaaacttggtcagccaatccatcccaagaatgacatctaggtctttggattcgagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcaaaaagtactgttgcagggattgagttaacagggaacgtacccagtacgacctccggtgctgtttgtgcctcctccgcagatgcgtggttgacacgagcctggataaaccttggcccggcacgcctgggcttcgggcatttgtcagcgaagtggccaagctcgccacagttgaagcaggaccctggtgtcgcgaccgggaaaattgccttttcccgaacgctagtgtatcaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttcttcaaagcttctcttactgaagaggggaaagattgagcaagaatgagtacaaccacagtactcagcaagccacaccggcagatgcatgattaatgcaagggggggtacaaggggataatataggggttaggttttgcagtaaacagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacataagttccaacccatcctaaccataaacaagagtaccgacccaatccccctacgggcgggacacccgggacaggcaagcaggactgaaccccctagcacagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccatggtgtccaaatgatatgagaattcccgaagtctaaagttataaaaccacctaatgttgcctaattaatcagcgaagcatctacctaaatttatactagtggaaccatgaatataatgtccactagttagggttttgtttattctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaatttcaattaaaaaccgggtttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggatgacgagggcgacggtgctccggcggtcggcgggcgaaacgaaggagcggacggggtcgacgacgacgcggcgaagccgatggaggtgacgccgagtcgggaggaggcccggagcgacgtcggcggcgtaccggagctcggcggcgacggcggagagaaggtgcgacggtgcgagcacgaatccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaaacgggagagggaaacgcggggaatgattcccccctcattatgtcgcgcggggacggcgggatgcggcggaatccgtggcggcggcggcgctagggcacgggcgagcggcgggagcggcgggaggaaggcgatgacaggtgggccccacccgtcagcgagggcggcgggcgggcccgcctgtcagcggcgcgcgcgcggggaggaggccgatgggccgcggggagaggagagagagggagggagagttgggccgagccggcccaagagaggaaggggggggaaaagaagacttttagagatttttctttttataaaccttttcaactttgtttatttcttctcaattattatttgtgctctgaaaattccactaaaatttgagggctctttttagaccaaggagaatttaacaaaaattctccgggtcacatttgaatttttcttgtacgtattttagtgtttgccaatttcttttcgaattttaattaattctattattccttttaaaagatgatttttatttcgggatgaatttatcaggacgtgacactggttttgctcccgtctccttcttggcttgcgcgggctggcctgactgtgccggtgccattggtgggcgtggagctgtaccgcggttgggctgacttccatggtagttttgactgccactggtgccctggtggaagttgctagggttgaacgggcggtgctggcggacgatcatggtggtaggtccaccctgctgcccgggagtgaagcgcggcctctggtgacttccctgatgtgccctgaactgagcggccttcctcttcctgtccatcttgttgcgttggtcctcctgacggattgccttgtcgaccagcctctcaaagtcagcgtagtccccagatatcagttggttggtcagctcatcatccaaacccgccatgaacttctcctgcttctcggcgtcggtgcggacatcctctggtgcatatcgcgcgaggcgattgaactcgtggaggtactctgtcacagtcctgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacacaggaccctgaagctggtgtgtggcaaaagcgaccttctcctgatcattgcactgcaggagattcagcttcttctctattgcatggagccagtcattcgcctccatggggttggtggtgctggagaaggtgggtggcctgacgcgtagaaattctggcaacttggactgagggggagggggaccaaactgctggtgctgctgttcggcgtgctgcatcatcctctggtgcatctgctggtgctgctgctgcatctgctgcatcatggctgccatcatctgagtttgatgtgccataacttgggcaagggtcggattctcgggaagtggtggcggaccattgccagaatcactgttggggtgcacaccatcagcgcgttcttcgccgttgctgccctcgcctgtcgtgcggttgccagtcctggtgtagaccatctggagggaagagcagatgggggaaaagaagaaaaacagatgctcaagaactaagctttattacaaaggaattaaaactgcaattgttctgatctgaattaaaaacacttaaaagaacaagcaaacatccttattaagacagccatatcataggcacatgatatcgaccgtcaactgaccccaaacaagcaacctaaacacacaaactaacaaccagaagctagaccatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtaccattggctgaacctctggcggctgatgctggagcgaaggagagagtgaacgcgggagctggaactggagctgcaggaactgcgggcggaactgaaggtgctgcgggagctgctgctggaggtgggttcctgggcgcaagctggatgcgcacaggtgcagtcgtcgtcttgcggggcatggtgcggatccggactcctcctggcgctggaagaccctttagctgagcgttctccttcttcaggcgcgctatctcgtccttcagggcgacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccactgagcggcggaatcgtcgtgtactccggcgcgttgaggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccacctaaactatccaaattcatcagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttctttcagggcatcccgcgaaccggtccttaactgccatgggtgcgaccagcaaaaccatgcacccacagcccaccatgtgattcattttaattaaccaacaccagagcggtggtactaatccaacattaccattagaaccaacagtctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaacaaatgcgatatttgaaggaaaacattaggacatttgcaatataggatcaatatgatcaagtgacaagcatgacttgccttgctctgctgctggagggacctcggcgactatctcgaagtacaccggaacgtcggaggaatcggaatctaacgacatacaaagcaaacattgcaaacaggctataagactactgaaacagagaacaaaaccatttttaatggattctacacaatttccttgatttactgagacttgaatgggattaaacggagctcggatgaattagttatgaattttagaagattcactgtgtttattactataacaaaaatccttaaataatttattgcgcaataaattccagggctgacgtcagcacgggggtgcggcgccgacatgcggggcccaccggtcagcggcccgggagagagagaaaggggtggcggcgcgcgggcccactgtcagcggcacgggaggtggaaggggcggcggcgccacgtggcggccgaaccgacggccccgatctacccaagggtagatcggacggcggcgggagctcgcggtcggggcgcgcgggcgcggcgcaagccgaaccggcgaccatggcgccggcggcgcggcgctcacgcggcggcggcgcgcatgcggcagcggcgcaaggcgacggccgacggcgaccgaccggcggcggagagcggcggctagaggaggagcggcggctacacagctaggcggcggtgcggcggttaaacggtgcgggagagagagagaaaacgaggaggagggtctcaccgacaacggtcgacgacggcgggcgtcggaggacgatgacgacggcgggacgagctccggagcctcctaacgaacaaaaggagaggggttagagagggagggaagggcgcgagagggcgagggcgccggccgaaggcggcggccatggcgtcactcaccggcgcacgacggggttgggtctccggcggcgaacctcagcggaggaggggtggacgaggtagatctcgaccgcgcgaagctaacggcgacgacggcgcaaggcggcggcgagcctagcggcggctagcggcggccgaagtagcaaaaacggcggcggcgggtggttgcacggcgcgggagcgatggggagctcgggagaggtcggcgcaatggggaaaaagtgagagggagtgccggcgatgcttaaatagggggagagagggccggacgtggccgggagcggcgggaatcgccggccgacgcgggggagtggggaggagagagaggcgggattcggttttcgaatcccggccatctcgggcgcgggcgcgagcgggagagagaggggaatgggcgcggagggcgcggcgcacgcgcggacgtggccgacgtggcccgggggaggcggaggcgtgggcgcggcggccgttacgggtgcggcggcgcgagcgggaaaggcgggaggtgggagacgggtccgacaggtgggtcccacctgtcggcgaccccagaagggagggaggcgggcggccggctgccgggctgggcctcggcctgcggccggcccaacagagaggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaggatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggat

SEQ ID NO: 73370 - DNA, 19363 bp, Oryza sativa
  unsure (1)..(19363): unsure at all n locations
gcggcatggtgactgcctcctctgcaagnacnncatcatgtcgagtcataagacagaattgccctcaccggcaccttcgccctcggcttcctccgcgtcaactccaccatgctctacctcgtcgtgctccacctctcatcctcgttcccactctggtgctcctcaacacctccaacctccaaatccagagcggcgcctggtgcgagtgcctggccaatgcgacggacggctcggtatgcgccgctgcatccgtcggcggcggcggcggccgcacgagcggcgaggtcggcgggctgtactgggaggtgcggaggcagcgcgtggagctggcttacaaggagctcctgccgtttcaacacttgccgtcggcggactgcgaccccacctgaatctttcatttatggaaagcgaacttgcatgattgctgcaaacaaaacacaaaatgcaaattccaatgcttattcaatcgacatggtccacaagaccacaacttcagccaacacttactctgacagacaacacttattccgacattggttcgggccaacacttaaccgacggactgggtaccgcccaacactatccgacacactcggttttacccaacactctcattctttctttttcccgaggcgcccaactctaatttgacaaagactgggtttagcgacagcttgttttgattacacgcactcaggaaacaagtttgatggaggctctgcctgctagcattgtagccgaacaaaagtacaacaccaatacaccatcatggtcccttcaccaacaccagaactccagaaggatgatccagagaaaggccagcgtccatctgtccctgaaaatgcactcagttaattagatgtcactatgatggatgcaacaaaaatatttactccttagtttcaagataccatgttcgaaatcagtctgatttaatcagaaagtgtagtttagttcagacagttaagataacacttgtgtgttcattctccattcatacttccaagttccgatgttcatatttgaagttcaacacttgagctcaggcagctcaagataaatactaagtgctcaatcttctctttacttagtcattgtgttcataactaaaaagtgcagtttagctcggatggctaacattcaaaattcagggaccactaagccaatcagatggatctagagattacagatttacagggcatcagcataacaaacaaacatacaagttgtaaaccgaagtagttttctaattgctgacatgcatacaaagtcctgaacctgacattatcttcttgatttcctgactttcataaggtatctaacaatagataaatctaagcaatgaaagctatcatggacaacaataataacctaaagccttaacaatttgtcaaatgcatccgatttacatgataaccatgctgggcagaatataatgaatgcttaatacaataacaacaagctgatcatggcctaatgcaatgcataagcataacaatggagattttctccctcacaaaagaacatggcagacaactagacgaagcaaagattacaaagaaaagcttaccatttcatacgcttggtggcgacaaagatggggcgaatccagcaaacagatcagcacctatcaaggtacgcctagtttcacagaacatctcaaccttgaaagtcttgagctccaccgtaaagcacacctgatcttgcacaggcccctgcactgaaatcccctgaacaaggaggtaacccccagctgctcccaccaggttgtaccgaaactccactggcaacttcatcagcctctccaatggccacttgttcgcgccctcgggatcccaaaccacatagaacatgtcgaatgtgctgtccaatatctcgtcaaccatggcaaacatcccaatcccgcctctcgctgactccacgattgcaacctgctggatttcaatcagttcactggatgggaggttgatggtggatagttccatcgtgaaggtgtccagcacaagtagtttcttcgcccaacgcaagaaccagaagatgcagccgtgagcatggtggcgttgggtcaatgcggtttcctgagatggagttgctgcgaccaaaatcccccatccgtcgtaggaggtggagctccattgttgggtatctgaggagaaggtgaacacgactagcttggactggcatcgcgccatgtacatcaccctgaatgacgtgccgccgccgccgtcgtcgtcgtcgtcgcgtggcggagcgaagaagggctgtaaatcgaggaggttgtggagctgggcggaggcggcgaggtcggcggggacggcggggagaaggacgtagcgtctggacaggggatcgcagacggcgaggtccatgaagccgggatcatcgtcctggccgtcgacctcgccgccgccgcccacggcgccgcgggagaagaggacgcggccgtcgaggacgtcgcggcggcgccagggatccggggacgaagggaggaaggggcaggcgaagtcgacgacgtcgcgggcggctgcccccgcggcggcggcggcgctggggtggggcggctccgcggggacgaagccgccgccgacgtcgatgaagccgagcagcgccggctggttgtcggcggcgcggaagcggcggaggaaggagggctcggtgatgacgcggcggaagccggcgcaggcggtggcggcgcgggcgaggtcggcgggggacgggacgcggacgaagatctccctcaggacgtcgtcgctgagaaccgccagcggcggcggcgtcggcgtaggcgtcggggcagaccgcgccgccggcgagggcgtggcggcgttgggcttggccgctcggcggcggcggcggcggaagcaccgcagtttggccagccgctttaggagaaactgaaggttggccattagacagattggtgtgtgtgggatgcgtctaggggtgtctattgtagtacgtcactgcgtgcaaccagctagccatgttaaagaaaccgggagtaaacctaagtacctaaccggtcactggttcagggttgggatctcttcaacttgaggatatgaatttatattcaaatttttatttgtaaatttatcagctggttagctgccaaagtgttagatttgtaggtatgtgatttgatatgatagaatccagtaaaatcataattttagaacctagcaacactagaacttcttgtgagctttttaaatggcggtgccgattgttacaagaggggttgaactttgatgctaatatgcattctattcactcgaaaggttagaaacccttatattcatatataatttataacatgaaatttatatgtttgaattagattactcgtggtattgaaaatcacgtaaatttatgtcgtatccacttagaatgtgtcataaaacacacgcctacaagtgcaaatgcatcatcattcatctatctatccgtttatctatctatctatctatctatctatctatctatctatcttggatatgactcaccattcatctatctatctatcttttagtgtgacgcaccattcattaaatggactaaatcaataaccccttactttttcataaatgattagtgtaggtgacgtgctcctttagcgcgcaatgccaacttaacccaagtttgcgtgcccgataagtttttatcaacaaaagcaccttttcttctcaccgcatataaaagcaccatttatgtgtttctataatctctttctcgtgcaatgtttctttgtacacacactttaactttatgacgatataagatttctatatgtgtttatccgtagttatatttatgtatcattataattgcatatatgattggttaatggtatgatctatatatatgtgtgtgtgtttggtctgatttagtatcatgctagaattttcacaatgcacacatatccttatgtttttagctcatgcccatacatatgcggtctctttagatgcaattggcaaccttcaagatggtgcccatccagacaataggacactcggttttcacattgcgtgactcgccgagttgctctgtgagacagcccacgaggccagatggcgtcagagtccatcacacgataaggctaatcggtgtgccacagcaactagatatgcagttatactacaaagtaaagtaaagagaagactaagacatgttcgagatgagtatgatctcttagacaatacaagattagattatttaaagaccgtgcttttacaataattgacgtaacaaatactctaaccattaactcaaaaaaatattattctattgctattctttcctttttcacccttatacaaccatgtttccaatagaggttatgagtcattattgagccgttgttaccatatagcaacggtattttgtctctcctatttatctctcttccatattaacaaatattcataattagcaacactaagagacatctattaatgaccattataaatgccctaaaatgagctagtattactttgttcgaatgactaaaaaattaccttattaagcaggtaaacaagagagttttatgctgcctgttgatcatggtggacgtagattataatggtttataaaaatatacaattgtacttttgtagatatatagaagcaggcgttgtatattcacgattacggttgagtaggatatttggctatttccattcatatagaggtgaaaaacgtgttctcaacccataatccaaattaaggaatcaactttgcgctctctctttctctctctcaacacaaattgaaaatgcaatatattgtgtttcacatgatcttcattggaaaagagaaaactatcctgaaagaacatttctattttcaactgagtgccattccatgcatcagcacctgtcatcctatttcattgagtactacctctgcccaaaatacagtactacctccgttgcaggttataaaactttctatcattgtccatattcatatagatgttaatgaatcttgacacatatatatatctagattcattaacatatatatgaatatgggcaatgctagaaagtcttataacctattaagataattttattgtcattacctacatgccattgccacctataaccaaagttgatgaccactgctacatataaaagttaaaaacactccagaagtgataagtattatcatcgtagcagcatagatatttagatatctgatgtatcaaccctacattgtataataatataacacagcaatttgaagctcttataaacctccaagatgtagtgtgacgtcagtggctagaagctgcattggtttgtcagacgagaccgagaaacttacagacaaccatgcatgttatcaatccccattgtcacgatgtgttcatgtgaccagcactcatctacatgaattatgtgttgcgcgctgcttgctacatatggattaattcaacttccaaagtgaattctggaatgcaaactcgtaagtattatctctcctctctttttttttatccccagatgtaacgaagcatatattactggtgtaacatgaatctcccgatcaagaaatttgtacgagccgtgggatcaagatcatagcaacatttacacatcttctggctgaaattcttctagagatgaaccgtgatttcctatttggacacagacatctaattgcagcagaaagaagcaataaaacaaaactaggaagcgatttgctcaccaaaagaagtgaggtagttagataccagatatctaatggaaactctgagctccacacgcagcacattagcttggaaatggaccagagctctgctacgaataccagcacagcattcgcatcatcagtgcatatcagcgttcagaagaaagaaaatagtttgataacataataagctagctagtacctagcaagcagcttagatcgaaacacaacgaaagtgtattataagtctggtaaatatacctagccatggattagtgcttaacaagtgtttgacaggtaacgtgaagtacttagcaaaagcaggcaaaggtgaactagactagcctagcgcgagtgcagacgcagcaggaccacagatcacggctattccccaacgaacagcagcagaatagtagaattcctgcaaatacatatagtaagaaacaactgttatgaacatgataacagatttattaatcttcacagtttaatactcaccgaaaaaccatacattcaagatttatagttaaactataaatcttttttttctgaaggtcattaaactgtgtattaaaaggatagaaaaaaaaatggacggcactgcatacttttgaaatcttgaaaccaaaatggagtatgataatttcagtattacatgcacaagcacatgtatttgtgtgaactgatgcacactgcacgatgacagcaccagttatttagcaaacatggcaagacctatatgatggaggttatttatttttaaacgggggacctggattgcaaagggaacactgacttctttctgaacatcggaacactaccttaagctttcaacgataatatcatgccaatcattttcccaataacatgacctatatgtgcccaactgttgccctacaataatgaaaagaaaaggtacataagcttatggcaattttttagatgaatattctgagactaataacttctgggggtctgggaataaatttactttcatataaaaacttcagttggctatttgtagaacaagaacatcaagcttaagggaatttgttgggagtacagacaacaaacagagcctataaaaactcacagagttaaggcaccctttggtgtaatacaactacatgaggactagctaacaataaggaaaatgtattttcaaaaaatgaatgtctgcagtatctcccaactcccaacttttagtagaacattgccagcgtatctgttatatgaaggctaaatgatttgcaaatttactttatcattcgaattaactcaaagtgtgatgacaccagtataattgttcaacaactcaacaagacattggtcattgtcgtattctgctattcagggctttgataagcaatcagcaacacaataatttaagcactaatggctggcataaactaaaaataacctaaagcagtaatgcatcgtaaaatgcatacaagctctgtgatggccatgatgcgcagaacatacatatataatgttgctgcaactgcaataaggtctgtacaagattaagtaccagtacagactagattctaatacctgcatcacaaaggataacttctttgcatgaagcatatgccaaacaaaaataaccaagaacatgagcctatgagacaaaagaaaataccatttcataagcgcggtggcgacaacgatggtgggtaactggtaaacaggttagcagttttgatggcatggttagtcccacaaaacctctcaacccgaaaagtcttgacctccaccgaaaaacaaacatgctccggcacctctgacgaagattctgaggcctgtgatgatccattttgacgcgaagaggcctgccatgatgattttgaaccctttggaatcccttgcaggagcacgtaacccccatcaatccccaggagattttcataccaataatttaagggcaactggatagcctctattacacgccattgcttcactcccttatcattatcttgccaaatagcataatagaggtcaaagctggtataaaaattgttgatgagaacgaacagcccaagctgaccttcctctgtctccaggaatacaatgtctttcttccagctgccgggaaccatctcaattgtggacaactgatttgttgtggtgtccaggatcaggagcttgttcgcccaatccaaaagccagcagatgttgccatgtacatggaatcgccagaacatctcggcgagccaagtcgatgtcccgttgatcagagcagcccaaccatcgtactccacggcgcgccattccccagcttcccaagggaagataaacgccatcagcttggtcaggccgcgcgccatgtacatcacccggaacgaggcgccgccgacctcgtcctcgtcgtcgtcggcggcggtggcgggggcgaggaagggctcgaagcaaaggaagctctggccctcgagatcgagggggtcgattaggtcttgcggtatttcggtgaggatggcgtagcgccctgagaaggggtcgcagaccgcgagatccatgaggaggacgtccgcgccgtcgtcgtcgggggcgtagtactcctcctcgcgggagaagaggatgcggccgtcgcggacgtcgcggcggcgccaggtgtggcggtcggggaggaaggcgcaggagaggtcgacggcgccggcggcgggggcgctgcggtggggcggctcggcggggaggaaggcatccgcgtcccgggggaggatgccgaggagcggcggcgggtagagggcgcggtagcggcggaggaaggaggggtcagtgatgacgcggcggaagggcgggcaggaggaggacgcgcgggcgaggtcggcgggggtgtcgaggcggatgaatatctcttccaggaggtcgtcagtgaggatcaccgaaggcggcggcggcggcgccggtgcagggttttggcgcggcgaggccatcgcggcggaatgggagtgaggagtggggaggacggggagtggggtctgaccaggtcaaacgtggttaggggtattttgggtactttagactgaaaacaagagaagatgaaacgaattatgggaatctttgagaggtaaaggcataagcgccactttaatcctgttggataattttctatgaaaacttttaaaacaaaatattaaatcatgtcatgttgtgtgaagtttcgatggaatgaacaaccatatagaaattttagagaaaacttaacaagagttctaatatattgaattttttttaagtctacctctcttattcgatttttgttttttttctactatccaatcaaatggtctatcatgtattttataatcctctattttatactcctaaattataattacattcatgttagaattgtttttatcctaaattgttcaaatcaacaagaatttattgaatgtcaaccgatacacaccccatgaattgaactcttgacacaaattcttagagaatattgtgcaatattattgagtttgagtctatgtaatgtttatccaattctatactctcacaagttaaaaatccacaatgcctactatatatacggtctatcaatgcaatcgttttgttcatgtttatgtgccaaaatttaaatttttaaaacttaattttaagtagattatatgttttaaaaataatttattttaaaatatttatttttaatcaataaggacctatatataaaatttttactcataaattattttttattagctaataagccatatggataagcatagcataccctacactgcgggtggttgcgattgccatcttcctaagctgccgctgacattctcttcaacgccggtttatttgtcgtcccccatgctgtggcagccacgctcaccgtctccactgacgtcactctagatatgcctcctattccaccttctgccgctcctatccaatttatacaacgaggctagactcggacgagtcgctcattgtctccccaaacatgaggaaaggaaggagagtggggaaagcaagagaaaagagagagaggagggtcactaacatgtggtcccacatgttgacttagcggctaaaccaggttaacgtgccacgcaactgaaaatcatcgtcaatactactaggagagttattcttcattggtttaaatagttagagggttgatatgtccggttttacggtttaggaattcaaattagattcctatctgagtgaaattggactctttgcgctctcttcaccatggcttcctgccacacgaagccgagcttgcgacggtgccatgtcgaagagtggggagcttccctctacctcgcggaggacagcgccgatcggcgacctctgcgtgccagttgccggttactgggcgccggcggtgggcaccctcgaaaactgacggggcaacgcgcacgaatgaaggcgatcgagaaaattccttatgtaccctaaaatttaagctaatcccttctatgcccttgaattttgtttacttccttgtatacccaaaaatttaattttgatcccttccccctctcgtcagttgaccgtctaatttctagaaaaattaccattttaccctttggatgtatatacaaatttatgaattatattattggaaatgtaaaagtttgtcgcattagactattatggttatgagtttgatgtgtgatacattatttattaaaaaaactatttttagataatgaaataaaaaataatgtatttattttattttaaaagtcataaaaatgaggagcattcatacaaaaaatactgcgaatgctcaccatattttttttatgaatgatcccgataaagaaaatctattgtcatattaaatttcaaataaaaattttactttattacatttgttttcttttcaaaatttatgtcaaaattttccgcactaattatttagtctcattttctacctaaaatgcatatattgtgcactcaagcaaaattttcaatcatttttcaagcttatattcaaatctaaatcatcaagggcattaaaggcatttgccatcaacttaacagttaaataaaggaaaatgtgatggcaggtcggcaggggcatggaagagataagttaaaatttcagagatatagaaaggatcggataaattttagcggtataaaaaggattgagcgagttttcaaggatatacataaaatttactcaaatacgaaggcctccagttcctcgttgccttccgccgccgagccctcgccggtagaatgctgcagcttctcttggattcggagggtagaaatgctcgctacaaaatactctgatttttaaagtttactcccctgattgaaaaaggaaatctgattgaaaaaggaaatcatgcctctcctgatcaatcgtgtttgtgctttggaagctcgagcacgtatacgtgcagagtttgggatcggatggagaagtccaaagtccaaaccaaaccggattcatctcgttggcgcgcgttggggaagcagtccaatatgcaagcggactcctccgcttgtccttctcttcctcatcgtcttggtggccgctgagtggacggctcgacgccgtcgccggactcagtgtcgtcccaactccggcaccggtggcagtctcggcgttgagatggcggctccttcgaatcgaaagcggaagcgtaggtcagccggagccgcgggagcacgaaagagggctcgcaggcacagcgtcgttaaggtaaaactacaaacccaatcccctgtcgttttcatgttgaggtgtactccctctatcccataaaaacaaatcttgaaccgaatatgacataatttagtagtacgaatttgaacattttcagattcgtagtagtactaggatgtatcacatccagtaatagattgattttttatgggacgaagggagtatgctagtaatagggaattttgcttctccaattaatcctacatcctagtacggcataatgttgttcattagttgatcagttcggcttattgttatggttgttttatgagtgaaattcgtagccggtctttaaacttgaactggtttgttacttaggtccgtgatcaaataaattgcatatttagatatatataattctagcttaaaatatcataatgggtcgaaagtgttgaccgatcttaagtgcccacgtggttgtccacgatagccaaaactttgcattcaacctcctctgaaaaccgcggtgacaaaaaaggaaagcatatagccccttctccctaccgtgtacatccaaatatccattcaactccttcttccactacatttcaccacttcgactctacacatgcagtcagtagggagggcggcgattgggctgacgctgacaagcgtcggcaggccaagatgctttggccggagtgataggtggcacacgataggcggtgcaacatgttggaatagtcagcgggaggggttgggggttccgagttacaaaaacgaattcaaatgtctatattttggcttcttgtcttaacttaactctatgggtaacaagtactccctatgtttcatattataagttgtttaactttttattagtcaaaattatttaagttgatcaaagttataaaaaaatatggtaacattttaaatagaaaataaacatattatcaaaatatattcaatgttgaatttggtgaaattaacttgacaacattgttttttttaacgcaggcaaacttacaacattgtcaaacctaaaaaaacttagtaagaaaaaaggtgaaactacttataatatgaaatagagagaatagtaacagatgttttttttcctaccacgcagctacgaaaacagcatgaaagcacatgccacgataggataagtgaactacccgatgacctcttgaccaccattttgggccatttggacacaaggacatcagctgcaacaagtgtgctctcaagaaggtggcaacacttacggaaaagcgtcccaaagcttcgattctcacaacatgacatattgccacaaacagaactatctcattttctgagggcccatgaatatgtttttttcaagccatcgctgtgcccatggaagcggcgggtacgagctaatccagagcgccttatcaggtactccctccatacttgtaaaggaagtcgtttaagacaacgacacgatctctaaaacacaactttgacttcttttttctataaaaatatttattgagaaataatataggtatacttttatgaaagtatttttcaagacaaatctattcatataatttttatattttcaaactcaacaacttgaaagttatttatgatttatattcccaaggtttgacttaaacattgtcttaaacgacttcctttatgagtatggagggagtataaaattgaagctaaacttggtaccatctgtcagcgatcttgaaatgaggcaaatcatattttgttttattatgtttcagcaatacttaagtaaggtaggcagtatgtatgaaactaaacggtgatataacattactattcactgattacttggcaggctagttggcaggtatagaacacgtatattcttgagtttgttaactggctatctacacaaatcaaatgctggtgacaagaacggcacaaaaatctcaagccttgtcttgtgttgcaccatggaggatttttatgccaacttgattgacaaattgatcagcattgcaatctgccgaggagttgaacatctgaatctggaaacatacttgtattctgctaatgatcaaagacctagcccagctccgtacaagtttcctttatccttgttcgctgatggtaagggattatctgtaacgaaactcatacttgccgagtgcaccctcagtattcctgtcggctttgctgggttcaaatctctggttgagctatcgtttactgaaatgcatatttctgaagacatgattcagacacttattgaaaattgcccaaatctggaatgcttccgtcttagactttgcagtggtgctagacatctcaagattgcatcgcctcatttgcagctcagagaaatcatggtaaagagttgccttcagattacacacatggagctttttgcacctaagttgcagcaatttacatacagagggccatgcatatcaatggttctttcctctgtgcccttgatggagcatgcgtgcctggattacgaaggtagaagggacggtgaatctgtcaagtatattttagggaagttgtctcaagacttttccctacttacaagcttaagcattgtgcttaacacttatcggttgaaggtgtggagatatatttgctcttctttttagtgttcattgtggttgttggtcacacgagttacttgaacattctgatttacactaatgctgtttctgcagaatccagtaattccagaagttgttcccacgccatttaagaacctcaaaagtctcacgctgggtgcgataatgcactgtaacgatgacattggttgggtaactatgctgctggaggtggcacctgtccttgaaagttttcagatagaagtatgatgaaaacttcgctttactagtgattgcatttattagtttgaattactatctattttcattgacagtcgattagttcgataagagttataaatttacatgcatgtgtactccttttgcttatattttaaatatttcttgtacatttttactagggtcttgattcatgatacataatgcctgaaacagttagctacaagtattctgaatcaccaagtaaacaaatacaaaactaacagcttgtggtagctcaggcctctttagttcccaaaaaagtattttctaaaaacatcacatcaaagttttagacatatgcatgaagcattaaatttagatgaaaaaaactaattacatagttatgatagaaatcgcgagacgaatcttttgagcataattagccataagtgctacagtaacccacatgtgctaatgacaaattaattaggctcaaaaattcgtctcgcggttccaggcaagctatgaaattagttttttcattcgtgtccgaaaactccttccaacatccggtcaaacgtccgatgtgacatctaaaaattttcattttgcgaactaaacagagcctcagtctcatatgtccgctcgctctagctcaatttcatgtttgaagaccttagtgtttttttaggaaaaatactaccagaccttgcttagcagtgtgattttataaccaaagaaaacataatagttttatacatgtatataccttagtttttttttgctttgaaattcatttattagcttggatagcaaaatggtgtattttccctaatttctcgtaacactctggacgtactaacccttgtcatatatttttttctgggaagttatgcatatatattgaagtgcagcgagaacaatgtatatcactaattcaccatggaactaacccatgttttgcaagtgcagcttcttaccaacgagaaacgagaacacccaggcggcgttctgtgggagccatcagacaacgcgcaccgtcatctgaggcaggtgaagttctaccgcttcaggatgagacaggctgatgttgcgctggcagggttgcttctggcaagagccccattgctgcagaccatgacgttttcccgtggatctgttcatcgctctcccggtcagaccgctcagtacgttgaggccgccgccgactggaccgcggagcagcgatctgctatcacacggcggcttgagacatgcaatgcttttggtgcaagattggaattccggtcatgatgttggatccccgtcctaaaatacactacctcaatgcatatatgtataaggttggctagtataaatttgaactagccaatgtcatataaaaaaaactggatagagtagatgtttaggaaatggcacatcctaatataatatgaatctatatatcattgttgtttagatttataatactcggatatattgttatactttagaacatatataataacttagtagtctagttgtataattttgcgtcattatttcttcgtttatggttgggttgtctttacgtcgagatatgtgctaattatcagatatacgatttcacatactatagtatgtgccgtttgaatgcagaggccggtattatatataaataatgtattatatataagttaaattcgtgttggtgctgcactgcaccagctcctcgctgcgtgaccattccgtttctcttcctatctaaactatggaaaaaaatagagtaaattttacaaaactacagatgctataattaaattatcacaaaactacagatttaattcggtgtatcataaaactacacatttaacaccaaatttatcacaaaactagatatttaagatgaagtatcacaaaactatatgtttagtaactaaattatcataaaactacaagtttagaactaatttagttacaaaacaataatatttatagctccagtataataatggtgctagggatttaaactctaatgttgtagttttatgataattttaatattaaggggttgtttggttggctcccaaagtttgccaaaggttgccacacctcatgttagtcaagtttgaccaagttagcctattgtttggttcataggcacacttgtggcaagattccttctcatctatttaggcccccacatgtcatcaacttagtaaaatgtgacacaatccaattttgctagctaaggtgtggctcattttttgtaagccacaacttagggcctatttggggagctttagattctgagaagcagctgtttggtagccaacttctgagaatctagaaaagctctgaaacccagcttctccagcttctggcttcttagttcatttttcagaatctgtaactacagattctcaaaagctgtggactgtttggggcagcttctagcagaagcagcttttgagaaaagctgcagttgggacaatctcccccaaacagggccttagacaagtgtggcacaaaagtatggtgaatggtggcaaacttagtatagcatccaaacatgcaattttgtgatacttaacttaaatatatagttttgtgataaatatgatgctaaatatgtagttttgtgatacaacgccttaaattcgtagttttgctatagtttgattaaaaaaaatatctgtagtttcatggaatttacttaaaaaaatcaggagcaatagtgcctcatttagaagacacgatatttaaattaagggaattcgatttcatgtaaaaaaaatcagagataccataattaattaaataaatcctgagaggattaaactattttcatatagaaaaaaaaaatctgctactaacaaattcgtgcgtggcaaggacggaaagagcccaaaacgaccaaaaccggactctcccgttcgcgtttgaggagcacttcaaatttccgaaggactccactgcttatccttgtcttcccccaatcatctcgcccacgctgaattctccaattaattttccgcccacaccgtcgcgcacccagttccgccgccgccgccgccgcccgccggcacagcgcccgcagccagcgatggcggctctaccgaggcgaaagcgtaagcgcgggttaggcaaagccgcgggagcacgaaagagggctcgcgagcagcaccccggtgtcgccaaggtaaaattacacgcaaaaaagcatctaatctgttactgctagttctgaattttgttttatccagtccaataaatcctctgccccttctagttcagtttaaccctgcttttacgcactttgatccaatgcaactgttttttttttgtaggtaaaatattttggtcgtaatatattttactaatctagattttgaccaccgagttaatccaatgttaacagagagtatttggaacgtggtgtgtagcaaagtaacaataacctcttctcctgcagcacagctacgaaagcagcatggaagcacattcgaagataggataagcgaactacctgatgacctcttgatcacaattttaggtcacctggacacaagatcatcagcagcaacaagcgtgctgtcaagaaggtggcaacacttgtggaagagcgtcccaaagcttcgattctcacagcatgacatagtgccacaaacagagctatctcgtttcttgagagcccacgaatacgttttcttcaagccgtcattgtgctcatgaaagcggcgggtccgagttaatttagaccgtcgtatcaggtatgatattgaaatgctaaacctggctttatctgacaacataaatctctttagtaaagtagtctatgggctaaatggtgatatgacaataatatttgctgattgcttgacaggcttactgacatgtatagaacacgcatattctctagctcattaactggcttcctacacaaatcaaatgctggcgacaagaacaacacaaaaatctcgagccttttcttgtcttgcaccatggaggatcgttatgtcaacctggttgacaaattggtcagcattgcagtctgccgaggagttgaagatctgaatctgacaacgagtttttattacgatggtcaaagacgtagcaccactccgtatgaattccctttatccttgttcactgacggcaagggattatctctaacagaactaaaactttgcgagtgcaccctcaatattcccataggactcgatgggttcaaatctttggtcaagctatcattaactcgaatgcctatctctgaagacatgattcacacactttttgaaaattgtctgaaactggagtgctttcacctcaaccattgctggggtgctaaccatcttttcgccgggccgggtgctaaccatctcaagattgcatcacatgatttgcagctcagagacattatggtaaacagttgcgaacagatcacacacatggagcttgttgcacctaaattgcatcagttcagatacagaggtccatccatatcaatgatgcttggctcagtgccctccattgagcatgcctgtctacactacgaagatagcagggatggtgaatctgtcaagtacattttaggaaagttgtctcaagactttcccctacttacaagcttaagcatagattttgacacttacgagttgaaggtgtgaaaaaatactctcttttttcttttagttttcattagttgttggtcacatgagttacttgaacattctgatttacaatgtttctgcagaatccagtaattcctggaggccttcccacagcatttaagaacctgagaagtctcatgctgagagtgacaatgcactctaacgacgaccttgcttgggcaactatgctgttggaggtggcacctgccctcgaaagttttcagatagaagtatgatgaactctgctctagtagtttcattctgtattatgaccttttagttaatattttttccgttgataacttaggtcagttcgatataagaacatataaatttactcgcatgcactccttttgctctcattgcccaaaagaatgcttaatgtttcgcctacaaggtcacatgtaacatcagttaaactgcaaaatgaaacaagtcctaattccaagataaatgttatcataagtaaatctttataagactaaactaattcacctgaatgaatcttgtgtttgatgaggtnctgtaccattggttaatcaattttcaaaggggggcat

SEQ ID NO: 73371 - DNA, 523 bp, Oryza sativa
tgaccagcaagagatgatgataatcgatcatcgtatatatcatccgaattaaagaaatggattggaagagaaggaagttggcaacgaattgaacttcgtcccaacttgtaatatttatatatataaacgttccatttgactagcgcaactaattaaactaggcttatcaggcgacagcggcgccaaactgacaatacaaagattggattttttttaagataataatataaatattgaatagacgcccaagactaaaacgcatcatcgttcatagtcgtcatataattgccatgcatgcacgttgtcgttcgtcgaccttccttcatttttggtcaacacatgatcggcatcaacgtttatctaccaactgcaagcatgcaaattaagcaagcaaagcatcatgcatatatattgctcatataaaatagtgacgcatattatccggtgtgtgcatgcaagctagctaagctagcctaactcaacccatacaatggcatagtcatagtgttcaactatagcaggg

SEQ ID NO: 73372 - DNA, 32768 bp, Oryza sativa
  unsure (1)..(32768): unsure at all n locations
cggttttaatagttgggggggtcaagatatctagtatcgtggtttaaggatatgaatcagattcaagtactacctaatggagtcgaagtgaacttattcctgcccaaaaccaatctcaatcctcattttttcgggggttttggtagacagtggcatagtgccagcatctccaagagaagattaaaaattagttcccaaaaatcttggactaaaaccgtcccaaaaattattatgctaataaaaagttgagaatttcttatataccactgaaaattagttggttcccttgtatgccactcaaaattggctcttccctttatgccactagatcttcactatttatcatactattgaatatatgaatgtttgcagtcacatgattttgaaccaaaggttattttggtcatttatgcaagaaaaaaaaagacatgtgacttgaccctagtcagtcaacacgcagtcaacagtcgagagtgagagggtgcacaaatttaagccaatcgcatatagaggaagagccaattttaagtggcatataagataacagaccgattttcagtgatatataatttcagtgatatataaaaaataaaaatcctaatattatatgattgttggccacgtaggcatgtgggcctagttcagttgatcgatctttttttcttgccgtggatacgttgccgctacagtacctcgacgcctcgccgatcgctgctgcctctgattttcttttttgccgctatagttcatcgacgtcttgttgcacatgtggagaaacggaaggtcgagacgatccccagccatacgacctcctacctatggcgctgctacgatgcagtagtgcttgataacctggaagatttagaaaaaaaaaatacaacatcttgacagtagtgtattatgtaagggtttacagataattcataccattttatacttcacagtacaaatcatgaacaaaacaatatttctctgcattcagaatacatatcgaacatactcctttcattccacaatgtaagtcattctagcattttccacatttatatcgatgttaatgaatctagacatatatatatatatatatatatatatatatatatatatatatatatatctagattcattaacattaatgtgaatgtggaaaattctagaatgacttacattatgaaacggaggaaatagattttctagggtttccatggaaaaacaggatactggagatggacggcagagggagccaggctggcgttggacgcgaacccaaggcggcgacgtcacctggagtcgaaaggtgaggggagtcgctagcgaggagcacctctgagctctctttctctacctttctatctcgcttgctcctgaagaagacggcggcgctaacgggagtgaggagaggggacgatgaacggatgaaggccgagacggcgtcggcgcgctgcacgttccgaggatgaacgatttatcctgcgtatgcaccgaatttgggagcgcggagagcttcgaaacagtactccctctgtttctcttaatataaggaattttgacattttacttataccgtttgaccattggtcttattaaaaacaatttagaattattatttattttatttgtaacttgctttattatctaaagtactttaagcacaatttttcgtttttatatttgcacaaattttctggataagataagtagtcaaacattataagaaaataatgaatatcccttatattagagggagagaggtactatctattaagcgattggtcgcactgcacgtggtcggattctaattttcagcttttagttcggttcaggttgtcgggtcttttctctttccttttgggactgatgttttgtgggctcacggtttgtatttttgtcccgtgtggataacgcttgatggggctaggtttcctcttctttttgcctaggaataagttcaatgtgggtcccacaatttatcgtccagtttggaatttatccatgaaccgaagcacatcgtcaaacttaaaataccggattaatcgaggtcccaagcagtattaggtccggtttaaactgatgtggccagctgagtcaaacgtgggacccacgcggggcccacgtgtcagcgaaccatttttactttcttctctccccaactcttcagggcgacgtgtagcgggttggaggcgtggagaggggcgtcggccgccggcaggacgctgcgccgtgggatggcagtcggaccagagtcgcgcggctgtcttgcggcgacctggagtcgttgacggcggagcacctgtacgtgcgtagcgacgtagcaggtccgggaagcgggagctcgtcttggaggatgtggagcttgccaaggtagttgagatggagaccgtgttcgctttagtttgagcgtggatttgtgatttcttttttttttctcttcatgatttgctcgctgtagatgagcatggtgctctgatttgctcgctgcagtacgagtaggaactctgattttctgatttgatattttcatttgctcaatattgatattgaaggatttagtctaaaaaaattaaaatgtccagtgaagaaagagcatgatttatgatttacttacagattgcaatcctatccaatcttctgcacatgttatgcttgtcgacacaccgtatggcgaggtcctcgactttgttggagaggatgagagagcacaggtactcaacacgctcgcgcatgacgtggatgatggcgaggagctcgagacgcctgagctgacgaacgccgtcagcatctccagccctagatagggagctgctgtggagagcttcaacaagctacgccgtggaggaagaggaaggcggaggagctcgaggaaggaggagggaaggtcggcgatgaagaagatggtttttttcctcttctgccagccaccggttgcatcaagggagagagaggagaagggaaggaggccggcaaccacccctctccgccggcggccatttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttataaccttgccccccaacctatataaggagggcagggagcccctctaggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacaagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcttccgtcgccgcccgaccggtgtcatncgcctatacgngttggtcggtcacaccaccgctgttgggcgtccacatcttcaccgttggctcaccttcgctaccgtcgactggtgtttccgcctacacggctggcctattatgccgccgctgttgggcgtctacgacttcaccgccggcctgcctccgtcgccgccgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcaccgccggcccgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtctacatcctcaccgttggctcaccttcgctgccgtcgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgccttcgtcgccgccgactggtgtcctcgcctgcacggctggcctatcatgccgccgttgttgggcgtccacgtcttcgccgaccggctggccttcgccgctgccgactggtgtttttgcctatacggttgacggacttcgccgctgttaatgggcttcatcatctacaccactggcttggttccactggcgccgactggtgtttttgtcaccattgatggactgcttcgttcccacattggctacttctgccatcaccaaggggaatattacaaagctaagtcgtcatttattttattctttatatgatatttttccttttcctctgcctcactacaccaattggtcttccattgagtagtgagtcgggggctacagatgttatatcatattttttataatattcatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttctcgcctgcacggttggcctattatgccgccgctgttgggcgcctacgtcttcaccgaccggctcgcctttgccgccgccgactggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgccttcgtcgccgccgactggtgtccacgcctgcacggctggcctattatgccgccgctgttgggcgcctacgtcttcaccgaccggctcgcctttgccgccgccgactggtgtcctcgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgccttcgccgccgccgactggtgtttccgcctgcacggctggggcgcgtcttcaccgaccggcttgccttcgccgctaccgattggtgcttccgcctgcacggcagacttattatgctgccgttgttgggcgtctacgtcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgctctcacctctacgtctggtttatacagttaccactactgatggacatcatcgtcttccgttgccgactggttatgccgccggcgactagtgcttttatcttcacaactgcgcgtcttcgctacaagtttgctcctgttgccgccgactcgtgttcacttcatcacgccgatgcaactttgtcatcatggtggagcaacttcatctttattatcttcggcactggcaaactctattgctgctacttcgcaagttttactacttcaccaacaacgacgtctttgtgagcctcgacatctcggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaatcaaagagtcgggggctacacaaatacaaggctcaaaatttgataaattttatgtcaagctgaagaaatcaattaatcagccaatgagtcaactccaggagtcattatcttcatcttcgcttcggaacagacattctacttcaacaacttcgaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctattgccgctaatcatcattaccgtcggatgcgtttgtcgccgccgattattttcttcatcttcatgattggtggatttcgctgtcaccgttgatgcgcgtctacgtcttcatcgtcggtttgcttttgtcaccaccgactgttctttcgttgttgttgggcgcctacaccttcactgctagctgacctgactgttgccgactggtttcttcgcctccatggttatgcaacttcattacctttgattggtgtcactgtttttactatcactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgggggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatgttttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatgtttccaggtgtggtgaaaccatgtgtcttttagggattaaagcacgtctgttaaagcagtgtgcgcatggcgtatgtccaatactttggaaatttatttattcacaacatacaagcttctttatagctgttttgctatgtgaattttcaataatgtagccaactttaggttacactcatcatattttacaaagcagtcggtgtatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttataaccttgccccccaacctatataaggagggcagggagcccctctaggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacaccattgccatgtgaaggatacgagaggagagagaaaggagacagaagaattggaacggacatgtggggcccacttgctacgtcagttcaaaccggccacaatacttctagactgaaagttgacatggtattgcaagttggaacatagggtatacatggtatgtcgatttaggtatagatttcagattcagcgacaaattaatggacctagagtgaatttattcctttttcctatgaagagtgttgttttcgttttttttttggcaaaaatgagtccaatctttcattggcttggcccgtttatcgtatgggtctctcatcccacatatatgttatgttatttctctaatctttttccaatttgtttcaaatatatatcaacaaaatttatatgtctaaagtttatatacacaaagtttgtgccaaggtggagtttgttggagtttgtgtcgaatatgtgtatgttgtcggttgcagtataggacttggagttgtattagatgttaggaatagagtaagagtctgtctctatcctagtatctctcttaaatagaggggtggacctgctatgaccacatggcgatttagcatagcgagaaggagcggttgccggcggcgtccagtcatgagtcattgtaactttgatatgctgtaatatgctggatcatggaggagcgtctgtagtcagtgcaccagagatgtaggcctcggctgaactccgttagcaaatatagtacccggtatcatcatcatgttggcatcacctacgacgtttctttcgtgtttagctaccgatgtcgattttggggctgcttttataacagccgctttgcgcaaggatgggcgccgattgtttgcagcggagttgggagggacggagtcaccgtgtacccgtccccgtgttcatggaagaagggaagagcgatagtcgatggcggacggtaggcaagagcgatacggcgaccatccttctggtttgtgagctaaggattgaacgatattgggctaggcggctggcaagcatcaacctatcatagaaccataactacttaattatccttccaccttaattaaataaatgactcaaatggccaccaaaatcaacggtgggtttattcttgctatactagtacaccacgagtgtgagcgattcggcagtgacgcgcccttgctgctgcttgttgagcttgggggatgggagggcaggaggaggtgccagatcaggaggaagcgtcggctttgctgccccctccattatccaacaaggagaagaggcggcgccatgaccaccatgagctcattgcagctgcggcttctccgcttcttggtgaaaagattgggggaaattcgtcttcatggtgaagaaaagtgagtggagtgggtggcacattaaagtagtactagtagtagtacaagtactcgtgtgatttatttttaccgtgctctgcagctcccacttgagagttggtggcatagtagagtttgcactattaataaagtatgcaattcaaacatgatgtgaaaaacatgtatgttttgttttgagttgtatcttgcttccctttatggaaagataccatatatatgggagaattcctaatttcactatgtttcgaagcctaaattaactactaatctgacccttttttttgtttgcttatttaaccctgcttttcaaaaagaaatgaaatataaaaacttttcataatgatcagaatgcctcaaagcaaccctatccgcatctaattctatccattcagattaaccatatccattcatctctcgtatcccgtctctctctctctcggcaagtggcggcggcggcgccagcacgttgtaactctgatacgctgtaaaatgctggatcggggtggaacgcctgtaatcagtgccctggagatgtaggcctcgactgaactccggtatcaaatatcgtgcctcagtgatatcttcatgtttggatctcctatgacgtttcttctgcgctcagctatcgacgttgatttcggggttggttttataacagtcgcttcgcacaaggatcggcgtcggttgttgggagcgctattgggaggggcggagtcgccatgtgccagtccccgtgctcatgtgaagaaaagaagtgcgacggtcgatggcagacgatggccaggagcgatacgacgaccatccttctgcttcgtcagctaagggttgaacgctatttggctaggcggctggcaagcatcagcctatcatacaaatataattacttaattgtccttccaccttaataccgaaatcaatggtgggatttattcttactacgctagtacatccaccggtgggaggtacaacaaaaacaccgttccattggctatatagtacgttcaaaaagaaaaccagattatttcttcatgcgattgttgcaatcctaggtgacggtgtattatatgtgattgctagttaaactgcattttccttgtgatctgaaggaggaagaaaaggtggctgccatcaccatcgcagggtgtagagaaataacttgatgcacgttggaaaagctcatggattccagctccagtgacaaaaacaaggagacattatgcctccccaccaccaccgtcgggggtgatgcttcctccaggctcaggtgtagcatgcggtgataccaccatcgtgttgatcaggtccaccaggtgctgctccgcgatccaacaatcgacgcacaccatcgtcgttagtagggcagtgctgttgtaggcgtgcattgtcatacctctcttgagcttctggactttgtccgcaagagcgtctcttctattgaagttgctggcaagggtggcaaaaagatcgcaggtatccggcagagtgctgcgatgcgtgttggtgtggctggccatggcccttagaatcctgagctcgccggccctagaccacaagcgctcgaatgctgtcacccgctttctcttgttgttgcgcttctgagatggggttgaggttggcttcttcttaggctcaccgtcgccaagctggaattgctccttcaccttgggcgccttgggcgtggccttttggggtgaaggacgattattgcagggtgcgagctatggctacgattgcgagggtttggcttgggattcggcttcggccggctatccctcctgaggcttcggcttcaacggtgaggtgcccctgctgcttcttgttgagcatgagggacaggagggaggaggaggtgccggatccagatgaagcgtcagcattgctgcctcctccgttgcccaaggaggagaagatgctgtgccaagaccaccatgagctcatcaccgctgcggcatctcagcttcttggggaaaagattgggggaaattcgtctttagggtgaagaaaagtgagtggagtgggtggcacagtgaagtagcagtagtacttgtgtgatttttttcaccgtgctctacagctcccacatgagagttggtggcacagtagagtttgcactatcaataaagtatgcaattcaaacatgatttgaaaacatgcatgttctatatcttgccgtcctttgtgaaaagataccatctatatgggagaatttcttatttgactctgttacgatgcctaacctaactactaatctgaccctacctttttagtttgcttatttgaccctgcttttaaaaaagaaataaaatataataacttttccaaatgatcagaataccctcgaagaaaccctatccacatctaatcctatcctttcagattaaccctatccattcatctctcatatcccgtctatctctctctccctctctctcggctagtggcagcggcacggctcattgtaactttctgatacactgtaatatgctggatggtggaagagcacctgtaatcagtaccccagagatgtaggcctcggctgaactccgttatcaaatatcgtgccttggtgacgtcatcgtgtttggatctcctatgatgtttcttccgcgtttaactaccgatgttgattgcagggctggttttataacagtcgctctgcgcaaggatgggtgctagttgttggcagcacagttgggaggggcggagccgccgtgtgcccatccccgtgttcatgcgaagaagggaagtgcaacgatcgatggcggacgctggctaggtgcgatacagtggccatgcttctgcttcatgagctaagtattgatctattttgggctaggcagctggcaagcatcagcgtatcatagaagtataattacttaattatccttccaccttaataccaaaatcaacggtgggatttattcttactacactagtacacccactagtgggaggtatagtaaaaacacccttccaatggctatatagtacattcaaaaagaaaactagattatttcttcatgcgattgttgcaatgctgggagacagtggattatataagattgctagctaaactgcattttcctcgtgttctgaaggaggaagaaaaggtggctgccatcgccatggcagggtgtagagaaataacttgattcacgttgcagaagctccaccgccacccccggtggcgacgctgcctccaggctcatgtgcaaccacttttgtgccgatcaggtgcacctagtgctgctccatgatctaacaatcgatgcatatcattgtcgtcagtcgagctgcattgctgcaggcgtgcagtgtcatatcatctcttgaacttgtggactttgtcagtgagcttggcctggtcggcatctcttttgtcgaggctgttggcaaaggcggcaaagagatcgctggtatccggcagagcgccgcgatgggtgttggcatggttggccatgtcctctagaatcctgatcccgttagccctggaccatgaccgctcgaatctcgccacccgctttctcttgttattgtgcttctaagacggggtcggggctagcttttctttggctcgacgtcgccgaggtgcagctgcgccttcgccttggacgccttgggcatggcctttcggggtgaaggacgattcttgcggggcgcgggctgtggctgcgattgcgagggtttggcttgggcttcggccggcccttcctcccaaggcttcatcgtgcaattgcttcgccagcgaggcgcccctgctgctgcttgttgaggataagggaccgggggtgggggggaggaggtgccggatccggaggaagcatcggcattgctgccccctccattgcccaatgaggagaagaggctgcgccaagaccaccatgaggtcatcgctgctgcggcttcttcgtttcttggggaaaagattgggggaaaattcgtcttcagggtgaagaaaagtgagtggagtgggtagcacagtgaagtagtactagtactggtactagtactggtacaagtacttgtgtgatttttttttaccgtgctctgcaactcccacgtgagagttggtggcacagtagagtttgcactgttaataaagtatgcaattcaaacatgatctgaaaagcatgcatgcgttgtgttgagttgtatcttgtcgccttatatggaaagataccacatatatgagacaattccttatttgactctgtttcgaagcctaactactaatttaccctactttttttaccttacttttcaaaaaaagaaatataataacttttcataacgattagaataccctcgaagcaaccctatcctcatctaatcctatccattcatattaaccctatccattcatctcttgcatcctgcctctctctctcttgcggtggcactagctcgtggagggagggagcagcggcggctcatggtgggaaggagcggcagggggcaaagggagggatctgcctggccagctcccacagcgtcaccttcaggagccgtgccagagctagacacagagcatgaggcatctgtcgtctatggcgaatagcccgatcacgccggccatctctatggctttgaagctccgttctttgttgtacacctttgacgcccgcagatacttacctcggtagctcaacgagggatcacgagggatcgttccatcatcttcgtgtcgagcgccactaggctgcaggtagtgcgaggacagggtgtagaactacgtcaccagcatgtacctggtggcgttggtgtcgcggctgcaccacctgcgcaggtggtgtagccttccgtacgactatgatgtactcaccgcccgtacgtcgagcaggtagctgaccatatagttctggaacacctcgtacacccgagcgtcatgtagtagacgagaacagcagcatgtacgttgtatgggcgtggcacccgcggcctgtgtccatatgtcatatacagcagttcgattcagtgagtaacataatatttttctatagcagttaagaaatgtttgacaatatatacaagatgaaaataatctaaaataccttgtatggatatatattccattatatatatatatgagaaaaggccgcaatgatattccattatctaaaaaattagatatagctatacatatatattaatgaatggtgttatatattttttctatttattgtttctgtcagttgtactgattcagtttaatcaaatactttaatcgtcgtgcaggtcttcccatatataattcatctaaaacacaattcatatccgcgaaattcaatgatctgtaagaatgaaaatgtattcctatggagttaaatattccaagctgcagtacagttttatgaaatcttacccctgctaggaacacgtgcatcaactgatcactgtacagaaacaacgtatgggaatcagtatcaaatttggaacgggaaaattatgcagaatacaatgttcgaaacactgttgtagcatggcaccttctgtagaatgcctggaactttatggaatcataacctttccagtatctagaaaatattgaacttcaggctttgagcgaaatttatgattgtaatccttgtggcggtaatactgctatgtgagaaaaaaattaatttcatgtaacatatgaacaacaaaataaatttagtatatgtataatttagaaataaccaacatgcattttctttcttttttctttggttggaaggggatatgggagggaaaaactcaatatatcccaatactgcatcacgtgtatgaccctagttagccacccaaaggtgcaaggattcacagtatacaggctttgatccaaattaatttttgatatgttctcgcaattcattgttagaactgataagttagattaatgaattagcaagaagatatattatttatatgcaacatactgtgttctaatagtgattatatttgaaaaataaaagtcaaatatattttctgaatgccatttgtactaaaggtagctatcataaaatagtttggttttgtacatattactttgactgcacacaaattatcatgttatataaacaagaatatgtttttaaaaaggaatgtaactttacaaaccactccaatcctgccatatgtcattactagataaagaactatgcattccaatggttccatgttacatattggccagatgtgacatatcccaccagatatattctaagaatgcaaattgttttattaccattatttaattgtagcatgagaagtatttttgctagacgatatgagacttaatattcagatttaatgaatgactaaatgtgggtagtactcccaaccaacagtactgtttaaacactaaatctgtttgttggatttcaattgttccatgtgtcaggttttatactgtagttatacaaagtataaattttaaaagagtaacacatgtttgggtttacacaaagaaataaatgatagatatatagctcatttttcgatcatgcatcattcttttagggttaacatataacacatctttatgtcaaaaacatttgtgcatttaacattttcagccaatctccaagattactatttcatgtgtacaatcaccggtactttcagaaacgttgaacctgctaagattaaaaatccctacatattattgttatattgatgacagggctggttatctttccccaaaactatctaccctaacgaagtaaaacaaaacatttaaaaaaaaaacttcgtttgtgatacactcataaatttgagaaagaacacatttaactcttttaattaatcatgaaaatttatgaaacaaatataactgatcaacatataatattaattcactaaccttatctttggtcttctgatcatttcgaagatgattctcgatgtcccatccagttggatcaacctcatcttttcttggatgaaccttccatgattcaggaatatccttattgtttttcacttgtgtttttctttttcacttgtgtttttcctgaggaccacagaaacaacccagagtctgcatcttgtcgttgaccactctagacaagattgtcaccgcttagaatcctctgaaagtatataaccatggtgagaatcttgaacagtacgacaatacaaggtctcgtgaacgatttaaactaattcgatcatgtgataggaaacacacaaacacacacacacacacacatatggctcaaaaatcactgtgctgctcaccggattgcatacatttttctagaaactataagaattgtatctttattcaaatttgcatctataataaagaataccaatttcagaaaagatgttggaatatatgttgtattgcaggactgtttaacagaaataacaagggaagtaaaaaatcccatggagcgcaatcatattgtgttagttatagagaaaaagtgaagtcgaaattaatatattacagttgttgtttttccaggtgattgtgttccagtacttcaaaatctgttgaaatttgttatatatgttacagcactatttatcgtaatcaggaacataaacctacgcaaaacaatcagattgagctggatttaaaagttaactgagatgaagcaccgtttgtgatattctcatcaaaactaatggattgcgatatctgatatttttgatgaaccataaaaagatcatggagacaaaaaaaatcaggatatgatagaaattcatgaacctcaggttgaaacactacatttttctacctttttcctgggtgcaactcagagtccacataggagagaaatggagagaattactaaaactatttgcgatcatcccaaagctagcagccttcagttctctcgctatcggtttctgaatctgcctcgtggttattagccttacgagaatccacctcctgatcaccataaccaccaggatgcacacaaatattctgaaatcagcggtaactgttctctcgctgtcactaatgctgttgcttccatcagagtcatcacccgaataccatggattagctcctgttattgccacacccttgcctttgccatcaccagaagatggaagaccagatggtccatgggtaccccttctgatggtgccctgggtctagaagtaggaaacctgcaagaagagaaggagagacaaaagagaggatttggagatgaaaagaggattggagtaggggtagatccgggagaaacgaggtagatgttcatatctgtgctggaaacaggttgctccagaaaggctgtaaactttaattaggagatattcatattagctgtaaacttcccttctaactagaaaaaagttaaatgccaaacaaaaatgttgccagcacaagaaaacacatttcttactgttgctgccaaaaatgtgttttgggacgcgttcacacacaatatactctgcttaaaatagcttttttttattgccgtgcaatatgggatggtgtttacacaatactacatatatagcacttaatttaattatacacaatccgtctaacaaaaaccacttctgattagataaaatttggcattttaaggacagagggatcggagtatgtattttgttaaaccagtgtcgagggtatcatcaaccgccaatggttctccaaaacccctacgtaccccgcaatagtggagtttaaacttgtccttggaaattatgtattgtgctgagtgcacagctaatgcaattaggagatagcaaactcataccaaagtacggttacatagttgcatgtgaggctcctagctaatttgggattaatcctattgaggcacatatatggatttgagtatcagaggagagatggagatatttctgcatgcgttagcttgaagggcaccaaataaacttttatgagatatgctttgactaatttcaaatcatctccaaaattataaatctgtgccacacacaccgcttccattcaagcgtacatgcaacgatttttttctatacagagggcatcaggctaaaaaagacaaatgtcgaggacaatcccaaaataattaaacaaacaatagaataatatatcaataagtggattcacattttgcttcaaaaggactgaaggttaaaggtagtgctggttattgtgcacgtgcaatacacatcacagtcagatgcgtgccgtgggagtaggagggagcttatcagtagataatagaggaatatagtccctccgttccaaaataaatcaacttatagaattcaaactttgtcctaaaataaatcaacttctatcttcttattcactgttgattcgcaaatcaaaaaaatttattccttcaataccccttgcctacatatctaccaatactagctattaatatatgcaggtagttttcagggcaacacattgactccggtcttgggcacaactacaaaagtatgaggaagatagtgagcttttaaaggctgcatgccgtattcttgagacaacagttatgcaactttttgtcaaacataattcaataattgtgtactctttatcttgggttggcagtctttagcttgtttcttcttgatggttggtttcatcctttaagtttctttgaacttcactcattttgagtgtgagattgtaataattggctgtagctctttgagtaaaggccgggatgctctattccattatctaaaaaaaagctattaataattgtattttggtcctttatcctcttcattaatttcgcattgggaagctaggagttatctctttatggcacagagggagtatgcactattagataaaagtacaaatgtgtgccggtgcccataattgccaattacattgtctccgccacaaaagtgaagcagcaatgatagttagtacattcatatataccaccggtatatataacggtttatctatggcgtcggttctaaatttttcacccagcggttttatgtgagcacttttgtagagacattttgcaaattacttttaagatcagaagttttatagtgtagagatattttatagaggcattttaaaaattgcctacaaacttttactctagagacgttttctgctctacttattagattttatcttgtagaggcattctttcggcactgtaaaatagcctgatatgtaaaggcattttcttgagacactttaaactatgtacagacacttgttacaatgataatgtgtactaaaggactatatataattaactaaaggcacaaacatacaagtaatgacatggagttgagttagttagtgcattgaagataaaaatgatttgtccaagtgatctcaagtttaagacttgttaaaagcaaagaaactattttattctcctttttggactggtttcatatatttgtgatataatttaatgtctctagaaaatgcctctaccatattatagatattttataaaatgtctcttcatttgaattcaccataagacacttattagacatttttaaaaatgtctctatagtattgtaaaggcatttgaaaagtgcctctacagcactagaaaaatgtctctacaaagcatttgtttttagtggtaggaagatttatggcaccaacagttgtaaactggcaatgtaccactgactgcagaagagagaggtttagtgtggaccaagtccagcgaggtggtacacggtaatcgatggtctacatcgatagaaactgatcggccgggcgagatggcataccatctcgcacgccactggccacacgggacgccatagaggacaggaatgtgtaggtggcgcttacatcacaatgcaatggcagccatgtcaacagataacctggtcatttatgtggcgacacacagcgtggtggcggacaacaagaatgggacaagtggaatgagtactactccgtcccagaaaaaagcaaatcctagctacgaacctatgtctaggttcgtagctagaattggattctttttgggacggagggggtagatatgaggacctcacctatctcaacaatgatggccggtgaagacagaaggcacgttcgtgagaatgaagaagtgctgaaaatggatagcatttactgtggtgagcagcaaacaggttcttctagaaaagctgtaaactttaagtaaagagtaaattgcatatttgcatcggtgatacacaatcttgtaaggtgaatgcaatttagtatataaaattgtaaaatattcgtttcagtacacgaacttgtctagtttatgcgaatgagaccaaaacagtttggcaatgttaattttatgaagttgttaacatcgaaatttcgtaagcccctaagagaatcaccacgtcgccaatagttggattcctgctatattcggttaaggaaagtaatctgttaaaggaagcttatccagaaatgactgatttcaaagaggatgcggcatggcagtttatctattaattaggtagtatatgttagtttccttttaaatttaggaaagtgtgtttagtgtcctataagtactttatgttttctttttatcttttggaaagtttctttcttgtcctataaggactagtatctccccatgggtataaatatgcacacccgatgtcaatgtaaactatctccacgatcaatacaattcagcgcatcaccaccttttaccttttctactttatttcatcgtccggcgggacttggcacttgacgcggggctgcatcactttccaatctccggcgaaggggtaagtccaatatgttccgccggcccagacaattgtatcgtctacatcggcgtcattcaaggctgcatcagtacattcgacctcttggattgctctggtttggttgatatatttgcctggctatttatcatatttcttagttaatctagtcttactatttcaatttagctctattggttgtctctcgctttagggtttctgccggtatcggctaaattattttactagattagattagctaagacttctaccaccataaaaatcagtcaacggcttgattatctagacattgtgtttttttcatacttagtgctgcatcagttaagtttgatctactaagtcatgtttacaaccataatccctagcctactttttgatggccaataagggtttcatcggggtttcagccgatgaggtatctggatattgcatcggcttacaaggattacatataagttggatttagccaatcgcaagaaaggtttcactgtttatgtaatattgtggattttatgatatcggacctccagccgatatatgctttaaactttggatcatgtcattgttagccgattgatttctactggattatattgttgttgctttcctgcattatcgtcagccgattgcctttagattgttatttacatcaagcatcagaatctacatcagatatatagccgatagttcaaaacactatcgctattggtcggcatcgactagaattaatccatcggcttgtcagccgattggctcattgatatgctatttgtatatcttgtcagttgcagggtcaaactgactggcacgcccgcatctcatcaacctttgaacctgcactggagctaagcagatctcctataccagtgtgtgttttttcgcatcaacagaagttgatgttgattagcgatgtgacgtgcatacgtgtagtgagtatgcataatacatgcaatatttataaatttggtctctactttatcctttatcatggaaatgatgaatttcctatatttttaactctgatatcactgctcgtttttttatatttttctagatcactatatcatattctattttttattgatgaggtgtacctctcagatatatgtttacatagtatcctaatctacccaaacaagttcatgtaccacaacgccatatagtgtcctttttgcctttctccgcacgcaccaaacaagttcatgtaccacaacaagcattatataagttcgtgcactagattgtacccacctagttcgtgtaccagtgatgcaatttactctaaactttaattgggagatatgcatacactactggagaagtaatctttagtcccgggttacaaaccgggacgccgaatccatagtcttagtcccggttaccaaccgggagtaaagttttttttcttttttttccattgtgttttggtacttgcatcaccaatgccgtcaccccaaatccaaacaaatcatccacaattcacaggcccatccacaaaatcatccacaatccacaaatcattcacaaatcgcatgcccatccaaaaaatatctacaatctataaatcatccacaaatctaaaaaaaatctacaacaaattctaaaaacaaatcaggagggcccgcacagccgccgctgcttctggcctgttgccgccgcttccactgggcacccgcctagcactgctcgcctcgttgtgtgcctgccgccacctgccgcatcccctcccactggatccggcggaggggagggcaccgctgcccgccgcggagatgggagaggtagaggggaaggggaggagggaattggaggagagaggggaggggaaggaggggtggaggaggaggagaagaagaagttggcgtgaagaggggaggaggaggaggggataaggcgtgcgagcggctaccaatgccgagataaggaagatagagagagancgatgtgggagaaagatatttatacctggttggtataccaatcgggattaaagatacaatctttagtcccggctagtattattaaccaggattaaaattgatctttgccaaaatttgctataggacactcaaaaaatatgtaattagctataggacaccataaagacgtgaatttatctgaagatactccaaaagtgtggtaatttgctgtaggacaccagacgcattaaaatataatatccaccctaatgatggaagagaaaccacacaaaatgacaattttgcccttattatcttcttctcccttctcccagctttctttcgatgctcactcctagcaaggtccatcggtttgcccatggcggacagcaggctagcgtcgagccgccacgcggctagccgatcacgccgccgatgatgatggtgccacccgtgccagttgtgcaaggcgttgtcgtgctgtccatctagccggggcccgttggcttgcatcgttgtgccatctatctggccggcgctcgctgacttcctgtcatgctacagctacaacccggcaacccggtgtacaagtagtcctcatactacggcaacggttgcggctactgctacggcggcggcggcgcgtgccgctgcggctcgtgcgcgggtggcaacaagccgatggccggtgggtactacggagtggcctcggtgatggcgtcgtacgaccaccagggatggtactacggcaattggcagccgggctaccaacagaagcaatgctacgaggtccccaacgccggatgcagcatgtgatgtgtggcggcaggcgcgatcgccatagatgggagcaatccgtgcgtgtggtcattctcgctcatactcactcatcactagctcatggccagtgttaaaaaaatctttctttttttttgccaatgccccttttttgtttatttagggtttttagttgtgtatgtggacagttgagttgtgatcttaagccgagtggctgtccgccatgggtaagccggtggagctcactccaagtgagccagaagaagacttggaggaggaacgagaaggggaaaactgtcattttatatggtttctcactcatcaactaggtggatattatattttaatacgcgcagtgttctgcagcaaattaccacatttttgaagtgtcctcgagcaaattcacatctttgtggtgtctcagctaaatacatattttgagtgttgtatatcaaattttgccttgatcggcagtcccttggtgttatcagccaggactaaagatcaaaaagtaccgttgggcttttgaacctggattaaagatattctttagtgccggttcatattcaaattgggactaatgtgagttttgccatgcggacaaagatcaattcttcagcggtgatatttgctgtaaacttccgttatattaggaaagagccaaatctcaaatgtataaagttgtaacctctttatacttgatgttgtatccagcagaagaaaacagttttctttattgctgctaccaaaaatatattataatacgagttcacacaatatatacagcctaaaacaagtttctttattgccgctaccaaaaatgcaatatgtcccatatatgtacagatacatagataaattgctaccaaaaatgcaatatgtcccatatatgtacagatacatagataaattttggttttttaagaatggatggagtacatattttgttaaaccggcaagcacatcatcaaccgccaacagtttctgcaaaaccactatccgctacagtacagtttaaacttgtcagtggaaattatatattgtgctgagtgcacacaaaaatgcaattaggagatagcaaactcatactaacgattacctagttgcatgtgtcccctagcattttttttgggattaatcctattaagtcccatataaggatttgggtatgagaggtgatggagatatttttctatgcattagcttgcttatagcttgaagggcaccaaacaaacttttctgtgatatgctttgactaatttcaaattatccccaaaattataaatatgagtactctagcactacagacgcttcgatccattcaagtataaatgcaaagattttttttatatagaggacgtcaagctcaaaaaaaaaaaggaaaatcccaaaacgagtaaacaaaacaatagaataatttctcaacatgcaacgagtggattaacattttcattcaaaagttactggaagttaatactactactagttactgtgtatatgcagtagtacacatgttagtagaggagttgtgtgtctagagagtaggagggagcacaggagtaggtaacagaggaatatatgcacaaatctgtgccggtatcatcatcacaagctaagtggatatttgagtgaaataaggataacatattttttgcagaattaaaaacagggaaaaaataacagaaatgagaaaaaatcacgaagaagccaaagaagaacaacatcatcagaaaaaggtgtggtacgttgggtggtgcagtctccagtctccagattcccgctccttgagttgatgctcgccttaggcattattcattttgtaagggatcggatagaattagaggggataggtaacactactatagatataaaataaatccccaccaatccctccgtcatatattaaccactagaccttgtcagtagtgtcttgcctgactacaacacctgtcaatgcatagctggcttgcatattgtcgctaggtagccatctcgccgcttttactcgccatgaactgccagtcacctcatgccatgggactgttggagcttcctatagttcctctattcttctaattaacctttatttaatgtaaattaaaacaaactatagcaattataactgttaagttcaacagcaagttaaaaagaaaaataagaacatatggcatcaacaaaaaaattatatatgcctaaactgtgttaattaatctctgggtaaacaattaaaccaagagtcgcttcttttatcaaaatagattgttgaataagcataatgtagtggcaagcaggtagcaccttcaacggccatatctgttgtgtccacgagataattgcaatgctgggagacggtggattagatgagatcgctagctagttaagctgcattttcctcgtgatctggaggaggaagaaaaggttggcgccatcgccatggcagggtgtagagaaataactttatgcacgttggacaaactcatgtattccagctccagtgacccgaacttaaggagacgttttgcctccctccccaccacaccaccgccgggagcatggtgcagcgtgctgcaaccaccttcgtgccactcaggtgcacctggtgcgcagctcggtgatttgccttgccattattgccaatgttgggatacgcgtaggctacgatagtataaatcaaaattttctattgcataaactaggaaccatgcaagtattagatcatagatcgttaccactcgacgcgctgcgtagcggaagaagacgctgagaagtcgaaggaactctcgcgaagtagcgcactcgatgtagaggaagtagtcgatcgcaccggctcgaccttctcctcctcgtgcattctcctcgccgtaatcccacgccgatcagcaccgcaaaccagcggcgcctctaccggtatccacacgtacagggacggaacgccacgcgcaggtgcgctagcacccgcacgcggctagggttttgctcggggagggaagtgacggctagggtttctcacgtgatgcaatgcctccgccgatcacacccctcatgaacttataggatccatcactcaggcctccaaagcctgtaggactcctattcggatccctatccgaattaagctcatattcgatctccatccaatccccttattccggcccattaaacgtgcaaccctgtaggttcatatatactcggctgtaacacgaactccttttcggtccatgcgtcaacagtggcccctagcagaacgtattgacccaccgggcatacataaagatcatatcggctgaacctctagtgtatacttgtatgaacccatttgcctcacgatatcgattaagctcaaggctagatatgtgctatcctctaatagctcaatcattcactcgaacctattgatagattatataacttgtgattgactcctcaatcacctttggcatggacatgcacttccataatctacaacaacgaggggcccagagatatctctccatatgaggggcaaatcctatcttgattattcatatcccactacatgttttatagcatacctgaaaactacttttataactacccaattacggagtagcgtttagcagtccctaagtaagctactacacatgttgggaaccatgataatctcaggtctaaggattcaacaccaacactaaatgagatcactgatgacacaacacatatagctcttgcagtgtctcatgttgggtctatccaacaacatgttcactaacatgtgtccacattattaatttggtatctctataccatgatccatgagacatgatcatcaattaatacatgtgctgatcatctaagcatatttattccacatatgatatttgatcaaggatcctttagaaatagcaacacacaacataaagagtctgatgaaagaatcacatattcattaaccaataatgagtttatctattttaaggaacaaagtcggataaatatgtaaacatagtgtgtgtgatacaatcatccctatgattgcctctagggcatatcactaacagtctcccacctgcactagagtcaatcatgaacgtatcttatacccattgccctactatgtgcctcatgcttaggctgagggagtggctttgtcaacggatctgcaacattcaaatccatatgtattttgcatatcttcacatctcctctacacactatctcgtaaatgaggtgataccgccgtaaaatgtgtttggacttttgatgcgatctaggccccttggcttgtgcaatggcaccactattatcgcaatagagatccatagggctagaagcactagtcatcacacctagttgagaaacaaatttctttatccaaacagcctcctttgctacttcagaagcggcaatgtattcagcttctgttgtagaatcagccactgtatcttgcttggaactcttccaactcacagcgcctccattcaggcagaacacaaatccagtctgcgatctaaaatcatctttatcggtttggaagcttgcgtcagtgtaaccatttacaacgagctcttcctgtcctccatagactacgaacatatccttagttcttctcaagtacttcaggatattctttacagctatccagtgactctcacctggatctgattggtatcggcttgttgcactaagtgcatatgaaacatctggacgtgtatatagcatagcatacataatggatccgattgccgaggcatatggaatcacactcatcttgttttgctcatcagtcgtttgaggacgctgattcttgccaagattaatgccatgtgacatcggtaagaaaccattcttagaatcttgcatgttgaacctcttcaacaccttgtcaatgtatgtactctggcttaatccaattagcctgtttgatctatctctatagatccttatgcctagaatatatgctgcttcccctaactccatcattgaaaaaccatttttcaacgatgtcttgacggattcaagcataggaatatcattcccaatcaataatatgtcatctacatataggattagaaacaccagtgcgctcccactaatcttcttgtatacacaagactcttcttcgtttttgacaaagcccaacgccttgactacttcgtcaaaacgaatatttcaactccgagatgcttgcttcaacccataaatggatttctgcaatttgcatatccttttagctgattgtggatcaacaaatcccttgggttgtgtcatgtacacatcctcatcgagatttccattgaggaacgctgttttgacatccatttgccatatctcacaatcgaaataggcagcaattgctaaaacaattcgaatagattttagcatggcgattggcgagaaagtttcatcataatcaacaccttgaatttgtctaaaacctttcgccaccaatcgtgccttgtagatgtgaacatttccatctacatctgtctttttcttaaagacctatttgcactcaatggcttttacaccatcaggtggatcaaccaagttctaaacttgattgacatgcatggattctatttcggatttcatggctccaagccatttctcagagtctggtaccaccattgcttcctcataggtagtaggttcatcgttgtctaacaacaatatatcatgttgtctaacaacaatatctcatcagagtttagctttctcttttgaccactcttcttgtagttgggcttgcgcttatgcataaccatcacatggttggagtttttcttaatgctttcctcggcagtctttagcatcccatgcaattctgccaaggtcctgttcaggttgttcatgttgaaattcattgtgaacagctcaaagctgggagggagcgactggagaatcaaatcagtagccaactctcggctaaggggaaaaccaagcttatccagactctcggtgtaaccaatcagtttgatcacatgtgggctcactggattaccttctgcaagcctgcacgcaaaaaaggactttaaggtattaaacctctcagctcttgcttggtcctcaagcatgttacatagtcccgtaattatcgtatgaacatccaatgcctcatattgcctttgaagctcaagggacatagtagcaagcatgagacagcttatatcaagataatcattgcatcgcttttcatgctccctatgttgagcagcaggagcattgttgggcaagtcagctcgaaaaggctgtgtaagcacaaactctttgtgctcttgcctgagaacaattctcaggttgcgataccaatctatgaagtttgttccagtcaacttctctttctcaagaatagaccgcaagttaaaactggatggtgcaggagctgccatgatctacaatagaaatatatgtatgcaaaatccgcaccatgtttacatttaacctttcattaaacaatttaacaaaagatactcccactatgtattgtgaaacaaaattccctctagtaacatagtgagtcaagatcctcattttgttagtgtctagtgagctttggcatcacagctagacaactatcaaaataggtaagcaacaccttgctaatcacattatatgtgactcttgtgctattggggtgacatctccatgtccaacccaacctatgccccaaggtccaaaactgttttgataaccttgtcaagtaaaccaataatctctgcatatagatgtgcaacatctatcctattttatcatgataaaaagtgacagtttgctatggcaaacccatcacttattatcacaaccgtaatagatgcaattattggaagagcataaattacacttaatttttctgagggaatctatcctaccatgtcatataaaatatataacaacaataaagtaagacagatataaaaccccaagcgaaatctaaggggcaatgcacacagcggtcccgctagccggttagcgggcagagggtcgagggggggagcatagatctgatctacgattctccatgtgaaaaccttaacggcgtaatcaaattatgtcgaaaccgagtcaatctcattggctcgtttttctcattggcgtgcggttccagtggacatcggactatccgatgaacacaatcgcgctcggccttggtgagtactagacattccagtgaagtcaccaacacacgtaccgattgatctcatcaacccatgcggctatcggtttatctcatgttcggatcacctaagaactcatatacaacataatagatctcatctactacacccgcatatcaattatatgcaatgatctagatcataaactatacaaggcggctctgataccactgttgggatacgcgtaggctacgatagtataaatcaaaattttatatcgcataaaccagtaaccatgcaagtattagatcatatatcgttaccactcgacgcgctgcgcagcggaagaagacgctaagaagtcgaaggaactcttgcgaagtagcgcgcatcgatgtagaggaagtagtcgatcgcaccggctcgaccttctcctcctcgtgtgt

SEQ ID NO: 73373 - DNA, 8244 bp, Oryza sativa
tgcgggagaagtcgacggagaaggagcgccaccgccggccgatgccgagctcggcgtcgatctcgacggcgcgcgcgcgggcggcgcgcgcggcctcggccaggcgcctcgatatcgagaacctcccgtccaggcgctgcgcggtctggcgcacctcgaacgcgagccgctcggcgccggcgttggcgccccgccacgcccgccgcacgaagccgtcgaagtcagcgccgccgccgaacgcgcgcggggagaccgtggcggcccggctccgcctcccgtacgccggtcgaagggacacgcgcccagctgccgccggcggcggcggtggacgccaccgcgcgaacgtttccattccgggagaggcgagagagcgtcgtggcgtcggagatttttcgtgcggatgtggtggtcttccttcgtccgtgggccgtcttggtcgctttgtttacttgggctttttattctactgggcctaatattaattagctcgggcctaatgatcctttccggattcggaaatccgctctaatcattcatacgtgccgttgaaatgccatagaaaaaatcacacgggagatggatagcaaaatcgtcttttcaatggatgttttgtgttaattactctctccacgtacttgtttataacatttctgagttatttaagcagaagatgttgttgatgataatagattttttttttggcggatggatggaatagccaaagaggatatcataacgggggatttattgtattgttccttccatgcaaaacatgtatttttcttgtttacaaaccacaattcagtagatgcgtttccaacaaaagatagcaaattcaactgataaactatatagccattttcctgcagctgtttagttctatcaaaccatgtaaacatacattacagttattttcggcaatatgcatactgggagttttttacaggagtttttacagcaagtcacatgcacagatgatggtcaattgacaaactcaaaagtcctaagacgtgtgctgaccccggccccatctagaaatcagctttattttgttaggatagacagatgtataattattccagtattcatgttccatctgcaaaaaatgctccatctagtactccagaattccattgctccatctgcaaaaatcagacttgctcgacggcggcaaccgtaggttctatctcttcaagtatggacagtagctttgggtcctggaaatcttttatcagcaagcttgctcctgcatcttgcagaactttctctggattcctagttgtcagaccaactacaggaacatttgcagctacaccggctcgaatccctgacgcggagtccttgacaaggatgaacaccatgttagtactattttaacatgaatatagttagttctcaaaacaaaacaaaaaaaaagtacatgaatgtagttgatgataaaactgaagataactattttgtgaacaaaagtacaaaactaatgtgtacctcaaaaatgaatgtgtgatcaggtgatgcaccaataagctcaagagccttgaggtaaggatcagggaatggcttggctcggtcacactcgctcccgattacgagcaccgggaagaattcagtgagcccaaggagtgacagcatgagctctgcatttgaccttggagcatttgttacggcggcgcgtttcagcttgtgatcttttatccatctgcacagatcatgcaggccttctactgccaccaactgttctggagccaacctgcatagttttcggcttaaggttatcaggatgaaccaacctgcctgctagttctgaaaccgaatgactatgttatgttaggaaaattcagagttgtcagtgcgttggcattagcattgtgtttaggtttacagctgaatttctgcagaaaaactaaaatctgcaattagttcatctaccatatcatgctatagtatggaagaagataagaatttatataccttctgtacaatgcttccttgtcgtccatgaacttcattgccttgtcatgatccaaatccgggaacaaggcccttgcgaggtcatcgttgtgccccccgctgatattggcgctgtagaactcctcggagatgggcacgccattgttgaaaccaacctgtagtcattacacacatagaaacgcgaaggttcagaattgcagagtatgcagagaagcagagcataatcgcaagccatgagaaagaaggaaagacggagcaagcagaacctgctgcagcagttcgcggaaggcgcagaaatggataggatcagagtcgcagagggtgccatcgatgtcaaacaagatcgcctccagtggagcaagctttgacagcgcactgctgcttaattcagacagagagacacatagaggatcagttatcaatttatcatcagtatcacagtatgtttcggcgtttctggtttgttagaacagcatgaactctgaacatatgcaaactgaagaacgattgatcaattgaacagcacgagcagctgaaccagcaatataatcaatcgatcatctccctcccaactcccaagaaaattacagtaggatgctctcctatttcggagtataaaaaagaacaaaaaggaacagcgaaaatggagaatccatgatccatcttgtcagaactcagtaagaattcacctggtggcggctgccatgttcaccgggacagctgctctcctcctccaacaagtgctcgtcgtcttaatccttcctctcctcccttgtgaagctactgctgttgctgctgctgcaacgtggagaggaagagacggtgcaaatgcagacatataaaggagacgagattgagcgaatcgatgcaaagcagaggaggagaggcgattcccgaattggattcgacctgtgcagagctaattgtttaaagatgagtggcgaggctgtagctgcctgcaagcagtccctgcaacgtacgccggaggcagagcgcgaatggaggatgcatacgtggcgtgtgcgcttacgtacgtgtgggcgtgtggctgagagagagcaggcgaggcgtggcaacggatagtcaaaagggtgactggtgtgtttgttgctgtagcctgtaggaggctatgggcctaatttttcgcttatgtttatacttatcaattaaaatttaatttttaactataaatttgaagttaattttgtgatttttatcgaagtttatttttagcatttgtttttagataaccgagaatatgcatataaaaattttattcacaaattatgttttatttgtaaatatgatgtttaacttattccccgaaggggaataagcgatacgacgaaaaaatacgcttctttgactgggatagatataccaacggtcaaatgaccatccttccaagaaacttcatgacttcacgcaaaaagttgatcgcttgcatgtgaagtccatgtgagtctcacttattatattaatttaaaaccggccattatgctgataagagatcaaaattgatatggataggttatatctgatatttaggttcagggttctgatttagcgataaaatgaaggacctcaagtgaacttattatggcacgtaattccatcccgtcattaggccgcatgaagtcgaaatattagttcagcccaatcaacttttacgataaaagttgacaaggaagggcgagtgggcgactcctgctcccgacgagaggttgcacaatggagatgtgcgtggatgaaggaggtttcgaactttcgacgggttatactcacagacagacggtatttgtagagtatatacggtcgttggaataagggtatacacgagattaagataaaagagaattgcgactgtgacttttatacaggtttgagccccttaactaacatgtaatagccctattcctattggtcgaagctggtgttgtttttatatatcaatatgtcataagtgcaatatttgggatggcctaattaatctagtctctgtcggtttggcggcacagagctctcacatatagtcgagagctaatgtagtcttctttgtcgaatatgaactcgacgagattggaggtagcgctggatccttcatgtcggcctttgtgggtcctacgttgagtttgtttatatctgtattggcttgtcttgtgttggcgtgtctagatctgtctagacgtgttagcgagttgcatgtgcctccttttcctaggggatcttgtatttatatcctcgaatgttcccttattcaagtagaactaagagacaagtatggatacaatctaagcagtccttgtagtgtatgagtagaactttgcttttccttcattatccggaacacatttcgtataagatttggtatatggtgagtcccgtcgagcccaacccaaaactattagatatgtcttctgtataacactgccaggagcgcttagagatcatgacgtgctaccctctgcagacggatttgaaccgtattagagacttgacaggcaactggactaggatcttcatgaccatctccttcaacgtctatatcgtctaaggctgtgttcgggagacaaagttgggaaccttgcctcccaacacggaaaacaaagtatgcaattatagtgagattaattagtattagcctaaaaaacttgaaaaatggattaatatgattttttaaagcaactttcatatagaaaacttttgcaaaaaaatgcatcgtttaacaatttgaaaagtgtgcgtgtggaaaacaagggaaataagttaggaaagaggggaaaagaacacatcctaatatcctctagcttcaatctataaacaatgtttaaatacattattttattaagcaaattatataacacatgttgtctactccctccataaaaaaaactcaacttatagagtttgaattttgtccaacagaaaaccaacttctatcatcatacctaccctcagaacataaaacgagaagttttattcctttataccctttacctgcctatcaccattacattttattcaataataaggggtgttttggtcattttcatcctccactaattttgtgttgggatgctaggattggattttatgtgggacagagggagtacaatatagatgctcaaagctacatggagtatgctcactataaggatataggtcaaatcattgattccacccattagctttgtgtcccaaggtggtgagcagagaatgcagcatgggttgtaggcttccaccagaagagtcctctgttacaacatctttatgaaacgattgcaaactgaatgcccgattttttccaaaaaaatcgggcgttgtttcatcacttgtgaaacaatgtttcagcacttagtataagaatatttcaattcttgaaaatagtggaacacaattggatcaccagatgaaacagtttggttcaacatatgaaacaaatgatttaaagccattgaaacatcacaagatccaagtgaaaatcgaaaaagaaaatgaaacaccaccaaaaccccaatctgacaagtgaaacatctatatacatctctactattataaaaattgaagatatgtttgccggtactattataaaaattgaagatgtgtttgtcggtacttaggtacgtcattcgtgtatgagtcggtttttaagttcatttgcttttggaaatacaaatccgtatttgagtcggattttaagtttgttctgttttggaaatacataaggaattgtataaataatctctttaaaaaaactcgcatgctaacttgagatgatcggacttttaattatagctcatgattttctaaaaaaatatatatccaaataaattctcacagtgaattttatcttaactaaccatataacaataataagattaaaatagtctttacccgttgcaacgcatgggtattttctcttgtatattgaacaatattacatagatgctcaataataagatggcgatgtggcgctgccgcctttgccgttgcatccgctttaccccgcggccactagcgatggatccactagtcccactatcgtcggcgctagatccactcaccggtcagcgcagcgtcttccttgagaagggtggcgcgatgtcgtccgagtcatcggagtcgtctctgtcgccatcgttgtcgtccgtgccacgctcccctcgaagtccaacgacccccgccttcctccactgctacttgcggcagtcgctgtccccgctgatgacccctagctatgccccctcccctgcccttccccgtgccctgccgctcttccctgcttccgttgtccaccccgccgcctacagcagtaggtcctcaccacgagatagcaacagggggcgtcgggatcgatgtctggaggcacgaggagacggcggtcgaagggacagaggaggagaatgagcatggttagagcaagttcaatagtatagccaactactagcttcaattcatctatagccaatttaatagctcatttatacaatagttacatactacactattaatacatggtcccacctgtcatacacacactgtgtcttggagtccgtgctacagctagctacaaatctgtagcccgctgcccttctctctccttatttatctccttaaaatatgtttgcagctagctaatagcaggctatagcttgctattgtacctgctcttagagagcaagacagtggagcagtgcccgatattttctctttgaattggtctactgatgtggagcgtttttgacatctttatccaaagcagcaacatgtggacatatgcagcttgagtagtttataccttactaaaaacatgtgtctcatcgaataaaaacttttggaacggagaaaatagtcctccctccgtttctaagtatttgacgctattgacttttttaaatatgtttgaatgttcatcttattcaagttcctatcatttgatttattgttaaatatacttatatgtatatatatagttttatatatttcacaaaagtttttaaataaaatgaatggttaaatatgtactaaaaattaagtcaacggtgtcaaatactccctccatctatttttgatagtcatatttcatcttggcatacagactaaggataagtaattctacttatcatctatttaagcatgctactagtcattcttcgtaaacaaacgattcattaatatttatatttctcgatgtccatatagccaatcacgtattaaatccgagaaagtcattaagatgataggttgttgaattgaaatatggctatcaaaaataatttttttagatttggaaatataactattaaaagtatatggagggattatttagtaaggtgagggagtattagtttggcgtgggatatgtacatgcacgtatcaaaagataaagaaaaatcccatgtatatctcacccacgaagcttcgaagcgacatatctcacctctgtcactagaccgtgaaaaaaaaaaaggagactcgcacgtaagccatcatgaaagggaaagtccgaatggtcaagtctcagacacgctcgctagttctagttcctgcgagcgctcgctcgttagctctttcgcatcgagaagcatctattgtttacgctgcaaattgttcttgtgttgcgtcaatacatgcgtaagccactacctcttgcatgtatggctacagacgccgaacgtgcccaactaacatgcatgcatgcagctaactaattgttaacttgcccgtactcaactaaccacataagctaattaattactcggtcaactaatcaccaaacacatggctgttactacaactgagctaatctcctagtacatgcatgcatgcatgcatgcaatgtatatgcagaactccactacgtgtatgacacacatacacgactggttaatgcagatattctaaaacatatgcgagtcattattagtgctaacagagagatcgagcgggccggcgtggcgagcatggagatcagcgcggcccagtcgcttgtgagtatagatggccatgccggcacggcccaggcctggccgtgcctgggccaaggcttgtcgggccggcacggcccgaccgacgcaccgggccgtgccgtgtcagcccacgtgccgcactcacagcccaggcacggcccaacacgcctcgggccgtgccgggccggcccgaaggcacgatgggccatcgtgcttttcctcagaataagtctaaattttctccctcctattgggctgtgacattgtataactaaaaaaagtctattttacctccctcttcttt

SEQ ID NO: 73374 - DNA, 1288 bp, Oryza sativa
acttaggcatttttgctttggcaatttatgctcgcaatggtgtggcccaatgctgataaaatcctttttaatgcggttatataattctttggaattattgcaatgcaaattgaaaggtacccgacagaaaagtgttatactatttttgtaagcttttttaggctgcaaaagctgtctgggttgatttaagatgacttgtttttacaatggtcattctcttggcgtgttatatgcctattttaattatggtgagagtcatagcctaggctattagacttattaattaccataatttttataacatttgatggattatctttagagttttttactcggatgtttgttaaatgtgttcatttgtgaaccttttagagtgttattcactcggatttttttactatggctggaaagcagtcggctgaatgtcttgttggacgccgcatatgcttttgtcatatgatgcatgattatgcaattattttattcttgactacatgtttagtttgttaactaatcatatagtcgggggctactgtggagattatggataccccatatctacacggcggttatatttagactgaatataggataccgaatatagatagaatatctttatttgtatctcgggtttgtttcttaacttgtacgtcaaggaaatatcctgagatttagtcggttacgattgtattttatttgtattctcgtattctgataaggatatgagttataccttgtaatacggactccttcccctatataaggaggggtccgagtccttcctgggacaccaattctctttgagatcatacattcaataatacactcggcggtttccaccccggacaggagtagggtattacttcttgaataagaaggcctgaacctatataaatcgtttgtctccaaacccatccacttttcaagcttgatagccacccctttttagtattgccgaaatcttgtttcgacagtaacaaactcttggtctatctgcaattaattgagcaaattccactgtcatggccaatgaatttgggctattttgaagagacaatgcaattaaattccctctctgctgctgtcagacataagaaactctccaactgggtaaggtcaacctgctgctgctattttgtttagttattttttccatcgacattccagttgagaacactgcatctctgcgctcatctccatgttctcctcaactaatcagatgttgcatgatcaccatattgcatgtatatgcatgcatgatcagttgttcacaaattataattaacca

SEQ ID NO: 73375 - DNA, 10345 bp, Oryza sativa
  unsure (1)..(10345): unsure at all n locations
tttgactatcanttgttcagtattccatcatctattttataataatctttcacaataatctatctatttatttcaaattactcatgataatttagattataataatcttaagttgaaccaaacaagtccttagacatgtccgtatttcctagttctttaaacataacgccatcttattgcgctaatataattgctatgtctgtcaatattctaatactatgtaattatgcgagtttaggagaagcatccacatatggtcatgtataggagatgtaggccctgtttagttcctaaaataaaaattttcacgttgtcacattgaatgttttggcatatacatagagtattaaatatagggaaaaaaaaccaatttcacagactgcgtgtaaattgcgagaggaatcttttaagcctaattgcgctatgatttgacaatgtggtgctacagtaaatatttgctaatgacgaattaattaggcttaataaattcgactcgcagttttctggcggaatctgtaatttattttgttattagactatgtttaatactttaaatgtgtgtccgtatattcgatatgacaactaaacttaaaaattttccccaactaaacaaggcaaacaaggctgtagtattcggttgaacatcataataaataaatattgtgcttatgtgttactagtacgtctggatctaatctcctaaagcgactgcattgtctgatatcgatgttgatttcgatgccggttttgataacaaacatacaaagtttcttagtaactaaggatattattagtatgatggtgtactttaggggattaagggtgtgtttttggtttgtctgagctccaatatcatacctttcgttttttatgctgacgttttttaaacagttaaacggtgcgttcttttttaaaaaaaattatatgaaagttgctttaaaaattcatattaacctatttttctaaaaagattagctaacaattaattaattatgtgctaatgtgtcgcttttgtttttgcgtgatggagggattaatgactatataccgatcagctacttattgaagtctccgaagctttattaaacatggcaaatgttccgtttgaaacaagtcctaattcctgtgacaattaagctgatttctgtacaactatttatagaactcatccgatctaggggtatttggatggggctaaaaatttttagtccgtcacatcggatgtgttgacactaatttagagtattaaacatagactaataaaaaattaattttataaatgagagataatccgcgaaacgaattttttaaacctaattaatccataattagcaaatgtttacaatagcatcacataggctaatcatggattaattagtctcaatagattcgtctcgcgaattagtccaaagttatggaatgggttatataattaatctatgttgaatactataaattaaagtcgaaacatccgatgtgatttaatccatatgaaccaaacaggacaatttacagaagaggttatctagggactgaaacactacaacaaggttggatagtcaatcatactcataaagtcataagcttacatctagctagctagctactccaaatctctgctctgtcaaactgtaggtaagacatgtacttcattcatatcataaccactgttacccatcctgtatccctaatcaagttgaaacagtcctttcatggttgtatgatctgacaacctgcctcgcgacgacgacctcccatatgccgcatacgctaaccgtgcttaattgggcgctgtttgcagagcagaaccagtactctgccatgtccccggccgtgctcctctgcttatgccgccaatatacaatcttggccaggacaggccagagagaaatttgcaagatctacctgaatacctgatcatttgcaccggtcaaaaatcgtttttaggtcaaccaaatacaccaagatgatacaaaagcactgaacacacttccggcatttgcatatcggtatttgtataattaggatgcacacagccaaaccggtaaaaaaatcgtggatatataccatgcattcatgggattatttgtgttgttttcgtgtccggccttgtgatccaatcatgctcatgcagaactaatgtcaggtcgatatcaggtttgtagtagtaggcatatggttcgatcgggtgtaacgtacgtgcgagtcccgtgatagagcatggtcctgtatattatgtacagatgtgtaaacaaaagttagtggtgcccaagtatctggataagatttgtgtccgtttgttggctcacgtacatgacaaaactgataggttcagacaaaatagtgcacgaatacaatgttggtcgatcaatgaaaggacggcgcgtgtcgtggaaaacaactgtgcataacgccaaataaaccaagttaatatccatgtgtggtgtgtgtgatccaaacgtgcgtgcatctaggctcgtcccttttttttcctcactagcttgatgtctcaccaagatctggtccacaactctagcctaacgaagctagctgttgcatcctacgagtgctttttggaacgtggaaattttataggattttcatgtgaattagtttgatttcttaaaacctctaaagttccatttttgcaaaatgaaaaagaaaaagaaaaggcccaagggttattcttttacgtttattctataaaatatcagaatgtaccgtgttttctgctgcctacaattacaagacaacaacgtagtgaaccattttttcctcttatgcaagtaaagcaagatagaatttgttcctcgtagagttagccattgggtcagaccgagcgatatgatctcggtcttcactctttagggaaattttggccatctaaaacttaagaccgaaacgcgttacgaattacaaaaatcaatatccgttatgaccaaaatcgtcaacaatgttagagatgaaaaaaattacagaaaccatcaacaatttcaaagatgcaaaagaacttacataaataatcaaataacaaaaaaccgttagcatccgctctagatctccacctcgcaaccctccacatgtcgccagcaccagcgcccttctccatcaaagttgcttgctgcctgacccctcagtgtaggaggttgatggagagcatgttggcggtggaagggtgcacccctcacccatggggggtttataacctgaaatgaagcatgttggagaggaagtgtgcccgatgtgcggcctacgccaaaggtggagaggaatgtgtcgagccagaaagggcatcctcttcactgagccggcggtcgaggcatcaccggatcttggagaggtggaggtcatgcgcgactagcgaccacgcagtgtcagggatacaaggagcattggaaagggggttatggtagggctgtcaacgagccgagctcgagcgagctcgtctgcctaagcttgagctcgacacgagctcgagccgagctcgagccgagcctattgcaccttcgagcttttaggcaagctcggttcgagctcgttcgagctcgagctcggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatatagactatacacagccaagctcggtcaggctcggtagaagctcgagctcggctcggtaaagctcgcgagcttttgctcaggctcgagttcggctcgtttggagcttgagccgagctcgaatcgagcctaggacgagccaagctcgagctgctcgggagtctcgagcttttttgacagccctaggttagagtcttaggattcattgtgctctattaggctattttagttaatgcgataaccgaaaggtgatgaataaattagccgaatataattccgttagtaagaggttgaaaccaaattaatgttcaaaattttctctatctgtcttgtctctcccgtttcttttggttttggtctgttttgcacacccttatttgtcgatgcaatatatgcatgaatgcttaatttgtatattgattatttgagtcaatggtactactagctagctagtactatggaaatttggtgtatctaattgtctgcccttgcaagtgatgcgaaaaacaaacgggaaggtgacgacgggtttggttggctttgtgtttcccgaagccattggaaggcagccaaggtcttttcactaaactgtgtgtgtgttgttgtgtactgtactatagtgttctgcatcgtttgcctgcctgtcttggactttggtttttccctgctttctttccttgtccttcacttccctgtagagtatcttcgaagtcagagaaggagagtaactaaaccaaaagttttgtacttttgactgcacttacgataggcacgttgtactatagcatgcaggccctaaacaaaacagagcagtagttggattacattgttaacattgctttgcttgtacgctgtttactgtattattaagacttggggcaattctaggatcacaaatttcagagaagatggaaccaatactgtcatgcatagcaggacaccggtaaattaatgtactgcaaatagcaactcatcagccatttcaactatctccgtacttagatagcaaccaaattatcaaattactagtacatagtaatggtaactatatttggaaacagagacagtaacttttagtgacaatcatggtgatcacctaacccatgacaatgagatcatccctgcatgccaaagaatgcagaagcactagtttacataggcattgatcaaattttgggagtatatggtttcaggactgtgcaactagattcatagtccatgatgtccacaccgcgcagcaatgtcaagaaaagcatagcgtcaactcgacacaagtgccttttgcttgtagtagtagcatactatacaccttgcttttggggctcagcactcatgatgtagcatccgatggtgagggtggatttaaagaagaagggttggggaaagcaaaggtcttcatgctactaagccataaaagcgtgcaagacccatgcaaaggtgtgtgtggtcacgccatggaagcaaaggggggttaaactgaaaatgttttttgcagggaccaaagtgcatttataagggtgccaagacattcatattgaccttgggggaatttagcatggacatattaatttgaccatagtttacaatgctgacagctcagatctctagtaggctttcttttacatgtatgttaccctaggggttcttgctctgttgctattctaaggatgcaaaccccactgtatggtgagattgaggcgtgaatgaaatccagacaaaaatgtttcactttcaaattgtggtccaaaaaggataaggtccatagtgtgccaattcttttgatttcctactgttagatttgtcgcaatggcgcgcatcgatggtcggtttaatatagaactccctccatccaaaaataagcgtagccataagttttcgtcttcaacttagatcatctgtcttatttgaaacttttttatgattagtatttttttattagattgtaaaacatgaatattactttatgcatgacttatattattttagattttctaaaaaaaataaataagacggatgattaaagttggacacgaaaactcagggctgcgcttattttgggaatgagggagtacggagtactaatatcaaaccacaatgcacggacaaaaccactccaaaagctaggtggaatccaacccagattcatacttataaatacatatgcaccttcatctcacaaattcatgccgttttaggcataaatagtacatcaaatatccaaatcatttttcaaacattttggacaacaaggaaggtagcccgtgcattcgcgcgggcatgtatcgtaggttgtatttcaaacactatatgggtggaatataaatcaaaaaacattttcaaaatataaactggaaataaagcccacatagatgcattgacatcttatttgttgttcaagaaaaagaatagtaacataaatcatatatcattatatacactgtaagggaatgtaaattatcttacaataaaaaagaaatatatttgctgtaaaatagatggtatattttaatatactactaaatataagaataagaatatctctcatatttaaataaaaatcattttgtcgtggtcatatataaactcccctattgttattgttttaaatgctatgtgcatttttaataaatgaaactgcattaataccactaaaataaattatatattattaatacactaaaaaatcatctacactgcttaactcgatgtccatcacttattttcacatctatgtataaatagtctaaacataccacttctaccggataatacgataacaccgttaaaaatagtcataaatgtctctctaacggatgaagtcgataactactaaagctttcttatgtaatgcccctgaaacaggggggttcctaatggggcgatcgatcagcacaccacaacaaaattttaaaaaaacaaaaagttagaaaaatttatgtgtaaaaaatttgaattcaaattcaaatttgaatcaggtatgtaaacttttgacttataaactttggatctataaactttagatatatagaaatactatatatagaaaatatttgaattcaaattcaaatttgaatcgggtatataaactttaggtctataaactttagatgtatagaaatactatatatgaaaaatatttgaattcaaattcaaatttgaatcggatatttgaattcaaattcaaatttgaatcagatataactcaaattcaaatttgaatcggatatataaactttaggtgtataaactttagatgtatagaaatactatatataaaaaatatttgaattcaaattcaaatttgaatcggatatataaacttttgatctctaaactttagatgtgtaaacttgaggtgtataaactttagatgcataaatttactaaaataggaaagtaatgcggtgccaaaaaaggaaaccaggtggagggagggagagggaggggggggaatcgatcgccctcgctcgcccggtagcatttccgcctgaaacatgggtcccacattgacatagccgtacacttaaagaccagcctatggcaccattttaacacttagtttactatgggcacacctacaaaggattgcattagtatgccacttaactcaaccatatgcaaatgcctgcgatatttacgatggcatagtaaacactacaccctgcattgaaaggacagggatggacaaaaaggaggaggtgatgaaaatagttatattttttgccccctagttatttctgtgtggtattatttttttaacaaaatcatagtttaaagatgatcataaatataggcagtttggttttccatctaataagtgagaaagaaaaaaaaggaaaaaaataattatgtgggacgtacttgttttttttgatacctatacgtgcacatacaatgcgagtttttgagataaatttaattgcattttttataatagatctaatggttataaatttgggcccaccgcattctaaaattttttaaagcgccacgtgtttaatggatttttagtagataatagataatagataattgatagattgaagattaggaaagggaagagaagatgaggggagagagggagtacgtacgttacgtaccatctggaggagaatgggaacgtagaggaggtggggaccggtgtggagaggaggattttattttttttatttgatctaatggttgaaaatattggacccaccaatttaaaggaaaatcaacggttagatttttagactgtcacttggcatctttggagcgttcgtaggaggacatgtggcggcttaggagcgcttataggaagtttaatggacttttagtatataataactaggaaggtagtccgcgcaattgcgcgggcatctatttatttctaaatgttaaaatcctttatgatgactgaaaattgtttgtatctatatgaaaagattttgtaaaatgttcaatatatatagttagtcagtcccatatcatgcagtttgttttgatacttcaaagcttgattggaagtaaaaaatttaaggcctagcttgtttcacctatgaacattgatgaataaatctatgactgatatcttcagataatatagaactaattattctttgaattttgatatcactatttttcttaatgactcaaggattttatcatgttttataatggtttcaaattgatcgttcataattttaaatttaactaaatgtgttggcactgattaatatgatatctatagattggttaatcttttagcgtgactccctagcgtgttaacagcctatagaagtggtgcaattgaggccatatatgctagatctttttttataattggtggtttaattgaggccatatagtatctatgggttaattattttacatgaaataagatgaatggcttggtactgtaaaatatcaacaattagtttaagctaatttctttcggtctttggttgttttatgtaaaacatatttttttaaagatctaatgtttaaaattaataggtccatttatttagaagaatttttttagagatgtaatggtctaggtccaagagtcatgattatttagctatctaatattgttttatatagttagcgctagttagaaaataggagaagttaaatagaaaataggagaggaggggagagtgggaaggtggagggaatacataagtgcgcacatacgtggttaatatccatgggtattctgttttctcttacatattcttctattttctgatatgatctagacaacggactgtaaggaaatactcacaggagagaatggttaagttggtcacgtatgtggtgttgttatgagaaaagtacgtattatcgtacttgtatgggagattaggagaggtttatatacatgatattaggattgctatttcaatagatctaatgtaatggtctaaaataacacgtccatcggcactaatttaattgaaaatcgatagctggatgatattttgttactttctatgaatttttatgattttctgtaatttattagagcaccacatgacaatgttggagcatttaggagcatttgtataaagttaattaacttttacttataacaggtgtatgatgcaataactttttgtgtatttatagacctaagttgaatatcctagtcgagccacagaggaggcctcatatgtaagttcgtactcgtccagtttttatatgtactcgtataaaataggagaggatggttaagtcggtcgagggagtatattcgtttacacatatgtagtgttgttaatgaacttttacttatatataacatatatatgatgcaatatatttttagtgtatttatagactaagttagatagatttagtagcgccgcaaaggaggcctcatatgtacatacatacagatataacgatattttaattttttgtttgagaatgaggagggaaggtataatatcgttacttttcagcaaaagacgtcgctttttagctttttttttaacgaattttacatacttattttttgtccattctaatagcacagtatgaaaccgatatctatgcaggaatagcatcgagaaagttcgtttgcatagttacttattaaacctaatcaccaattatagatggtaaaatttcgttgagctgctgctgcctatggattgtacaccaaatgatcaaatgctgctgcctgtggattacattgccagctactgaaagtcaaatgcttgtgcaatcccagtctcatgtagctcattttccccgattaatctgtgtggaggctttaatttgaaacctaatccaagtctaggcggcagcaggaaagctttcctctatcgaggccttgagcccaacacggacgaaaggcaccggagtaggcgacaggaagcgtgatcggatttggggcaagaatttgggtcaccaatttaattaaaaatcaatgacaggtatagatctaatctaacggtataaaataatgggtccactaacttaaatgaaaattaacggtgagattagactgtgccacgtggcgatctaggagcgtttgtaggagcgccatatggcggtttgagagcgtttgtaggaagtttaatggatgac

SEQ ID NO: 73376 - DNA, 917 bp, Oryza sativa
aatgcattctccacataccatctccacatcccagagttttgaaccggcattagttcccaataaaaaccatatgttgcccgacttactacaacatagattgtaatgtcactagtctgtggatcaactcccaagccccgcatcaaccatttttttatagaaggtacactcctctcggctggcctatcaattccccttgctgttacaataaattctgacagatctaccccagttggcccataacggacgtttccttgaccatggtatagttgaaatataagtttactggacatatctgcaaagttaattactaggccgttattttacataataaacgactacagtgtaatatcttctttgcaacgtacctaaatttttatatattctattgcaatgttactcaacaacatttaaaactacaaacctaataactacaaatactacagatctactaagttacctacatggctacatctaacaatatatatttatatagtaccacaggtaaaactctatttcatacaatgcatttatcatatatttagtcacgtatataatctacgaatattacctgaaatcgaagtttgaaactggcagggcttcgcctcttcttttcttctcctccccttctcctttttttttttttttgatgtggagaggttaggagggaatgggctcctcaaaggagccggctgggctttataggcggccaggcctgccgccttctgtaagggcggcaagggggtcctgccgccctttgccagggcggcaagagggcaggagggggcaggaggacggccgtcccgcgccgtccagcgcgccgtgtgccacgtcggcttgccgcccttgcgaagggcggcagggtctagttttgcaaattttttcggcgctataatatttctgtaaatattaaaaaaaaa

SEQ ID NO: 73377 - DNA, 648 bp, Oryza sativa
tgtgtgtgtgtgaatgacatgtcgatcccacaatttttttttactctaatgccacataagcaacacgtgggacgaagactgggtcaacaccgccatgtagacgccacgtcagacaaaacctcttctaaaaccatccagggatatagtttgcatcggttttgatagttggagaagttgatatacacgatttagtggttagaggtcatgaatcatactcaggttatagttgagagagcgaaagtataccttttcccacgctttaatcatgcgatttgggctgcctgatccatgatgagttttgatcggcctatgctggataaataccaatggcccatgaagagcagggagggacagaggagaatagtggaagcaggctttgcaactataacagcaggctccctttatttccaaggaattttttctttagatgacctgcacagttacaacaactagtgcgtatcttctataaatactgttggaattcaaatctgagcctaaaattaaacataaccgaattgttggtggctcaaagctaagcaaccagttgcgtgtcttcagataaggagtacaaaagagcttttcagaatgaacatcggtctgaagagaagtatcctaattagaacataaaactggttcagactaaaatgc

SEQ ID NO: 73378 - DNA, 27229 bp, Oryza sativa
  unsure (1)..(27229): unsure at all n locations
ccaggcacggcccgacggtcgggctgtgccggcacgggcccgacccaagggggttcgtgccgtgcttgggccgggccaaaaaggcgtgccgtgggccgggccttcgggcctcgggccttatggccaactatacttcggagcgaaggtcctccttcgaccgttgaggagtatctcattctccgccttgacctcaacgacctgccgaaacacgcgcttgagaagctccatgaggtcactgcggcggtccctgctggtgggatcgaacgcctgagacacggacacgatcgctcggtacgggaactccatctccagcagccggcacacttcctcgcccagcgtcgacttgccgacgccgccgaaccccacgatggagaacaccttgacatgctgctccccgacgagctgctgcttgatcagcagctcgaccagggcgtccgcctagcccttgatgccgacgagttggtggctgtcatggcggtgcgcgtgcgcagccaccggagcagcagttaaagaatatgactgataagaagggaataagcggcggtgctacagggcgtcgcggttgacgccgtaccgggcgtggcgctcgctgatggagagggcgcttatctcggcggcgaggcagcggcgctcgcggtaggtctgaaggcggtgcttcaacctgccgcgcacgccgtcgcccgggcggcacctgatgcggagccaatagaggccgacgcagtcctcggcgtcgtaggcgagctcgcgcacctgcttcatccactcccggatgaagtggtccacggcggcgccgtcgtcggcctcagactacatccggaagagcgcgttcatggtggccagctcgtcccgcagctccgcgacctcgccgcggacgccgctgagctaccggtactcctcacccagcagctgcccaaccgtgctcacaagtatagttggccataaggcccggcccacggcacgcctttttggcccgacccaagcacggcacggcccgacttgggtcgggcccatgccggcccagcccgaccgtcgggccatgcctgggcctccccgccagcacgctgggctggcccggcacggtcgggccggcccggcacggtcgggccggcccggcacgatgggctggcaggccagacccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggaaaaaatttagacttattctgaggaaaagcacgatggcccatcgtgcctttgggccggcccggcacggcccgaggcttgttgggccatgcctgggctgtgagtgcggcacgtgggctggcacggcacggcccggtgcgtcggtcgggccgtgccggcccgacaagcctcggaccaggcacggccggacctgggccgtgccgtgccgggcggcccacatggccatctatactccgaagccaacaaacaactcaaccacgacgatgctggcaagatgaagaaactcctggatggaatcgacgattggaaatacgagaaactggacaaggaactccggtcctatctcaaggacaagaggtacgtacgtacgtacggtactactaccgctccatcctaaaataattgtattttctatcctttacttgagaaaatacctgtacgttgctacggaaaactaaaattatatatgataattttcatgatccaagcccttttaagagaatatattcttcatgttacgcgcgcacataatttttgtcaaggtctaaacaacaggtaaattcttttttcataacagcctatttcacattacaccagataaattattctatttgtataagaccgtgacacaaaataattgaaatccgatcttgacacagacttcgtgtcacacacgaacatgatctcgataagatgtatagaaaaagttacaactttaatgtacaagtctcaacattcgtacctatgagattgtaatatcgcatatgcaccaacattaaaaggacgaatccaaaattttaagtaccatatccgaatgtataaaagaaataagaatgaaaactaaatgatgcgggatgagagcataagttacatttttttacacatgcatcgactaaacttagaaaataaataaaacaataagtttttttctaaagatttcagggaatcaataatcactaaattgactcaaaaattaaaaattctccacggataaatctactcggtctagtaggttccaatagcctcgatgaacatatcgtaatctactcggtctagtcggttccaatagcctcgatgagcagatcctttgcccaactaatttttttgtacacttatatagatggtgtaattcatagtaaaaaaagaactacttaacttttttagatagctcccacatataagatggaaagctcgtgggggtgtgttagtgtaaaagaattactatcagggtgcaggagggggcacgtagtaaatgtacgtagccacggtaattctcacgttgtcggtctttttttaataaaatgaaaaatgtctcacaactttgacacttaattactactctctccgtttgacgtttttcttagttaaactttaagtttaaccagtttgtacaaaaatatactaacattttcaatacaaaacaaatatattatcaaaatatattcaatgttaaatttaataaaactaatttggtgttgtaaatgttaatatttttgtgtataaacttggtcaaacctaaaaaaatttgacttaaaaaagtcaaacgtcctataatatgaaacggatggagtagtttgtatatgtctaaattatgttttgaataccaggtctgttttttttatagaaaatgtcttactaaaccatctcacacatttggggactcagggacaatttcattttttttaataaaaaactaaatggggcaatttcatcttggatctaatacgacgcatcatttttaagtgaatgtacaacaaatctaaacatactctacatacaatatatactaagagcaattttatggtccttgagaaggtactatgaggtaccactttttctagagatttgctccggtccaacaaaaaatacctcgaggtaccggtacctcccggtatcaaatcatttacgatcgttggatttagctagacaagatggacatttatagatccaatgattggaaatgatttggtaccgtgaggtgctgatacctcgaggtactttttgctggaccagagcaaatctcatttttctattgtaaatttggtacctctttgtacttaagtactagaaggtactaaattttacactaaatttttggtacctcacgtatctcctcaaggaccgtaaaattactcgtataataatgcatacgactagttaactgcaggtacctcattatggtggatgacatatggaccatacgagcgtgggaggcaatccaatccgtgttgtgcgataacaaccgcggcagcagaataatcgtgaccactaggatagaggctgtggccaaagcatgcagtcctgctattggtgggcaccatattcatcatacgcaacccctcgagtttgaagactccaagaagttgttcctcagcagaacatttgtcaacaaggagtgtcccgaggagctggaagatgtaatggagaatattttgaagaggtgcggtggcctgccattggccattgttagcattgctagcgttttggcaggttacacgtcaccaggaagcaaggacaaatgggaatcaatctacaaatcaattggttctcatatggagagcaacccaacccttgaagggatgaggcaaatacttgcactcaactacaaccacctgcctcatgagctcaagggttgcatgatgtactttagcatcttcccagaggattatgaggtcaacaagaatcggctcttgtggagatggattgccgaaggattggttacggagaaacggggcttgtccctaatggaggttgcagagtcctatctggatgacctggtcaataggaacatgattcaattgcgtgaagatatcgagtactattggaaggcccagatgtaccgtgtccatgacatgttccttgaggtcatggtgtccaagtccctggaatctaattttgctagcctgctaggagggcagtatgcaacaatgtcgtatgataggattcgtcgcctctccattcagggcgatgatgacaggcttgagaatgcagagcagcctaggaaaaatacggcagcatccgcaggcgtagatgatgggatactggatttggagcatgttcgatcactaagcatgtttcagcatacagggaagaaattgctcgatcaacttggcaaattcaggctgctgagggtacttgacctggaaggtttcaagggcgccctgactaaggatcatatgggctatatttgcaggttgtacctgcttagtttcttaagcttaaagggcatagaagtcgaggaggttccaagtgaaatcgggaagctagaacatctgcagacacttgatgtacgtcagacgtcagttcgcgggctgccacataccgtgacgaagctgtataaactcgagcgcctacagatctcctataacggtgatgccaatctaatgtggaagctacccctggagcttaagaagatgaagatgctgcgagaggtgggcttctcagtcctcggaaaccatctccaggttgcacaagatgttggtgagctagatcatcttcaagagatggttgtctacgtcgacgacatcaccttcgacgacaatgttctcacagagttcgctaattctttgagcaagttatactcactccggcgcctcatcatcggagacgtgggctacggcaagactctgaactttctcgaccagctcccctcgccgccacaacttctccggcaccttatgatcgccggtggcatcgataggttgcccagctggatcatgtcgctcacataccttgttcagttcaacatgtcgtgggggaaagttgctggtgaccagctattcgatgtcctgtgtgagttgcccagcctcgagaccatctgcattcacaattattgctacgagggcaatgttctagttgcacgcactagacacaggtttccggagctcatcactttaagaatagcctctggatcaaagcttcccaatgttattcggtttgagaatggaaccatgccaaagctcgagaacctgctagttaacttcactgacaatgatgagaagaagattattggcatcaggcacctgaccagcctcaaagaggtacagctctggggtaacgagagcaaccttgcactacatcgtgcactggagcatctcaagagtgagaacaagaggcgcctttttgagttcagtagccagtttcaaattgtagtgaaatacgagtgatttctcttgtggtttccttatttgttagtttctaatttctcccagatatcaaagtaaactatcctattatacgcaaggatgaggaatgccatcatgttaattaagatgccatcttgccgattggagagcacgcttatggagatattcactagacatgggtggcggttcattgagggaatcgatgattgaacaatgttgtccatgacttggcattcgatttttttttcttcttgttgttgcttgatttgtcacgttttgttttcaagtttgtaataatgtacggctatgtgcatcatgcatatattgaagaggctgagatgcatttgttttttttcttcttggctggtttctcatgttttgtttacaagtttgtatgatcattcttattcctttaaaaaatgtattactaacttagtaggtgggcgatttagtaaagaacttaagaatcaaacatcaaagtgcaacaacttaataagtggatgtgttctagtatgagaacttgagaattttgtattttggtgcagcaagttggctagatatgtttgttttggttaataagtgtttggtgagattttttacgaaacaaatataccatcacataataatcttgcggatatatattaccttaccatcttggatttaatctataggctagaattatgttgctcatccaatttgcaccatcagtttggagtttcttattcaacttcttaaatctcaatcgaaatacaaaatttatagaaaatttagttgacttttagttactagaatgacaaattttaagtatacttatacaaatttgtgcaaatatatcgacaaaataagtacgtcaaaactaaatgagtacataaaaaaatcaaaataattaagttgttgcgcatcacttcttaatttattatagcaaaaccacacccatcttacaagttgttgtattcatgcgctcacttattaagttcatatactagatttcacccacctattaaattgttgcactagcatgcttacttctcgagtttttatactaaattgtacccacctattaaattgtgccaccggcatgcttacttctttaagttctcgtactaaattacacccacatctaagttaatgtaccatgaatgtaatttaattatagctcatttacctttttttaattaggtcgcctaccactgaaagtctaagttaatgtaacgtgaatgcaatttaattatagctcatttacctttttttattgaattacgtcgcctaccactgaaatcacaacgccgttaaatccagaaaaatccgctcccatagggagtcgaacttaggacctcaggtgctactgaggctcttgtaaccactatgttacaagctctttcgtatagcttatttacctttgaactgtgtatttattccaatcccaccctacacagatattttattcacgagaacaccagctggtcggttatttcgaaaagaaaaaaatatatttatttctgctagcaataaagggaatgactaaaatgttctgctagcaacgaagtaagtatgtgatgataaaattaacgaaactaattggctaggtttggcccagaagcaagcaaagaaaaagaaaaaaaggacattaaaggaagaggccagagcgaggcccatcaaaggagattttttttaggaaaaagtacaccgaaggtccctcaacttgtcatcgaattacaaaattatccttcaaccgcaaaaccagatatagaacatccctcaacttacaaaaccgttcattttaggtctttcggtggttttaaccccggttttgtctgacgtgacggctgagtcagtgtggaacccacgtgggtcccacatgtcagactatccgcgtcatcacctcactctttccattgtttcctcactatagttggccataaggcccgaggcccgaaggcccggcccacggcacgcctttttggcccggcccaagcacggcacggcccgacttgggtcgggcccatgccggcccggcccgaccgtcgggtcgtgcttgggcctccccaccagcacgctgggctggcccggcacggtcgggccggcccggcacgatgggctggcaggccagacccggtacacaaagtatagggactaaaaatagacatataaatgtcaatgtctaaagaatagggaccttaaatagacttattttagctatttatataccatagcacaaagaagagggaggtaaaatagacttttttagctatacaatgtcacagcccaatagaaaggaaattattttgttctttttctgagaaaaagcaagatgccccatcgtgctttggggcggccccggcacggcccaaaatgtgttggcccgtgcctggtctgtgagtacggcacgtgggctggcccggcccggcccggtgtgtcggtgggcctgtgccggcccaacaagcttcgccccaggcacggccgggcttggnccgtcccgtgccgggcggcccacatggccatttatattcctcacctcctctctctcactcttcatctcatttgggcagggcggcggcaagtggtgaggtggctggcgggccggcagggtaaggcaggagagcaggcggcggcggcgcccgagcagggggagggccagctgcccgtctgccccaacgccgccgcggcgcgtcgtcgtggttgcgggagaggctatcaaagacgaggaacagcgcggcacggggccgaaggcgagcacggtggtaggaggaggagggcggcggccgccgggcaaccaggacgacggccatcgcgccgcggcgggatccggcgggaacgagggggacgacgacgccgacgaggaggagaggatcccgtcgggaggagcgggcttgggcgaatgatatacggtggcagatcggtggaggtggcggcggagcaggggaaggagcgggcgagcgtggcagcgtttacccgatcttgcccctgacgtcgaagccgtcgagcgagccattgccgcagaactcggcgaacggcttcccgctcgcgccggcgtagaccagtgggtagaaggtgttcagcgagtcgttcggctggtacaacgactcgccgtcgaagtagaggttgttccctaagcgcaccgtcgtgcgtatcgaccggtccatggtgctagcggcaacggtgagcatccacggtgccattgaagtcgcaggctcgcagcaccccttccacttggctggcggcggcggcatgccggcgtcgctgaaggagaggtggtctgggaacacgccgacaatgacgccagagccagctcccgagccgccgtgggatgacgacgaccaccgcttcccctgcggtggcggcggtggcgacggagcactcagcccgaggaactgcggcgtgtgcgtctncacgctctccacgctgtctccgagacgcaccgttttcgcgctctccacgctgtccgccggcgcctccaccgttgcggagctcgggagcccccagttcgagctctttcttcgccgccaccggcctccacgtccaccttctctgctgggaggacaacaccgcagttgaggccgacgtcacgcacgcgaagaagagcgcgtcaccgtcacgacggggagcgcgaggatcacccaccgaagctgccgctccgccattgccctcgcccgccggaggtcgaatgccgtgtcggcgagggacacgccgctgccggagcaccgcaaagatcgtgtggtacctgcgcgccgcccctccgtcgcccgcgagcggctccttcccccgccacccgcagctcctccccccacccctcagctcctttctcccctggcgccactccctcccctccctcctccgcctggcgctgccccgattcctcccctctgtgccgcctcccagccgcgcgttgccaagccgccgcgccgcgcagcctctctcctcccgcacgcaaccgcgccgccaccaggctccctctccctgccgccaagctctaccccttccacgctgccggccgcctcttccccaccgccgccggccatcacctgcgtctccggcatcctccctctgctgcgcgctcgtgagaagtaaagaaaaaaaagcaaaaaaagagataaggacagaggggagagatgacgtggcagcttgacatgtggggcccacgtgggtcccgcgctgactcagccgccacgtaggataaaaccgggttcaaaaccactgaaggacctaaagtgagtggttagggatatactatttctggttttgtggttgggagacgattttgtaattcgatgacaagttgagggaccttcggtgtactttttccatttatttaacacagacgcaaacgctgatatacatgtatgcatactcaccccacaaacacacatacttggacccctagggttcattgtgacctggtcctttgttccctaaaaatatgtgggccgacccacaaacttttggtgccaaatttttagggtcggcccgcgaatctaatgggccgctccgccccctttgcaggctagagccagagatgaagcgggaggacgcgtcatcgccgacgagcaaggctttggtatccatgacaaacctcgcatgacggtggcgggagcagtggtggatctaggatttaggatatggataatccgatctatttttttctaaacacaataaatctatcgatactaatatatactccctccgtttctaaatatttgacgccgttgacttttttaaatatgtttgaccgtttgtcttatttaaaaaatttaagtaattattaattattttcctatcatttgattcattgttaaatatacttatatgtatacatatagttttacatatttcacaaaagtttttgaataaaacgaacggtcaaacatgtgctaaaaagttaatagtgccaaatatttagaaacggagagagtacaatccaagtatagataatagaacagaccaaattactattatatattaacaaaatatcttaaaatatataaaattagtaattaagtaaaattgaaaaagatagataagtagaaaacctagaaattgttgtcttgttggcgcgggcggctgatcggctcgacgacggctccccgcggcgacggcacacgcacagcaggtcagcaccagtggcagccggactgcagagcagcgcagcacagtagtggccaaggcggcggagtgcgggactcgcgcgcggcggcgtgggcgtgggggcgcgggcgccgggtcgcgcgtgggctggcgcctggcggcgccgtacggctctgtgactggctgatcgcgtcgcgtgcccgcgtggaaggacgacaaggaaggacggctatgctgccaacgcgaggtttaacaccggagatgcgcgcggatgaaggaaggctcgccaccctctgcagacggatttgaaccgtactagcgacttgacaagcagccggatcaggatctccatggccatctcggcatctccctcggaaggttggccgccgccgcacgccgtactcctatatatatgcttcctctccctcttgctcctcgtcctcacgttcatgccgtcgtcgtagatgctaggtgcatacagtacttgcagccaacactttgctagtgtcacatcacacgtgctagtttaattttattgtgaatatacgtttattggttgatgaggacatcaataccatcaatacatccacgtccccccaagtacaacttcatggtcctattacccactctcgtgcacgtcaactcaataatcatgtgagttctttcttaagttcattttcctcttctttatatcccggagacgcgtgcactcttgttttactcaggaacgatgatggagaggatccaaaagggagaggatttccacgggttggattcggaccggtggacagcaccaacttctaatggtcgccacaacttcatgcgaactccgatttaggcatgcaagtacttcatggaaagcttatcaagtctactttcaaatggatctagccacatgtccgtatctgttctggagcagccgcaattatcattttagtcccgactgctttctgtccatggtgctgcgtcacctcctttgcccaatgggctgtgtatcaagttgggcccattaggggcgcgtttagggttggagcacgaccctgtgttgttcttccccttttcttatagctctagtcgccgtaaagaacaccggggttttgatgatggagttagctacttactaccggctcgcaacgcgcgtgttggctaaaccgctcgtctgcttgtaatcagaaccctaccatattgtgtttttgattgtgaaaactttcatcttcatctagcaattcagtgcttgttctacttgttcttgcttgttcttcgattgcttgcaggacgagtgccctcgtggccgggttgacgcgcaccacaagttcacggtgaccattggagacggtgtatcggttgctaaggcgcggtgtctttggacggttgtagtcagaccgtgaacgtcgtcttcatccaatcgagttatcccccacctctcatcgaaagattgggccacaaaccctagcgggttcacatcattggttgtagtttaatttgtcttttttattgtaatatgtaaaagttaaattttaagttgcatgtttatgaagtagtataccacgtattaacacgttttgtcaatttttttaacattttcgtaactacttaagtgatatacaaacaacaggtagacgtcctttcgagagtttagaatagtttctctgttacttattcacgaacgattttgctatccatctctcgtgtgattttttctatggcatttcacactttattttggccgcacgctatgcaccacttgtgatgtgagctgcagctcacggcctgtgtcagctagcccatgcgtgcaccatgatagagaaacacggtggcaaggtggcctctgaccggcgagccggccgccggcagtacggccaacgctattcggcgagcgacaccgtccctctcgtcgtcgtgaaatataaattacaatactatataactaaaattacatttgtaaatttaattgatatgacatgtaagtgcactgtaatttttgataaaaataatgtgtaagtaaatatgcatttgttattttctttaaaatataaaattacagtcctatataactaaaattacatttgtaattttagttgatatgacatgtaagtgcactgtaattttggtataagtaaatatgtatttgttattttctttaaaatataaaattacagtcttatataactaaaattacattttaaaatataaaattacagtcctatataactaaaattacatttgtaaattcagttgatataacatgtaagtgcactgtaattttgataaaaataatgtgtaagtatatatatatatatatatatatatatatatatatatatatttcgttggatgtaaatataaaggtagaaaaaatctgggtgattttttttgttagaaatcacacgacaaatggatagatagttccttgaaaagattagagaacacatgtagaaattggggattgaactcttgcattgcgatgagctcaaagagcaaaatatttgtgtacaatagatggaaaattaccaaactacccatagacacatatactaattattactactcccctgtttcatattataaatcatttgactttttcctagtcaaactttgttatgtgaccaagtttatagaaaaatttaacaatatctaaaatatcaaattagtttcaagttgaacatattattatatttttctataaacttggttaaacttaaacaagttgcctcctgggccaggtccacgagtctccccgcctagtcctttggaaactctgtggcacttgaacacaacgctaccgcggatacactgaaaactctgaattttcctaagataacataacaattcggcttcagaactagcagtgtgtttcaagcacagctcattgttctccaattccaacagaggatgttaatttcaattccaatattgatttacacaaacactgaacacagctaggtcgatacaaaagatgtccgtactgctgtttgattcatcctgactcctgagaacctgaagccataaactatgcagtagaaggcctgaaagtatggataatttgagcgtgttctggagctctgaatctttaaagacagaacatgagaatccgtcatcccaggaatctagaataacagagcctccagaatgtccagttctccacattgccaatctcaacgcaatgccactgtgcttataacaagcatgaagctgctgagacctgaaaggcatattccctcttcatgccgaactgaattccttgctgcagcaagccgccatggaccgaaaccttggactcggcgaaccagcctcggtgttctatgtgggtacaatggttacatcatgcgtttttttgtttgactgtttccatttctggtaaccacatgatctgcagcagagcccctggccggctgtagtactaaacatacttgctacaaggatacacggataagtatattatcatatattttaccgcctcgacttaaacatttggatgaactagttgacagaaaaactagtatgggtcattgataattgaatcttgctggatgatctgtccttgatcacccaagcaggtagtgatcagtattcagtagtcataactaaagaggtagaggtagatgacaatagaccggtccagtagtactggccatgtgggcccctgtctctgactatcccagcaacggccatcaggaatacgtgccttaaatccagcgattaagacagcaattagtaattattgttgttattagcattcgccttatgaatgtcaatgatcaacctgtctgctggccctgccttgccgcttgcatcgtctcagctgagttcatctcagctcagctcaatttcacagcaaagaaaaagttagcatctgattcatctcttcttctctctgaactctgatgccgttgtcgttctgtatcaagtctgtccacccactgtcattctgacgaagagatggacgatcaggagcagatgctaatctgcacatgttgaccatgagattcgtgatgagcgacgtgtcgattagggataagctgcatgtgatgatccctaattcaagaatcaaccattgcacatgtagtgtcaaattgacagtacatttctcttccactcagggttagcggcatcagtacacttgaaagtactaccagtttgctttctgccaaagctgtcgttatggtctccctctctcttttgttcatcttttggctacacactcattcccaatcactgctaatcctttctttgtttcggcattacaatcattgttatctcttcctgtctagcaagtaatttctgacgttggccaattcactgttcagagaaaccgttttgccatctgttagatactttctttttcagatatgcaagatgcagtgcaaattttgcacactcacgcgccataagtggtaatcataaaccatgccaaattgcaattagaagctggaccatctcctcgagctcatccaagcgcatcaattttgtgatctctgagaagatccatccattccaaatcagcatagtgcacctgctccttctcacagtttactaatctaacatgagcagcacaagttcctgaagaggaaagactagtctaaaagacgatatcgaaacgaaaaccaattcggaatatagtagtagagaggaggagagattgcgtggggatagcagaattataataataccgaattgatgatctgactgcgaatgcattgtaaacgccgcatgcttctgcttttttggtatgtttcctccatataaagacctctacccatgcaggtgtcactacatcagtgcatccaggacttccttctaaggtaaagtcttttctttctctgaagtgtttatcttcagactagttactacttactctctcttgttctaactactctagttttttttctctatgtccctagcttcgctttccttctttctctcttgtctagctatctttctttgcatgtctttgcattgagaagaaagaactctgtgtcagtttattggagcctgttgttttagacttgcacagcttcagtgatcaatggtcaggcatcgcgaatgaaaatgccaaaaacacaaactgtagctttttggagcttccacgtattgttttttcatgtgtggagtggttcatctcgcctgaaacgaaacgaggttctgaaatcattcagcatggacagtcaatagggcgatgcctttaaaaccaataattgctattgttctctagctgttgttctctagtgtattgtccatagtaagaaagacgaatcgctatacagttgcggagttatactgtaggtaggcttttgatgtcacaattagtggacgacaagaacttgggggagatcatcactatgatttttttcttcttcttcttcttcttcttcttcaaagatcagatcactataaataggcattgtcattctaaaaaacatacttgaggcaaggcaatgccatgacaacatcttctcatcgcaccacttgattctttcatagtagtatttctcaacgcagattgatttgatttgatctgatctgaacagtgtgtaaatggagcatctcaagaaaggagtggagtttggggtggcctccctgcagagatgccattctctgtcgtgtcaaatggtgatgctttttttttttgcaaatctttcgcgctaaaaatttcttttcttgttcacttttatgcaaaatggaccatacatgtcggctaatgctagtactatgaatttggcataaccatctgcatatatatatacatcccatgacaaaaaggaaaaatcagagaaaacctcagctgttgctgtgatcaacttggtgactgaacttatatataacttcaacaacatatataattcagcttgtatcatgacttagctaccatggtggttttgctgaatgtgcaaacaggcagagagcacgcagatcgacgagcggaagacggggaaccgatgtagcaaggagaaatcacggcgtccgaaatgctgccatcctgcagagatgccggtcatccccgagcaggcaatggagttcctctctcggacatggagcccttcctcctcggatctcttccaaatcctctctcccagtgtatgtttatatgcacacatgcatcatctgctctggaccacaccgatgattgattcagttccattttacaaactacaaaatcaagggtgttgacatatacatattaatatattccaactcaattatcaacatgtcatttccattttcatgttttatacaggttacaatttcagttctgtcaacagcagcagcagctaaaattaattatattcttctttttttaatgtttcttttgcctgaatctatagagcctgggaacatcaccggtaaaccgtcaggaagactaggtgatcggagacgaagacgttgaggtacatggggacacggttcgatttgatggaggcagaagccaagtgttcaaccagacatgggtaagccaagtgtcagccactacatgatgtagcttattatttatgcaagagacatctttctgatcttcctatgaacgatcaatttcttgctttaccttgacagggaattctagccagtgggaagtctagctcaggacagcacaaacataagaaccaacccacctgggtaagggcatatgtagcacagggagatgtgacaacactaagagtaaggtcaatagtatagccaactactggctccaaaacatctatagccaatctaatagctcatttatataatagttaactataaaaatatactacaccattaatacccggtcccacctctcatacacacataacatcttggagtatgtgttgcagccggctataaatctgtagcccgctttcttctctctcttctcttttcttctcgatatatggttatagccggcttatagcctgctattgtacctgctctaaggccctgtttggttgcagtgtattgtagtccattccaaaaagatcttatttctggctatgcacatgaataaatatttgtccaggtgcatagacagaaataaaatctttttaggacggtggcagtagtattttgtcagatttttcatttcaagacaaggccatcatgctttgtcggatctggcacagtgaagtgaattgacgaaagcttttggtttccactgaaaatgagcagctgaacatgggacacatgagggcaattctgagaggatacttgatggacagcatccccatcgccgggagtcggaggaagaggcgcgacgagctccggctgcacacggcgcaggcccacgccgccgtctcggtggcccagctcgcagctgcgatcgccggcgtcgtgtcagcttgcgagctgaggagcagctctgggggtgctggggctgacaggaagctgagcacggtgcttgcctcggctgccgcgctggtggccaccgtctgtgccgagttcgcggagtctgccggtgccgacaggtcccgggtcacctccgccgtgaaggccggcctcgacagccgctcccccgccgagctgctcaccctcaccgccaccgctgccacatgtaatcaacacttcagtggtgaaactcaaccaagtgatcgaagctacaaactcactgatgctatgatgctgagcttcttgtatgctttttccaggtctgagaggagcagctgtgctgaagctgagagcagacgtcagcagagggatcagcagcagcaccagcaactccatgatgatgatgagcaccaatacagctagcattcagaaaggcacaattctcagggtttgcctgccttgtggtaagagaccaaaccaatgatattagtaccttaaaaaatagcatcactactagtagtactacattgttatgccctagtacaaagtactaagactctgactatgaggagtactaagatagtactactcctaagtcctaagagattatatttccttccccaaaatattaaaaaaagatagtaattctaagagattttgtttcttaaaaatgaagatatatagtactcctaggatattttatctgttataaagaaagaaggtagtactagctcctaggatctagcattgagcatggtgcagcaagcaatctaatgataatatgatattggggtatttgggtggcattacaggaaggttgcggctgaggacggtggccgtcttcccggagtgcggcacggtggctctgaggctggggaagaagcgcctgcatggagcattcacaacataccagcactgtaataattaaaaaaatttacctgcatgaaccagctgaactgcttgccactagtgtattgatcttcgttctgcttgtcggtgatgatgcctgaaccctgttgtttgtgcttggtccagatgaggtgttggcagtctctggcggtggcgaggcggtggtggattgtcggaagttcttccccgtggcgctgagcacggcagcagggacggtgcagctgctgctggacaaccagatgcactgcaaggtctggaaggcttccatcgagagcatgctgtccggtcgaaagctcaagcacaccaaatgctgattaattagagccaggaaaaattgccttgcttttcttaccatgttgcatcacccctgtacatgcaatgtatgtgatgtgagttcttaatatacaggtaaaacataaacaactgtatagtataaaattataatttctttaaacatcactttccatgttcaccagataaccaaaccttcctcattatgataaccctttcttcctcgctaagagaagagaaaatattacaaacaatcaaaacagagcaaacgtgttcctaacttcagctcaccagtaaaagtatgatactaagcagcccactagcatcgatcatatgaaaagaatacagcaaaaggtccttctccataaaaaaagttacactaattcagatgtgacttgttatgttttcatgcgatgcacaggcttgcctgaaacaaaggtttggcagatggtagcaagacaaaacaagagaccagttctttctttttccttttcatattttatgttgagaaaaagaggcaaggaagaaataatggattcaccagctgggcaggttgtcatcagcattcagcagtcagactgtgtgataatgtcatcaatcttgagaatcattttcaccacctgagttgtcagcacgatctgctgctgcttgttttgttctctgatgccgtttgttcgaatgcaattgcagtcaataccatgatgaggattgctatcttgcaaaggtagttcaggaggctgggaagttacccacaatattacacaatgcttcaaaataactgatgtgcgaggatgctatataatagaaagaacataggttccttagcatatcatcctataactagagggttctctattatatagcattctatatattttcttgcatccaccagattaactaacagatagtaggcgtatgtgctggttgagttgatggcatatgaagcattttttatgagcccaaaacatactaggagtggggcgacctaatcagactaaatgtagtcaattaatgtcaactataagtctataactaaagcaacagaataaagtttaaggattaccaaaaaaaaaaaaaacttcacttgctgaggatttactgcagtcgacgtatcaaaagggggcaaaccactgttttcagctagggctagtgggatcccatccaatgcacctcaaatggcatgagcgatgtgtgggagagacgtctcagggagatctgcacgtacagttttcaggtatcagataatgatagcatactccaggtacacagacacaatcagaagacaggcagacattgcttcattttgtaacttaaatgtccaatgtcagtacttacttggtcaactccaggctgttgatctgctgcagttttaccagcaactagcatggtgacccgcgcagattgctcggctagcatcattatattttctctcatataatagcatatatgttttctcattatattattcaaatatattaaaatgatatcataattttaaattttgcaataactttacgaaactacaaatgagtaatattcatattgtattttatatacgtgttggttagtaattatttttaatatcaaattttagttatttgtaaattatatatattcctatatggactctagactcgtcttttaatatttctttttttaattccgaattttctgtaaattgtatttctatatagactttaggctcttcttctaatattatttatttttatttctgaatttttattatttttaattgtgtttctatgtggactctaaactcatctctcaatattatttaatttttaatttcgaatttcagttacttctaaattgtattcctatattgactttaaactcttcttcccatgtttttcttaatttcgaattttagttatttgtaaattgtatttttatacggactcaaaactttacttttaattttactatgtttattccgaattttagttagttttaaattcttatatggactctatactctacttctaatatttcttattttttaattccgtatttctattttttttcttaattgtattaattgtatttttatatggactctatactctacttctaatattccttatttttaattccgaatttctattgtttcctaattgtatttctatatggactctatactctacttctaatattccttatttttaattttgaatttcagttatttcctaattgtatttctatatggactctagtctcttcttctaatatttcttatatttttaattccgaatttcaattatttctaaattgtatttctatatggactctagtctcctcttctaatatttcttatttttttaattccgaatttcagctctttctaaattgtatttctatatggactctgctttttctttttctccgattaatgtgagaatttctaggccatgagagcgaacgtggaggctcctttttctattcctttaataatataatagatttataaatagatccctgaaaaaaattatttcaagaatgggttcttttcgcaatgccaacatcattagcgccgtagatcaatgtgatggtgccagctatgttggcgcccctccccttttgccttacacgcaggaggctggcattccaaatttaccatttttcatgcaaatttataaagttatagttagttacagtaaatttctatcgtgccaccaaatttgtctcctccatataatacatagctacaaatttaacttaaatcaattttttcatacaaccatccattcatgtctcaactaaaaattatcattaccacatatatgcactccaaaaaatcatagcaccaacgagcacattgtgtacatgtaacactacaatcatcaaatccccaatttcaacggtcagaatcacaaaatcgggaaaaaaaagagttctagagttaccctccgatctaaaacgcaaaaaaagagggagaatggaggatataccttgctctttgattttcccaataaatcttgtaaaaaaaatggctccaaaccgaatggatttaaggagaagaggtgatagagagtgcacgagatgcactcgagctcgggcggaagaggagggggcgaatagccggggagtggatgtacggggtggggctcgtgtgcttcccccctccacgggtagagcgtgctagggctgttggtgcacggggagggtttggcaatattgttggcgcctagtacctcctgccacgtcagtgccgggccgccgtgtggtgccatggtgacggcgcaagagaccgtccagttggacctcgacgccagcaattctagcgccaaaaaggatcattccttaaataagttttttctaagaatctatttataaaataagtttgtgaaaatgaccaaattgtaaaaaatcaaggagagtacatgacaacctcgtatacacatactggatcttgtgtttgtagacgactataaatttgtatccctctcgtcttctgtcttctccacccaagtacaaatttgaagtggcaatttttaattttcactcacaacacttgttatacttgctctaacacataagtatctgatatacacccaaaaggtatatgcgagctacaagagtggattattgggtgaaatcagtcaagccctccaggatggactaatggaattagaaacaatataattaattttggtgccaccacgagtcatgctgcagatggtaaggttagttgttcctgattctctttaattaatataactagtattatggctaattacgtacacgtgcatgtcgtggaatcaaatcaacgacaacttttgctggctagtgccaaaccggtcacaggaagaaaggaggacatggcattgacccatggtaaacgatatggcaatcgaactgcacgcactactcactgctacttgctccgtacaaaaaaaaatcaaaaactggatatgacatatctatcatagtacaacgaatctgaaaagaggactgtccagattcattatattagaatgtgtctctagtattaggttggttttttatgggacggagggagtacgtaacatgcctgctgctagctagctagctgtgggtctataaatcgtgaaaactcaacagctatgtagagaagcaacaaattaaccaaagagggtgcaatttcagtcagagtagggagaagaaaagagttagtttagaaatgaggaagcaacacacttcttctgctgttgctgctgttgctgcgtctctttgcaaggtgctcctgatgatcctcgccctcctctgcaccctgcacactgcctccgtggtcgaaggtaaatatatactccctctgtttcaaactatttgacactgttgattttttatacgtgtttaaccgttcgtcttattcaaaaaatttaagtaattatttattcttttcatatcatttgatttattgttaaatatactttcatgtacatatatagttttacatatttcacaaattttttttgaataagacgaacggtcaaacacgtgctaaaaaaatcaacggtgtcaaatattttgaaacggagggagtatttactagtactccgttcgatcgagttaaattaactttgtgggtttgtgcatgctgcatgttatttataaaattaacgagtagatcgatcagtgacatgctatacacagtgttaattgggtgaatgaagtgtattgatcacatgatatatggatgcagggagatcaggtcctccgaacgggccgccagctcctagtgccaacgaagagcggcacaatacaccggcctttcacaactagctagcttgatataacagctgcagactcaccatgcatgacaacctacatacctgcagctctctatacccatgacatggcatgtaataatatgtgtgtgtgatactacgtatgtactgtttctgttgccggatcggatgatgatcgatgttcaacttactctcctagctgagtagtcccttaatccttttcatctctttgtgtaactagtgagcaaaggaaaattaaatatagggatctcatcgatctggggcttctccatgtctgtcaagagcttgtgtagatcgagctgtgtgatggtgttaatcctgggaggcacactatacatacgaagagttttaacagagatggtaaagagaaggcccggcctggcctgactaatgggccgtgcttgggcctattagcacggcacgacccaacaatcaggggggaccctaataggcgatcgatcgccctgaggatggggcagcgatcgatcccctccccctcccttcctctacctgattttcttttttggcaccgcattactttcctattttagtaaatttatacacttaaagtttatacacttcaactttacacatctaaagtttagtgaccaaaagtttataagtcaaaagtttatatatccgattcaaatttgaattttaattcaaatatttttttatatatagtatttctatacatctaaagtttatacatctaaagtttatagacctaaagtttatataccccgtttcaaatttgaatttgaattatatcttattcaaatttgaatttgaattcaaatattttctatatatagtatttctatacacctaaaagtttataagtcaaaagtttacatacccaattcaaatttgaatttgaattatatccgattcaaatttaaatttgaattcaaatattttctatatatactctttcttcccataaatgtttgacaccattgacttttttaaacatgtttgaccgttcgttttattcaaaaacttttgtgatatgtggaaactatatgtatacataaaagtatatttacaataaatcaaatgatagaaaaagaattaacaattacttaatttttttaataagacgaacggtcaaacatttttaaaaaagtcaacggcgtcaaacattttgggatggaggtagtagtatttctatacatctaaagtttatacacctataaattatagatctaaagtttataagtcaaaagtttacatacccgattcaaatttgaatttgaattcaattttttaatatatagtatttctatacataatttttctaacttttgtttttttaaaaaaaattgtggtgtaccgtagtaggaagagaagaaggagagaaggaagggggagaggagggaggagtatagggggaaggcacagcgcggggcgatcacctgcgcattagcatttcccaacaatcagggagacaaaatagatttattccagccatgtagacatggcccaaagaaatgagggactcaaaataaattattccaacaatataagacacggtctaaagagataagaaaagcaaaataaacttattccaagacgaacacgatgggccagtcgtgcttttgggccggtacggcacaacccacgccttattggactgtgcctaagccacaggtacatcctgtggcctagcctggcacgacacaaagagtatgccaagctgccagcccgacataccttaggccgtgccgacccgatatgccttaagctgtgctctagtcgtgtccgagccgtgccatgtcagcagctcatttagccatctatataactagccaagccaagccaagctagctcattattttaacgagccatactgagctaagctagctcgacatccatctctatcaatggtcaagtgcaagatctctcggtgtcagcaaggggaaaggctcatgcgcgcgggtggggccgaaaactgcgtggggagtgagtggagactgattgagagtgacggattgtaaaaaaaaaagaagagagggacccaccacggctgagaaaaaaagtactcccttcgtctaacgttttgactttttatttgcacgtttaaccattcattttatttgaaaaattagtgtaaataaaaaaaagataagtcatatgtaaagtacttttgataataaagcaattgacaaacaaaataaataataatttcaaaattttttgaataagatgaatgatcaaacattaacaaacaaaaacttaaaaagacaagtaatatgggacggaggtagtatgacgattggaaaattcggtatcttttaagttgggatagatgtaacagtgatgtcggtcaagccttcacgatggacctatggaatcgaagtagcaacgacatttctgaagtttggcgccacgcaataatatcttgcttgaaatttgtttactgtccatttctgatcaatttttccatgccagcgcgcaccactggagaagaaggggacccgctagcaagtgccaaattggagccggaaaaagagtgcccattgacccctggtaaacgatagagaagtgagctgcagccgctataaattctgaacccaatatccggtagagaagcagcaacacagcgagagagtgcaataatttcttcagacctaccgacagaaaaaaaaaagagaaagatgatgaggaagcaaagcagcagctccacctctcgtgctactgctgctgtagtgtcgctttgtaaggtccttctgatggtcatagggctcatctgcgccctgcacactgccaccgtagaaggaggtaaatcaaatactccctccatttctaaatagcttgacaccgttaattttgtattacatgtttgatcgttcgtcttattaaaaactcttgtgaaataagtatatttaacaatgaatcaaataataggaaaagaattaataattactttaatttttttataagacgaatggtcaaacatgtttaaaaaaatcaacggcgtcaaatatttaaggacagaggaagagaaagtattatacatacatatccgttaatagttaacatttgtgttagctgcatgttgttaacgaccacatatacggtactagtatatatagagtaaattaacacagctaactaatgaatggagtatatacatacatatatatatatatatatattatatgtactatttaaaatcacatggtgcaggttagatttcagatccagcctatatatgtttagtagtgatatagatccgttgcaatttgtaatgtatctaacatatatatatttttacgagggatgcaggaagagcgctagcggcagcggcagttggtggtactggtgtggacttgccaccaactgcaccaagctactccagcaagtgcagatatccctacaaatgcccccctgcaggctcaccatgacaacctgcatatgctgtgctctagcgc

SEQ ID NO: 73379 - DNA, 23790 bp, Oryza sativa
  unsure (1)..(23790): unsure at all n locations
tctcctcctcgtgtgttctcctcgccgtacacccacgctgatcagcaccgcaaaccagcggcgcctctaccattatccacacgtatagggacggaacgccacgcgcagatgtgctagcacccgcgcgcggctagggttttgctcgaggagggaagtgacagctagggtttctcacgtgatgcaatgtctccgccggtcacacccctcacgaatatataggatccatcactcgggccgatccatcactcgggcctccaaggcccgtaggactcctattccgatccctatccgaattaagctcatattggatctccatccaatccccttattccagcccattaagcgtgcaaccctgtaggttcatatatactcggctgtaacccgaaaactccttttcggtaacatgtgtcttatgttggctcttgcagtgtctcatgttgggtctatccaacaacatgttcactaacatgtgtccatgattgaaccattgatcttaaattctacttgagcctaattaaatgtaggctcagatcagatttcaaattcttcatccaatttgaaacagaaggctgaattccttcgaagatgagtccatttctttctttccaaatattccaagttgctaagaggaaaatctccatgaaacactgatacgtgaaagccaaacgctgagactgaatcatttgatgtaactccaatgaagtgtcccagacccaaccaattttgatccaacatgccttactgaaatcacaatgaaagaaaatatgttcccttgtttctcttgcatcaatcaaacatgttgaacaaaagaccgaagtatttggaggagcacagtgctttctgtccagtaggtctctagtgtttacccgatccaagagcagaagccatccaaagaccttaatcttcatattaactttacattgccagatccattggagtgtcagtgggggtgtcagtgaccaaaagccaatcttatagaggtgttgcgaagtatacattgcagacccccaaatatatgtccagccatcatttacatctaaaagggcagtagtttggacatcagccaagagaacattgtactcatccaaagcctgttgagacaatggcaagaagaattgatcttgaggttctctcgccaagtgctgagaaacagagtcttccttgtgtcttgcaaacgagaacagccttgggaatttgacagatcttaccataccattccatagatcatcctaagattggtttagcaattcctttgaacaaaacatcaaactggaacacgtccttccaccaaaaagacccacagcttctagctgttttaggaaccgagttgggataataagttgtccagattaaatttacccatgggacctgagctctattataaaatttgtgcaagtgcttcatcagaagagctctattttgaattttgagatcaataactccaagacctcctttatctttttggtggaattaagatcatttcctctccatagacaatgtcttctggctctatcaattgattcaatcactgagactgggagtgataaatagcacatatagtaggttggcagagatgataacactaaattaaccagtgtaagtctatcaccatatgaaaggaaagctgagcttactgttaaccttctctcaatcctgtcagttagaggggaaaaatccaccacctttggcttagtcgttccaagaggcagacccagataagtgaatggtaaggagcccaatttgcagccaaaagtagaggcaagatgattggccttttcttcagtcaaattcagggatcatacatgacttggagtaatttaccttaagccctgaggagagtgcagacgaattaagcatggcctttagggcaaaaagttggggagcagaagcttccaagaagataagagtgtcatcagcatactgaattattggaatgttctcatcaccaattacaggtataggaaacttcaggattcccctaatatgcgctttattaatcaaagactgaagtagatctgctcccagggcaaataaaagaggggataaggggtcaccctgtcttacatctctcttgcatttgaaaaactttcttagtactccattcaatagtataggagtagaagccgaagaaaagattttagtcatccactcattccattgagaagggaaccccatagcagtcatcacctttaaaattgtatcatgctcaattgtatcaaatgctttctcaaaatctaatttcaagagaactatttccctctttgaatgtttgaactgatgaatgtactcaaaatcccaagctaagcaatcttgaattgatttcccctttataaacccatactaattttggtgcaccaacttggtcatcaaaatttggagtctgtcagcaaaaattttacaaagaatcttcacagacaagttcatcaaagaaataggcctgaagtcattaggggtttgaggactagtcttctttgtatccatattattaatttggtatctctataccatgatccatgagacatgatcatcaattaatacatgtgctgatcatctaaacatatttgttccacatatgatatttgatcagggatcctttagaaatagtaatacacaacataaagagtctcatgaatgaatcacatattcattaaccaataatgagtttatctatttcaaggaacaaaatcggataaatatgtaaacatagtgtgtgatacaatcatctctatcattgcctctagggcatatcactaacagccagctccctcagcttcacttcctgtgcagcgtccactcctcggcgtgctggagccagaaacggaagatgaggcgtctgtcgtctacggcgaacagcccgattccgccggaatcgcgcgccatctccatgactgttaagctccattctttgttgtacacttcagctgacacccgcacatacctgggtagctccaccagcgatcactccatcgtcttgtgtcgagcatcggtgattaactaatcattcattttcatttagtttccaataaaatggcctagcattgatctgaattggctcttatctttatacattagatgctcaattatcatgtcttcatgcttacgaggtttgttttgcttagcatagtgttgcaaaagaaaaaaatgattttctttcacatagaatatctacactcggtatgccatcattggtgagatttttttagttttattttcccatgcacattggtgggatggaagttcagcactactggtaataactgtttaatgctttttttgatgaaatgtaatctacaggtttatcacattccatatatgtctagattgacaccgtgttatgttaattagattcagtaaagaaaaaacctactgggtaaactaaattgatttgcacggatttcagttcatgtaccaaggttctttaaatgaaattctgtgttaaatttggatatgggatgtggtaccttttctcccagagaatacttcagtataatagctctttttcaaatgaggtaatgattatcagaatagttttttgctttcctaaaaaacttatcagttatagataacacatgtatggagttgcaagttgcagtgagcaattgtctgaaactgaaaccaaggcataatgaagaattcaaatttcaaactgcgctaagccctattcaccaaaaataagatatgctacaaatcaatatgtaccgaccgtccattcctcatgttcaacagcgaaaggaaaacaaggtttaactgttgcttttgtttatatattagtattgtagcttccatttatatatttagatcatgaaactcagtgtatgttgactacccaaatttgatttggttccatcaatccactcaacataactaggataagagtactatgcttcctgctctacaacatataatatggcccttctagcatactccctccgtcctataaaaaatgaatatagggccggatgtgacatattctagtacgatgaatctggacagatgtatgtccagattcgtagtactaggatgtaacacatctggtactaggttggttttttatcggatggagggagcatgtactattccctccacgctaaaatataagtatttttagcataatatcaagtcaaacatttataactttgactattaatagcaaaaaaaataaaaagatcaatcatgtaaaattgatgttactggatttaccattgaacaaactatcaaaatatgcaactatttttatttaaaatatcttatttgtatagatattgttggtcaaaatagcatctcaaaggttgtgttcaagtaaaacaaatgcttatatatttcgatggagggagtagaatatacaagctatagtgttacttttctttatgtgcagatttgtacggcaattattctatacatctagaaattgataaaaatggaaggaatatgtcatatatttcataaatctaggcttagaattcattttcttttttccaatatgtgcacattttgtgctgccttcaattggacgacttaggtttatttctcaaataatcattatttgtaaaaaaaagattttttaaatttatttagttttttaaccttgttttatttgttttggtgtgtcatgaatttcaagtgcctagatactaattaagtgtcaaaacttctcattgttagatttcttgtgtttataatgaattgcaagtttatgtaaaagcttgcaacatggagtaaatatatcttggccatgagaattttttcacttgcattgttgatggttttaataaagatattctctaatctttattatttcttattggtactacatatctgcaacacattctttgtagcgcatatttttgtgtccttgaagtaccgttatgcagctctctgactaaacgtgttacaaacgtgtcctggtatagcacatatcatgtactgtgctatctatcgttacacagttcttaacgtgttacagatatctgttacaataggcctgtcttgtggtagtacagtagaacaaattaaagaaaatacacaacatataaataacggaccacacattgcaggccagagatttagtcactctgagtgctcttcaaaagtcagttataatatatatactttgcgtccagcaatggctaccattactaacaaatttgggacatacaaaaaactatcgaaaccctaagcttgccatagtgacaagtttaagttggtgtttgcagcaagaaattctaactaaacaatttgtttgttttgacaaaacctaactttttgtataggtcggctacaaagcgttttcccaggcggtcaatcggatttttgcgtgcacagcttcggcccgtctggaacaaatcgtctgggaaaatcatgattttcgtgtgcgggtggcgcacccgcatgcgaaaaacagattttcgcgtgcggttgcttatgacgtccgcacggaaaaacaaaaaaccaaaaaaaataaaatttcaaaaaaaaaagaaaaccctagatcgggtcatcgccgcggctcccacctcgttgtcgtcggcggcggcgtcgctgctcccgcctcgtcgccgtcggcggtggcggcgacatcgcctcccgccggcctcccacgtcggatccgtcacggggggagggcggccagcagccggatccgtgcggggacggccgcgggccgcccgtcgtcaccagcccgcccgccggatccgccgcccgcacgctctcgtcgctgccagggaggggaggggaggagctgtggccgcccgtcgtcaaccgcccgccggccggatccgccgcccgtgcgctcccgtcaccgccggggaggggaggagccgcgaccaccagtcatcggccgcccacccgccggatccgcagcccgtgcgctcccgtcgccgctggggaggggaggagccacgcccgcctgtcgtcaccccccccgcctgtcggatccgccgcccgcgcgctcccgtcgccgccggggaggggagaggaggggagggcacccggttcccgccctggatccgtggcggggggaggcggcccgccccccggacccatgcggagaggcccgccgccgccggatccgtgcgggaacggccgacgccagccggatcccccgcctcccccgccgcgccatcgtcgctggtgccgtgccgccaccgccgctgccacggatgccgccgcctccgcctcgcttaccgagggcgcgggcttcgccgaggagggagaggggatggggaggaggatagagagagggagagggagagggagatggatggagaggtggttgggagggcgagcgcggggggagagaataaggcgagcgcgtggggagaggataagggtgagcgtgtggggtgggctatatttgtgtgcgggccacttaacaggcccgcaggcgaaaataggcttactttcacgtgcgggcctgttatgtggcatgcacacgaaagtagattttcctgtgcgggcgacgttctgatgcccctttttcatttttctgtgcggttgcacttatgggccgcctagaaacacactagtctagtgtccatgaaaatttttagtgtagtagtgttagatgttaattaattattataactaaaagcatatgtgtcactagttagcacatgcatcaatcccatagaatcaacactattaattatgtcgaaatactgaactccataattttcataagagaaattaaaaaaaaagtatttcttccacgaagtaccaaacttgtcacagaagcaaatgactgaaatgtccagggaaatcttaacttcttaacttcttaagaataccatggatactttgtgattatgaattagtttttaaagcaaaaatatagagcccaaacatatgatctagggagcacatcaatgccttttctaaagatgcatcttcgagtagtcacattgactacacaaaaccatgcggaagctgtaagggggattctggacctttccctccagaggcagacgtaccagaacctgtgtaaaaatgaaacaagcatatttaattaattagtgaacaagaatgtatatcttttctgaaacaaactatatagatctgcaatattttcaaatgaaacagtgcaacaatcaaatatatagcaatatatatagatctaataaattgtagtttgccaacagaatgttctttatcgcaaacattaataattaaagaagcacacatgtctcaaagatagaacactgatcttttcagaattagttgccagtgcaaccactcacaggtggaccaaacacaagcttaaacgagattagacatagctcaacacaggaaaataaaagccatcctagtgatgtgagatctcactggtggagaaaccatctttcgtcggtcggcctaattccacaatagtcccgattgcaaccaaaaccgggactaaagatgatctttagtcccgattaaaaagggtaacgggcatatttgatattttgtcccggttggtaacaccaaccgggactaaagatcatcttttgtcccggttcaaatgctgtcaggtcttggcaggccccctcgggatctttagtcccagttggtaactgcaaccgagactaaagatcgtaactttagtcccggttggtgatcccggcgatctttagctccggttcataacaccaaccgggactaaagtcccacccctatatatatatcttcttcctcctccagcccgagcaagcttcaaaatttcttcaaaaaggaggggaggtcatgccaaaatttatagtgaatttttttttgtgattatatacaaatcggaggtgcctaaaaggttagcaacttcatcctccaatgtttttttgtcgtatgacatttggagctatgttttgcacacttttttgtctccaaaattttgttgttagttgatgagagagaaaattagtgtggggaagaaaaaatatatagaaatttagtttatttgctaaagaaggttttataaaatagttgagaaggaaaatatagtgaaagttaatcttgaataatagaaaacaaactaaaatgaaaaattaaaataattacaacacattaatattagtttaaaactttataaatagtaaataagaattatttggtgtaatatttcataatttttgtatgaataatgatatgtcattattgtgtgactgttgaaagagtatgtaattattttataattattgtatgactgtcattattgtacaaataattatttatgtacgattttttttcatgtcatgtagatggatcggcaatggatgtacgctgaccggcggtccaaagagtttattgacggcgtgcattattttttgagagtggccaaagctaacaggcaaaacggttttatttgttgtccatgcaataagtgtaagaattagaaggagtattctgcatccaggactattcatttccacttgtttgagtcgaggttcatgtcaagctataattgttggacatcccacggagagcaaggggttgaaatggaagaagatgaagtggaagacgacaatattccggactttgctcagtacgctggatttgaaggaaatcaaacgggcgaggcggaaagggatgctgatggtaacgacgttgcggatgatcttggtcagatgttgcaggacgccaaggaggactgcgaaagtgaaaagggggcccataaattagacaagatgttagaagaccacagaacatcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccgagacaacgtatgaggctaagaagatagtctgccctctaggactggaagttcaaaagattcacgcatgtccgaatgattgtatcctatatcgcggtgactagtacgagaacctagaagcatgccctgtttgcaaagcactacgatacaagattagacgagatgatccaggagaagttgacgggcagctaacgaagaagtgaattcctgctaaggtgatgtggtatttccctataataccacggctaaggtgtttgttcaggaacaagggaaatgctagaatgatgcgatggcacactgaaaagcgttaacaggacgggatgctgagacaccccgccgatggttcgcagtggcgaaacatcgacagaaaatttaaagactttggaaaggatgcacgaaacatacggtttggtttaagtacggatggcatgaatccttttggagagatgagcagtggccatagcacttggcccgttacgatgtgtatctacaacctccccccgtggttatgcatgaagaggaagtacataatgataccgattataattcaaggccccaagcaacctgttaacgacatcgatgtgtacctaagaccactggtcgaagatcttaaactgttgtggaagaaggaaggtgtccccgtgtgggacgaggacaaacaagaggagtttaacctacgagcgctgctgttcgtaaccatcaacgattggcctgcacttagcaacctatccgggcagtccaacaaggggtacaaggcttgcactcactgtatggatgaaacagaaagtacatatcttaagcactgtaggaaggttgtgtacatgggtcatcgtcgattccttacagcaaaccacccggtacggaagaaaggcaagcactttgaacataaggcggaccaccgtacgaagcctaaacatcgcagcgggaaaacagtgtttgctatggttaaagatcttaaagtagtgtttagaaaggggcctggcaaccagcctatagagagcgaagatggtcacgcggcgatgtggaaaaagaactctatattttggtagttaccctattaggaattcttggacgtccgccacgcaatggacgtgatgcacctcactaagaacctttgcgtaaaccttcttggcttcctaggtgtatatggaaagtcgaaagatacactggaagcatgtaatgatctgaagcatatggaacaatgcggtgaccttcatccggaaccaaaggagaaaggaagccattacttgagtctagccagctacactcttagcaaggcagagaaggaaagtatgtttgcatgcttggagagcttcaaggtaccgtctggatactccatgaatataaaacgaataataagcatgaaggagaagaagttcacaaatctaaagtctcttgactgtcacgtgttgatgacacaactgctaccagttctaataaggggtatcctcccagacaatgtccgggcaacaataacaaagctatgtgctttcatgaacgcaatttcacagaaggtcatcgatcctgatagattagaagccctgcagaatgatgtagtgcaatgtcttgtcagctttgagttgatatttccaccttcatttttcaatataatgacgcatctgctttgtcaccttgtcaaagagatcggtattctcggtcctgtgtacctacacaacatgtttcctttcgagaggtacataggcattctgaagaagtatattcgtaactgttctcgtccaaaggcaagcatcgccaaggggtatggaacagaggaggtcattgaattctgcgtagaatttatcgaagaccttcgcctaatcggggtacctgaatcacgccatgaagggagactacggagaaaggggactctcggaaggaaagcaataatgatggtagacaacaatttattccgtaaagcccatttcacggttctgcaacaatcttcattggtggctccctacatcgaggagcactaggctctagttcgtgccagaaacatcggtgagtgcgatgcatggattacacggcatcacattgatactttctccacgtggcggagacaacatctcatgggtaacgagacgattaaccaacaactggtcttactggcgaggggaccatgtggcccccacaccgggtccccacgccgccgacgggccaagccacggctccccgacgccagctgcgcgcccgcacgccactggcgngtgcgcccaacattgccaaacgtgaacgaatgtgattgaaacgtgaccgaacgtgaacgaacttgaacgatacgtggacacccttgaacgaacgcttaacgaacgtgaacgaaaagttaacgaacgcgaacgaaacgttaacgaacacgggtaatataatgccatctattccaaagtcgcggggaatctattgctattatgttgatctcaggtaataattaattaatcatagcttgcaactgcaaatgtagggcttgggatctgttccgtcaattggtctgcgggacttggaaagaaaaacttggacggaggtttcattttccagtgagtacatgcatgatccaaaattatattgaattgaatctctaattatagttaatataaagagtatattaaatctctcatcgtttctcatgtagtgtgcaaagcaggatcagggaactaactgatgcggctagtacgtatgcgagtatgcccactgcctatcaaaccaaatatgcacaacacgagagctcgatgtacgtatacataaaccattcaaaatttcattgcgtatcgatttgttaagttgtttattaattttatatactgatacgtcattatttttcgaatgatagcgtattcacatgagtgataatctcccacaaaaggattttatcacggctgttcaagaacaactgatgggattcatcaacgaagaagttcttaatctcgatggtgaattctactacgacggatcgacaattcataacgtcggtccttcctcttctgatataacgccgccgtcgaagtcatagctataactactgagcaaatgaattgtactatatatgcatgtatatatatatttatatatgtacacatttactttagtgttaatatatattttggtaacatatatgcacataaaatgttaagtgctttaaattatacatatgtgtgtgtaattatacatatgtattgttacatatgtatgtatatatatatacatatatatgtatatatacatatatatatatatgtatatatacatatatatgtatatatagatatatatatatacgtatatacacatatatatatatatacgtatatatacatatatatatatatatagagtatatatacgtatatatacgtacgtatatatatatatatatatatatatatatatatatatatatatatatatatatatatatatatatatatgcaacaaacaggtacatgcaaataaaaaaaatggtgcaccgatctttagtcccggttggtaacacaaaccgggactaaagatggttgtggccgcccacgtggatgaccgatttttagtcccggttggtaacatgaaccgggactaaaaatcgatctttagtccaccggaactaaagatagctatctttagtcccggattcgtagtcctggattcgtagtcccggttggacaaccgggactacaaacgatttctccaccagtgtctgcggcggacccacatactctttcaaccacttgcagctggttaaaaaaagtttcatcttgtatttgtttaaagagtgaaatttcactttggggcacattttatattacccaagtttcatggaataaaatgaaaatatatatagcatatatatcattctgattcatcatccagagctaacaatgagtagtaaatatttttaaaaaaaacaacaatgcgattctgttatgaaaagcacattaattacctgaatttagagccatcgtccttgttgtacgaggtctaccacgaccgcgacctgtgtgcgcatgtcatagcagtccgattcagtgagtaacgtttccccatagcatgcagttacgaaattttagaaaatatatacaagctagcaagatgagcataatctaaaatatcatgattgttacaaatgtagatatatataaataaatattgttatatatattttttctatttattgtttctgtcagtattactgattcagttcaatcaaatatatattttaatcatactgcaggtctacccgtatataattcatctaaaacaaaattcatatttgccaaagtcaattattagtaaaaatgaaatggtattcctatggagttattaattccaagctgcacagattgatgatatcttacccctgctaggaacacttgcatcagcagatctctgtacagacacaatgtatgagaatcagtatcaaatttggaaagagaaattatgtagaatacaatatttgaaatcaactctgttgtagtagggcaccttctgtagaatacatggaactttacggattataaccttcccagtatctagaaaagatttaacttcaggctttgagcgaaatttatgattgtaatccttgtggcggtaatactgcgaagtaagaaaaagttcaatttcacttaacatacgaacaacaaaataaatttagtataagcaagtatatttcagcaatatccaatctgcattttgttttcttttttctttgattggaaggggatgggagggaaaaacttatattgccattgcatcacatgtatgaccctagctaggcacccaaagctaggtgcaattaatgattcacagtatagaggttttgatccaaattaaatttgtgatgttctcgcttttcatattgatagaactgataagtgagattaatgaattagcaagaagatatattattgatgggcaacatactttgttttgatagtgattatatgaaaaataaataaagtcaaatatattatctgtatgccaattatactaaaggtagctatcataaaatagtttggttttgtacagattacttttcctaaaatgagtcctatgttttcattgagcattataacacagattgtgaacactccataagtgatataacacttttttcactccacacaaattatcatgtcatataaacaagaatatgttttaaaaaggaatgaaattttacaaaccactcaatcctgccacaagttattactaggtaaagaactatgcattcccatggttcaatgtaatatattggccatatgtgatcatatggcaccagatatatgctatcaatgcaagttgttaattaccatgattcaactgtagcataagaagtgtttttgctagacaagataaaacttaaccttcagatttaatgaactactgaatgtgggtaatactcacaaccaagaggtgtttaaacactaaacctgtttggatttgaactattccaagtttcatgttttatattctagatatacaaagtataaatgttttagaagagtacacatgtttggtttaacacaaagaaataaataatatatatatagcttatttttcgattattattcgtttagggtaaacatataacacccaacggagacttttatgtcaaaatctcttgtacattttatcattttcagccgatctctaagatttctatttcatgtgtacaatcacaagtacttacagaaatgttgatgctggtaagatatagaatcatatgtattacttgttatatttatgatagggctggttatctttccctaaaataatgatatccaccctaacgaagcacatattaaaaaaaactgctttcatgatatactcataaaattgggaaagaatacatgtaactctttaatttaatcaattatgaaaattcatggaacaaatataatcgatcaacatataacatgaattcacaaaccttgtccttggttttttgatcatttcgaagatggatctcgacgacccagccatctggatcaacctcatgttttctgggatgaaccttccatgattcaggaatatccttatttgttttcgcttgtgttttctctgaggacaacaaaaacatcccagagtttgcatctcgctggtgaccactatttgctccataactattgccaccacttagaatcctctgaaagtatataaccattgagaatcatcaaccgtccttcattacaaggtttcgtgaatgatttaaattaattcatgtcataggaaatatatggctcaaacatcactgtgctggtctacacttgagtgcatatgattctctagaaatttcaacgattgtatcttttttatatttacatatgtaataaagatgttgaaatacatgtcagattgcaggacaatttaacataaataatcagggaagtaaaaaaaagccatggagcataatcatgtcgtgttagttttagagaaaaagtgagatcaaaattaatagattagagttgcttatttcgcaggagatcacattgagctggatggagagaataacttagataaagcaccatttgtttgttattctcatcaaaactaatggattgcaattattttagtttgatgaactataaaaagatcatggacacacacaaaaaaaataaggatatgataggaattcacgaacctcaggttgaaaccttgcacttttctgtctttttccttctgggctcaacccagaatctacatctgagaaatggtgagaattgccagcactatttgcgatcttccctaagccagcacttccagttctctcgctatcggtttctgaatgatctgcttcatggcgattagccttacgagaatccacctcctgatcaccatgaccaggatgcacaaatattccgaaataatcatcggtgacagttctctcactctcactgctactcttgcttccatcagagccatcatctgaataccacgcgttagctcctactactgcaacacccttgcctttgccaccagtagaagatggaagacctgatcgtttcccctccatggctgccctagctaggtctatagaagcaggaaacaagaagagaaggggagagagaagagatgatttggagaagaagagaagattcaactaggggtagatccaggagaatatatatatatatatatatatatatatatatatatatatatctatatatctgagcacgttcatatatatctatatctgagcagcaaatggcaagcatttactgtggtgaagacagaatgtgcccgttggtgacattgaagtagtgctgctgaaaatggctagcatttactgtggtgagcactgaacaggttgttccagaaagactgtaaaagctttaattagaaaatagctaaatgtcaaataataaagtgggaaactctttacacgtgtgggtgtatccagcacaagaaaacaagagtttattgttgttgccaaaaaagtattatgggacgcgttcacactatatatataccgtttaaagctactttcttcattgccgctaccaaaaatgcaatatgggatgcgttcgcacaatatatatataccacttaatttgtacaccctttgtcccgaaaaaccacttctgataaatagtctatatccagatagatagataaaatttggtttttttaaaggatggaggaagtatttaggccatcgtcttgacgatctagacaagatcaagacgttataccatgggttatcgtccagtttagggcctaaactggtgaattagaccgtttgatcatctaatcggtcaaatattggtttaaatcgtgtaagcctggcaattagacaacataaaaacaagtgttgaccataaaattgttatctagatcatagtctaggtaatgaaccaatgcactgttggtatgtcaggagaaacctggtggccctcccaaggactatatagctaagggttttaaccccagctaaaacccttctccactattcttagacatgtcgttctcacgaagtcacgccgtctctcctcagctagttgtcatcgtggactttcctcccacctccctctggcccatgactacaccagtagcttccctcatcctagcgtcgctagttctccatcctccctcaggcccatgactacgccggttgtttctcttataccagcatcgctacttctccgatattttatgaaagatgttaagtctacctatataatcgtcaaaaaaatatgcctgttgtatgttgtacaatatatcgtacagaccgtctagacttgcgcctagactgtctagactctagaccatgggttattgcccgtctagcgtcagtattttgttaaactagtggcgagacactagtacaaaagtaatttgtccagacgggccaaaagtcgttttcgcgtgcggacctccggctcgtctacccggaagggtctacgaaaatctaatttttccatgcgggtggtgcacccgcacaagaaaatcggttttttgcgtgcaggtgcttagttcgtccgcacgcgaaaacaaaaatccagaaaaaaataaaaccacaaaaatcgccaccgcggttgtgctcctcacgccaccactgccggatatgcatggattcgggcaggggacggccgccatcgcgtggtctgggtgggggatggccacctccactggatctgcgcagggcacggccgtcgccactcgcccaccgccgccgccgtgctcatcctgccaccgtgctggatccacgcggatccgggcgggggatggccgccgctgccgctgtcgcccctcatcgccttcgccgcattcctgctggcctctgccaccgtcaccccttgtcagctcgccacgcttccatcggtcaccaccactcgcccatgccgaaagagagtttgagagagagagagaggagtatgaggaggaaagggaggagataagaatgaggtaaggagagagagagaggggacgagttgaaaattttgaagcgttaaaacaatgaaagaggaggcttgacttctgggcggacctttaagaggcccgcctgggaaaatatattttttcgtgcggctgcttaagagggccatctgcaaaaaaaaattttgcgtgcaggtctcttaaggagacatatgtgaaaataggggggaccatctttctagacgcggatacttatgatccgtatgcaacctattgaggtgctcagtagtgagaacagccactggtttctccaaaaccactacccgctacagtggaatttaaacttgtccgtgaaaattatatattatgctgagtgcacggcaaatgcaattaggagatagcaaactcatactccctccgtttcacaatgtaagtcattttagcatttcccatattcatattgatgttaatgaatcttcaatataaatataggaaatgctagaatgacttacattgtgaaatagaggaaccttcacacactctttcattgacacacaatcggccacaccattgctgatttgcgcagacctcgacatagatccaatctatgctaattgaattagggtcttgcctcacttgagagcttaaaccggtataaatctgtgtcaccatctctccttgatcttttgcaccccataaattacattgccgatcataaaaatcgacaatgtgtctagccatacaaacggcttccattcaagtgtgcatgcaaagattttatttatatagagggcgtcaggcgaaaaaaattaaatttagaggaaacccccaaaaagattaaacaaaataacataataatatctcaatgagtggattcacattttcctttagagagtactggaagttaatggtagtactagtaattgtacacttgcaatacgcatcgcagttgaggagttgtgtgccataggagtagagggagcgcaggagtagataatagaggaatatatgcactggtaaataaaaagtgcaaatctatgccggtgctcatcattgccaattactgtgtcagtacctcaaaagcggagtggcagtgatagctagtccattcttatatagcaccggcataattaatggtatattcgtgccagttctaatttttttcacctcgaagctctctgggtgggcgggaagatttatggcattagcagtggtaatgcaccactgactgataaagagaggttaagtgtggatgaactccactgaggaaaccaattgtctagatcaaaggaaatagatcggtcggcggagttgacatcccatcttgcacgccgcacgagacaccacagaggacaagaatgtgtgcatggcgcttagatcacaatgctatgtggcagccaagtcagatggctcgcaatagtcaacaggtaacctggtcatctgtgcgacaacactgcatggtagcagacagcaagaagaggaccagaggaatgagcgagcaacgaggacctttcaactactagctcacgaatgatggctggtgtctgtcagtgacaacgaagcagtgttgctcctcaggttcgcaacgagatgagtagcttccgctggggctccggcttaatggaggtgacaaccaaaacttctggtgtatgtgaaaaccggtgttggggttgatgatgaccggaagcgctccaatcaacggcggccggcagcgtgaggcagccgacgtgatggtggctttgggttcttgctgaaggcaacactctggagtctggaaccattcggcttcaatcaattatcagccaggtttccttgttattcttcggtgactaaggtggtagcgatgcggcccaatgaagcttcaatcaacgaaggattcttggctggatttagctcaggtgccaatgttagggttgtagggtgaggactgggttctaggcccgggatctccatgagaagagttgcggggaaggggaggggggaggggacaatagagagaggcacgaagaagctttctattaacctggaggagatgaggcagcgacaaagtggggctgtgcaactaagtgtgcaagcggctacccgcgaaagctcacttataggctaaactaacccgcgagctcgcttattttgacctataagtctgttcgcgggtgacccacttacacccctattgcagacatgatagaagcacggtcttcgtgaggatagtgggggtgattcattgccgatttccgcctgatgatagaggggagatgttgagaagacggcggcgaatgaatctacaatatttgaaagcaaggaagggatcggagcaagcggcacggatgcagcaacacaatgggatcaacagttggcaggtctcccagccagagttttggagacaaaccttaacatgtgatggttccacatatcggcaagaggggaaacaatgaccaagctttggcagcttcgctgcaaatgtgccaaaacagcccacctctgttgcagatgggttgaagcagagacaggtctgctcggagagatggagaggctgagcgggacatgggccagatacggtcgatcagaaggatggacaggaaacaagagagtaagttcattctagctccctcaatttgtcgcccagtctgattcttacccttacctcaaaaaccagacacaacccatccttcaacttacaagaccagtgcaaatgagatctctcgacagtattattctaggttttagctgacatggtgcttacatagcttctttgactaggtcttcgtaccacgttccatcaatgtagcgcctacatgacactttgatccagaaaaaaaataaaggagcaaaatggaaaactaaagaaataaacaaaatttatggggcccacatgtcagtcaaaataaaaaaaaattaaaaatagtgggacccacttcctccacctaaccctccctccaaaaccgcgtagccagcccttccgacgggctggccacttaaacataccacttcacttacactttcatcatcgcttcgtgtaagggggttaactcgggagtgacatggttggaggaaagagatcttataagttggtttcacttgtgctaaactagcaaggtggtactaaacctacacacacagatcacatgggccacacatgcctcatcctaattgggccaagatgtcagactacctctatctcgtcaacacttcaccgaatggcacagagggagtggtggggaggccggtgaggcaacaggtaggaacatgaggaaacggggttgtcgagggaggcggagaggtcgacgagcttggtggatctagagtcgaggggactgggatctggaagggaaaggatagcgacaggtcctttcccccgctgttgcgccgcgccctgctcctctttcccgttggctgccacgtggcctcctctcccccacaacgtgccgctgctcactctccgccgccgcgctgcatgccgctcctctcccccaccgggcggtgagcttggtgaagctagaggcaaggggcaggtatctaagagggaaaggagagtagccgttcctctcccctgccatggtgccgcgcgtcgctcctctccctctcgtcagccgccacgcgccgctccactcccacgtggtgcgccgctcctgtctcgctgccacgccacgctctgctcctctcccaccagccactgcgcgctgctcctctcccccaccaggcaacaaacttcgtgcagccaaagccgagggggtgtcgatctgggagggaaaggattgtggccgctcctctctcctctccccgccgctacgccactcctctcttccgtcaccacgccattcctttcccgcatgggcaccccgcgccgctcctcttcgccgcattccggcgagcttggtagagcctgacccgaggtggtaggaatctaggagggaaaggagacagctcgcagcgacgacatggatgatgaatacaccagacgcgcgaggaagatatacagttcaagaggctaccccgggcggtgccaacaccgcgtctctgccggcgacaaccccgaggtcctctccctctagccgccgtgcaccgctcctctctctcgtggccgcctcgcgccgtctaagatgtacctttgcaatggatacggtcctcataagatgacgatacgcgtaaattgatttttgcaagcgaaccttgacccatcccgcagaaccgattattgcatgcgaacgccattacggctctcctagagcttacagggggcctcgtccgcaaaaaaataattttgtagtagtgagggtgggctttgcagggagggaaagagaggcagagagatttgagtaaactaacttggaagatgttttttcaactcggctcgagtggacttttgtaccggtttattaaaaaaccggcactgatatgtgggacatcggtgtcatttttttaactaccactaatgattcactagtaaaaatcctttattggtgccggttccaatttagcggttctaatcaggtagttattggtaccagttctaaaccagctccgaatcggcacatacagttgtgcacccattttttttatttttgtaggcattttttttatttttgtaggtgtgacaaaaccccaaaaaaatattctccattttattaggaacctatcataaccataggtcacttcccaaaaatcacatgattttttcagcccgtattcatagaatgcgcaaagcaaggttcgaacccaagacttctctctatatccataggcctcctcaccttctcacctagaaacattttttgtcataaaattaaatgctgttgttttaagactgctaccgtctgaacttataatctatatttaacactatagatgagctgaaattaaaattttgtcaactacttcctccatttcatattataagactttctagcattgctcacattcatatatatgctaatgaatctagatatacatatgtgcctagatttattaacatctatatgaatgtgggtaatgctagaaagccttataacttaaaacggaggtagtacaaaattgtagatctcaactttcatataggctttgtcttcatccaagatagtttagaaattttaaaatttcgcaaatccaaatagatccgagaccttataaatacaattcggatatccaaacaacctcaaatcaaatagtcattaactaaaagttgtaagttgtagatctcatcgaactgtacaaatttcatatacagtttattttcatgtgagttcgtatgaaaaagttaggtaaatcggtagcaatgagtgcttatacgtgtccggtcttaattttatcctaacaaaaggttgaaaacgcttcataagtgaaggttttaggctgaccggtacatatatggctggtctctatgtggtgttttacaaggtggatgtggtgttttacagttgtgtttgttagagatggttttttcagaaccgatactgataatgtgttatatatgtgcccgttctaaatttgtatatatgtgccgaggacttggccgtaatctaaccatgctatgtttgaataaatttcaatgtttcgttcgacaaggtcgagccctgcaggctgaatatattgcacatatgttatattatcgtgaatttcgggatcaagctttctcttgcgtcccgcctgcgctgtggccatcagaccatctacggcccggctccatttgcacaagctgggcccaaacaagacaaccaaagttttgccgctctctgatataactcttggctagtgttgcagtttttaaagcaaaacgtacacccaaggtccctcaacttgtaattgagatacaaaatcgtcctccaatcgcaaaaccagataccgtgcgtctctcaattaacaaaaccgttcgctttaggtccctcggtggttttgaccccggttttgtccgaggtggcagctaagtcagcgtgggacccacgtgggccccacatgtcaggctgccacatcatctccctccccccccgcgccccctccctttttcttttctcctcgctcatggctcacttgcagcagggcggctggcgggcgcgtgcggccgccggggggcgacggcgaggtggggggcggcggtggccgccgggggga

SEQ ID NO: 73380 - DNA, 1273 bp, Oryza sativa
gtccacgtgttcgaacttgctgttaatcactgaacagcagagcagcttaagtagcaagaaggaatctttgtaaccctttgtcatcttatctcttgggcaagaataagatggcaaattagattgttgtctactgcctgtcagtggaatcacaatggaagatatcaagataagtacatgattaagaacaattagagatttagaggatctgagaggcatcaatcaaatcttattatgaaaatttagccactattatcttcctgaatatgacatgacaaagagagacggtggatcaaatcaaaacggatataagaaaatcgagtttttttagtagggtatgttttatccggcctctacatgcaaccagatatatatagcctttttaaattagaaacttagcttctcaaataacacaatctgaaatcgagttaggaagttgatgctttatgggcatgattagttactagtttattttatactacagttcctgcaacagggtgcgatcatttaaaaaagaaggtggccaatccaataaatagattgtactagaaatattagtgaataaattacatttcaatgtagttagaggcctagaggacgatcatgtctgcaaaatttaagtaaacatattccaacagaaattttgcaagaaaagtatttttcataacactataatggtatggaacatacttttcaagacaattcttctcatatggttttcacacgttaaatctgaatatttaaactaaattggcgaagagaagttgttcttccttcatacacccaattaagttataagattgactgtgatagtgtgatatctatccccattggtgtctacagtacatatagcttatgattatttttttagaaaaaaaggagtgaagtaaatgaaaaaattgctttccaaataacagacacaaacggtgcaagatttatatataatgttgacaaagcagtggcacaccggacagcctgacgtaattgtgatccaaatcactgttctaacacaggatgagctaatccgatccacttcaagttcataaatgacacaagattgcttcatttggggataaactaaataatccaaatatataatttataattgcaatgctattgcttgcagttccctttccttttcgtatcactttcttcctacaagaagcgaactcttgtggcttcatttgttcctgacgcatcttcactttgtacaagttgaccaaaagaaatagacaacataagaagatcttttaccattgaatggtggataatttaa

SEQ ID NO: 73381 - DNA, 4457 bp, Oryza sativa
aggaacaaagggcgtgaacttacactcttcttccgtggtagagacttatacctgaaagggtggagaagtgataggtttggtctgtttgctgcccaccctgataggtttgataagaagaattgcttcatacaagacaaagcttgcaaacacctgaacatcgaggataattatcatcagcttgttccaggaggaagaatcgggaaagtcagagtgggaccccttgcaatgctagactattttgaagtccttcacaaatgcaatggaatagtgacaacagatgttctgggggctgtggctggatttgctgttaacttcgcagaaccaatacgccaggaagatgtcttggaggatatcttagagtcgtttgttcattttgatgtggctatgctggatagcagaagggcactatccttggacgtaaggaaatacgaccactactcaagggagtttctaactggtgttgattgcttattgcacggtagaccaatgccagagattttgaagcgtgaggaagttacagtcaagtcactccatgagttgtggtgcagaatcaaagttccgctgagagactcttataatgatggtgcattttatcatgatgataaagttggcatacccgtctggtctcccccctaccctgatgggaataattgggaggaggaggaagatgaagaggaagaagaggaagagggagataaagaggaagaggctgaggaagaagaggaagaggaagaagaggaagaggctgaggaagatgcaaaccaccgtgatctaaaattcacaagccaacaggacttcttttcagttgggatgaaggctaatgaaatcaacacctcttgtctctgtcgtcctttctctgcagttgcctcaggtgggatgaggccccttgttgtccctccaagtcagggtggggaagtccagagccggtttctgagcaggaggccacagtggttctccagattcattaatggaccaagggctgcgtgttttttgaggaggctactaaaatagcgaccacggctggtggagcgggcttcttgattcttttgtgtctgtctgaaattttgatatgtctgaaatgtatctcttttgctttgtttagttgcttcctgcttacaaacatgtaaaatttctctaaaggagaagttgtccagaagtttcatttgcatcatgctcttttctgccttccaaacatgagcaaactccattaggatacttggctttgtcttgagtacatcatggatcatgaagcacatttatgctaagtgagattttaattggtcggaattttgctcggaatgtcctaaactacaaatttctgagcccaggggagacggatccctgataaacgtttggagcgtgcctttttaacatctgacaggatacaggatgaggatagcatggatgagggagatcaaaactgcacaactcaggttataacaactgaaaacagtcagggaaccaacaagttctcacgcttgacttgtgttatcatctgacaacttatctatgcatgttagttgtatcataaatatgtattatccattgaacttaacttatcctacgtgaccttgaatttcctttttaaaaagaaatcatgtgtgtgctatgcctattgtttgttctctgcaatctctgccattttctgactgtcacctatattcttcttggttttgcagtttaactgttgaaggcagtattttggtgcatacatatgttaaagtctgtgatgctttagcttatgcttcgcaaaatctttgatactgccataatgccattgatttttctgtgctggtatctctgatttatcatgtcttcccagccaacccgcaccgaagcgcagggtgcacacctgcaagtataattgttagcaatagtgtcaattcacttcagtaaataatcaagcaatttctaatcaatctagcatgtaatactatactctctccagccataaaagaagatcaattttgactattcaaagtccacaagacacaaatttgaacgctagattcttcctcataagtctgaaaacaggttaggtaagtgcaatactgttattcaagcatttgctgtaataaacttggatatataatttcatatgcgaaatatacattctaattctaaataatagacaaattttgctacgggacattcaaaaaacacgtaattagctgggagacatcacaagaaggcatatctgttataggacaacgcaaaaaactggtaattagctgcttgacacccgtgggattattttattttattttaacataatgactattacgtgaaatcaaccacaaactatttcttctttgctatttacaacttctacagatatgttaggtgctaataataagttctcttaaactaacatttggcatagcgttctgatttttttagtatggtcgtgttactcgtgtaaccatgtactgttaggactgtaaatatcacaggctgaaaacacaaaaggccattaatacaagaaaagcatatgccaaaacgaggaaaaagttcactttagatcccttatgttatcattgagtttcaaaaacatcctgaaccacggatctcgtgtgcgctagttttgtaagttaggggatgcgttgtgtccggttttgtggttcagggatgtttttaaactcgacgacaagatgagagacccaatgtgaacttttttttcccaaaacgatgatcatgtgggcccatgggccgttgtactttgctcccacggcccagggcatcacggtctactaccatcatcaatggcgggaaagcatgggagaaatggagggaaaacgagctcccattccccacccagaggccgccgccgccaccgccgccgccgccgcagagcggagctgacgatggcgaagcgcaaggcaccgtccggcccctcctcctcgccgtctcccgccgccgctggcgccgacgcgtccccgcccgtcgaccccgtcagttcacctctccctcgaatctcacgctagttttgatttctcttccttttgttgaggtttcgtattctagctcgcagggtggatccgccggcgggaggaatcgcaagggcgcagcggcggcggccaagcggaagcctaggaagccgcaggtttgcgtcctcccaaatcccaatcgcagcaaatccttgcatcctgctctcttttttgattcgtttgaggctgtaattttgccactgaatgtgtggttactgttctgcccccaaatacaacattggcctgatgcaataattctgtcacttttgcgtaggttcacgagaaaaattacgcgcatgtgtactatggatgtagaaatgttttatatgatgggaatgatttctactatggacatagatatacagaagaatttcgtaaggtggaggcacatgatttgtatggatgtccacacttgattgccgagctaccaccacaaccacggttaatgtcattgctggatttacagctctggattatcaagttgtttagactccatccagaaacacaagacctctcaattaagggcttcttcgaagaagaagacagttggcagtacttaggttcagcgggctggaagacctatgattttctatctgataaaagttggcagtcctttgtcaagaaagtaaagggtagaaaggggatggaatttttcaagttgtatgtggactcctctgaaatcaagcactacgacagtttgctaaaagcaacaaatgatgattattgtcagtcggcaactgtcttgttgcccgagcaagatgatctgacatggtattttccttgggatcacatttcccgacgcctcacggaagacctggcaatgacaactacacagattgtagctcatcttgctcacaactatgacaggcaccttagctatgctggggcatggagagcaaagcagaaggctttggagatacgatttggtacattttatgcttcacacaactatgtcccgaggttactcaaggaaagattttacataaataaccctttcagttttgtggacatcaaggatacagaggttgcaggctgtaaagatttccgagtcctccaccgtatattctgggcatttgcacagtgcacgcaggcctttctgcactgtcgtcctgtgatttgtgttaagggaatgccgctatgtgggaaatatgaaggggttctgttaactgctctagcatttgatgctaatggttaccccattccagtagcatttgctgtcatcgagggtgagagcaaagaaagctggctatggtttcttaggaatgtgaaacatgctgttgtgaaggagcgatctcatatctgcatcatacatgattgcaaaagggcattgttcaatgctatagaagatctaaggaataatccacaagaagcacatccatggaaggatgtacaaagccgctggtgcatccaacaccttgctgaaaacctgttcgcccattttgctgacaaaaagctgatgatgctgttcaa

SEQ ID NO: 73382 - DNA, 34925 bp, Oryza sativa
  unsure (1)..(34925): unsure at all n locations
ccgcatcggtggcaaggtgacgaaggggtcaggcggaaaagaagggcgacgtcggcccccacacctgcaaccacccagcacgtgccgccgatgccaggcggtccctcgcgtgccgccgttgcggacgacaacgccaagctctcgcgcctcgtctcctaggccgaggccgacctcgacgctggccacgtccgcgctgcacgcaagcacgcccgccaggccacctgccttgacccggactccccgcgcgcctcgctcctcctcaccgccgtctctatcctcgtcgccgaccactcctcccaccgcgccaccctcctcgccatcgccagcggtgtcggcctggacgaatgtggtggggaacagggtggtgtcaatggtgcgcgggacgacgggcctcggggaaggtgggagggtgggttgggatgacgacggctgcaagcggtaggaggacggtgaagaggaggcagcggtgggaggacggcggcggtggcggcgatgacgacgacgtgggcggcagatcgaccatggacaacgtggctgtgtcctcgcgctccccgtccccgttgctcgtcgtcgctgctccccttctcccgcgtcaccgcgcgcgccgcgttgcctgcttgccggccttagcaagcgctcggttgacttcacctcgccgccgccggcttcctctgggccctcttcccctcatgcctccctcctaccctccccggcggcggcgcggtgtggcagagctcgaggacggcgagggcggcgcggcgtcatgggcaggcgctgggtgacacaactggagaacggcgagggcgacgcggagatgctgccggggtcgtggattgcgaccccgacacggcggcttgctcacgcatcacagccgccgtcgctgcctcgtcgcccgccgccctcagccccgtcgcaccactcgtggccgacctcttcgaacggtcaccggaggagtaggccgcgaccatcgcacttgcgcagagaaaagaagagaagagtgagagacagaagaggaagggagaaagaagactcagcctgacatgtggggcccatgtgggtcccatgctgactcagctgccacgtcggatataaccggggtcaaaaccaccgatggacctaaaacaaacggttttgttagttgaggaacacccggtatctagttttgtgattgggggacgattatgtatctcgatgacaagttgagggaccttgggtgtactttttccttttataaatgccaacacctaatagttctgaattcaccttatttaaaaagatagtaaagagatttcattgaagtgctactcctttctactttttggttattttttttcttttcacgatgggcttggttcaattgatattttctaatatttttttatatttttagggaacagtatgttttacccggtctctatatccaactagatatatgcaatcatttaaattgagaacttagccccctcaaacaacccaatctaaaatttgctcttacgaatatatttaaattgagaacttagccccctcaaacaatccaacactacaaaagtgatttttctgtacgaggcccattgatttttgcaaacggaccataactagtggcctataaaaatcgatggttatttttgcatgcggccccttaagtggtccgtatggaaaaatcgattttcacatacgagcctcttaatagggccgcacttaagtaaatatcgaaaagacatgtgctctactgctggctacagtgacctaaattgatatgaaattcgcacctataattctatttaggtcactgcagctagtagtagactacatgtcttttcgatatttacttattggcattctggctttggatttacatatgtgcggaggactggaatttcttctcatcttgcattttcttaattaaatattcacggctccagtttaatagttttatatgtaagccggttgttctgaagcattaacttaacttaaatagtggagtcgtatcttcacttagcataagaaaaaaactattgcaacctagctttgtcttgatagtataataccttaaaaaaaggccaaatgaaaagtttcttgtttgtttacgttacaataaaattagccatgaacttgctaacagtgctcgcttagaaaataggtcagttttttggtttggccataagtgagaaactgtttctctgcactcattctggtcgaatgtaattgctcttatattaattattgataaatccccccccaaaataaataaataaataaataaagtatgcacctaggcttttttccttgtaaataaatttagtacctgtattatctcaaattggagcaaactctattccaaaatcatagcaaaccagggaaaaagcaaagaccaccagtagcagtcatcccagggtagcgtcaccaccagaccatcttttcataaagtcccaatgactttgtataagtgaaggaattaataggaattgaaattcgacactcatgactcaattgattaatgaacacatttatacagctttgaaatttctgagcaaaacttggtccaggtttcatgagtcatgacatcgcggttaccagctgtttagcacgtgtagttgtggtttctgtactattaaatttttgtgcttacacttaactatcaagtaacagttgtacgacaccacaaatggaactagcagtctaacaaacagataactgaaagtagtaaccagcagacaagggtgcaattgtcctgttgatactacagtttactcccttacaatttgtttaatcaactacacattaactgtacggtagatcaaaatgcatgcatgagttggggagcagataaattatagtactattaatctaaatatttggctcattaatataggaattctatgtacttagactatcaatttaattcgagaagtttttcgatccactgtttcctcattatatatatatgttgatcctttcgatgatcagtactagtatatagttggtgccagatgagctagggcacagctggtaacggccatgcagccaccggcggctcaatttcttgtagaaacacgtacactataaacagtttatagacgctcataacacacacttacgctgaatatacataagaacatcagaaagaccgggccaacatatgttaagattgatcaagttatcacgagcaccttactatcgatgggaatatttcttaccattgaaagaataactagccgtaaatctaagcacccatattaattctaggatttcaacctgggtggattgatttcaccacaaggaatctaaccagttgaactatgcttatttcacacagccaccaacttcacgtttataatatgtaatatgtatatatcctattttaaatcacaaacgttctactttccttcccatcccaaatccatgtatataaaaaagctcattttccaccctaatcttgcatacgaaataaccagtccctttccacaccctaagggcatcctcaatgtttgtggtgtagtgtaaccttaaggtgggccctatgaatagtaagccattgttaaagccatacccacaatgctatggttagaatttagccataagatgggcccacatagaatggaaaaataattgtttgatctcttgttcatgaagtgaatgagagagaaaaaatattttctttttgcttatggtagaccttaagcataaggtgcactctaaactaatgctactttccacaatgtatatagctcactttacaagtgcaatcattaccttaaggtcacctttttcatacattgtggttgccctaatccccctaataaataagcgctcaaagaaagttttgtttcaaaaaaaaaacaaccaagagaaaaatttcggagaaaagaaaaagttgaaccacgttcactagataccatcccgctgaaagttcatccccactatgtataattaatgctatttctctcttctctcattaaagtacattagcttaattgtttgtagccattggatgcttgatctatgattcaagttatatccctcatatcaccttagttttatctttgaatgattactctatattatctccgtttttttttctttttctcactgagccacttcactttgtttttacttttaacagatcaatatatatgatttatatttatttcagtagtccaccacaaggaagaaaaaatatataaagtatataatgctatattaatcttgtagctatcttatatgttatttctactattatcatacaaaactcccaccacaacatgtgcggtttcatacagttaacagaagaggagttggctcaagcagctgcaagccccgtcaatgttaaaagagagtatccattatatgccattgagtttgtcacagatttacgatttgccactgacttcatcatgttctacaatatgccattgacttttgcttaacttctaagatttaccatcgtcacctggttagtcttcgttagtacagtacaaatttttccaaatgaccaaaatacccctgggacaaaacattcaaaatttggataaaaattctgaaatatcagattttatgtttttggccaaattttggatgtttacaatcttatgtttatagtatgatatttttggaatttttgtacaattttggaagtttttgtccttcgggtattttggtcatttcgacaaaattgtatagtgctgacagaggctaatcggacagcgatgataaattgtaaaagttaagcaaaagttgatggcatattgtagaacgtgataaagttagtggcatataagggattcacccatgttaaaatagtccattaaccaactctttttccaataatcgtatgttgtcacataccgtaattttctaattaattaaaacaggccctattatctagtgttgacatttaatgtagagtgaaatgcaccccgttagtggctaaacttatcgcaatgtgtcacctaggtcaagttactttgaaaatgcagacttattacttgaaacttttaaaaatgtgtcatcaagatccaaaaatgtcaggtggcgttgacgttgctgctgcctcccttatgctctctccaccatctttctctttctttctcctcccctccctctcttttcctcaccacttctctgtttgaatggagcaagagaccctgctactttcgaatactcttctgcttaggccattattgcctaggccccacaaagcatctccatcgggtcaccactccacccccttcggatctcctgatcccatgttgactggtctctgaccggcctccgatgtggccctgctcctccgtaaacctcgacgttgctgacctaccctaagctccctcgtcattttgcttatgcttctgcttctggtggcgccatttcgctattgttgcttctgcggtggaccacatgctagagagagaggagggaggtgggcaggtggcaacaatatcaacagtgccaaataggatctctgaggggatgtatgtatgcgtgacagggtatttgacagtttttggacctgtaagaaaattcagcaagtattaggaggttgatctacaatttcaatgtatatgttacatagcgtgataagtttagggacgcggggagcatttcacactttaatatcataggtcagtccatatgatttaggatgcgcaaggacagtacacatttatgccttttcacttgtgttccttatattgatggggactgcatgccagcaagttcagccaagaaaaatagtaattatgtgttgcaaatgaacatgatactaccgtgttgaataattcaactgaattaagtgttgcaaatgaatatggtagtactccttttgaacaattcaaatgactaacagaccactttgttgatgatttacttgataagaattttcaaattaattttttcaatgaagttgttattttgacaagcaagcatagtttaggtaattgaagatgaggcattgcatctggaccgtgcaatgaagtgcttgatatttggatgtagaagtaccaagtgaataaatttttacgtgctacccctaatatgcgtgcatggtagtcatctatataggattggtaatgagttagagaagtcataagagatggatgaaccatccttaatgtaaaaggtagcctcaatcccaccacgtgagcatcaagaagcagatagaaagcaagatttgagtcaaaacaaaccaataaaataaaatcattctatgttgacagggttttttttatcagaggtaatatattaacatgttaccgttttaattgatcagtacttttatttgatttgcagatgacttgaataaaattaaatgtaatagccacctccattagtaaactccctctaggaaataggatgtcaatacgccaagattaattatattcattagttagactacataggaacaatatactggaccacttaatgttttgtatctttattagttacgggacgaaccgtggattaatatggttaaataaaatcttaataaatgttttaatgcacgtagtttaacagatcacatcaagatatgcattaatgcatttgtgtgtgtgtgtgtatatatatataggtatagctcaatccaatccacaaaaaacagtagtcaattgtgcacactgactctttctaatttcaacaccttgtgcctacaattaggggaaatgtgatgcagacctgtgacaacaagttggttgactcggccagcctaattaacttgactctcaaacatactgtcccggccggtaaccttcattaattctcctatagtttcgcatctgagatatgcatgcatagtagcgacctttttctccctataaatatatgctcaagttcaagcaggcacgcaataaacatactaaaaccatacaagcaaccatatccacatagcttgagttaattagttcgtcgatatatctagcctagctatctcaattgatcaacatggggttttctcatgcgattgcgatcttgttcatcttcctcgtggcctcaccaccatcaccttcacatgctaggatggtgccaaacgatgatacccagcatgtaagcagcaggagtactactcctcgatgttcagatgagttgatccatgttcaggtgcctccaacgccggcgaagggcggcgctgggcgcagtagagcgctgtggtcagcaccaagcgatggcgttggtcattagttacaagcatgtatcgatctgctacccatggtttctgaaataattcttgctttgttagatttactggcaataatgatgcaagtctaaaactgtcagattttacaaagcatgcagctgatagatatattatttatttgtttctgatgttttataagtactattagatttctaaacatgaaaagcagctgtgtactagcttaaattgtaattttgataaattatatatatgtctcttgtagctattatatatttatatttatgtgtattggagagcttgaatattctgtgtcctcctccaaatgtttggcgctggttattttaattttaagctaaccaacataaaaaaaaaggagggagtatatatactccctctggttccatattaattgacgatttagacaaggtttaggtcaaacttttataactttgaccatcaataactttaaaaatatttagtttaaaggaactagaacaatatatagaacaatatatagatttgtcttttaaagcactataataaaagtaaacatgtatttatttattatatatattataatagaaaaataaggtcaaagatatatctcgtagaccgtgtcattgtccaaaacgtcatttaaaatggaaccggagggagtatgtgtttccaacgttgtcttaatatatgattgtgatccattttgtgtatttaaacattgcgaaattcacaatctatgtggcaaaccaatagaattcttatcacaactgcgtatcaataacacacatacatatatatgcccacgtatatactatgtgagaatttgtatataatgttagattgtcacgtgtgaaagtgacatttaacctcgatcggaactatagagctctgaatgagaaataaaacactgacaggatgaagtatgaacgcagcataggcggaggtgtgctggtgtccatcccccactgcttttacactttttataaattagtcaccgatattttctgatattttggaatagatatttgtttgaatcaagttaaaaccatatattcaaatgagaaaacatctaatagtaacatatttgataaaaatatattttgtctgtaatattattacatatttttttgcttgtttccataaaaaaggtaagaactgcaaaatggttcgccattgtaaaagtcttggagacatgaacaaagaagtacttctataaataaaaaggcaccaatctgaaagcgatatgggtgctgtagaaaaagaaatttcgaacctttgttttgcacaaagtagtatctatcgagcgttgaaaaataatctgagtaagacctttccatttgctgatggtgacgactcacaaaccaagctgaagctgggctttgaattcagaaccaccaaacaaatttaacactgcagcactttttgatagttagcaatgctgataaggaggtaactttgaaagggactggttcatgaatttcctgaactaaagtagctcagcggtacatttcgatgcgtctacgttagtcaaaacaatgaaaaaacagctgttgatcatgaaaccccagttttttgggccattatttcatttttgcataaaattaattcaggttttgcattttagttaaggcatgcaaaacatttttgcaatttaaaaggaataaatttcagaaaacactacattccagggctttcataacacaaaaccctaggttttgctattcgtttcatgaaacactaggttttaggacaaaatatttcataaaacgttgggctcaagcttatatagtccatataactaatatatttgtctataataattgtgaacaaatttatgagatagtttttagtacatatatatccaggtaagtcgttttcaacaatcgttgatcaccacggtttgattactcatgtcattgtcagttaggatttttcaaatttttagcgcaaaattgagaataaaaataaagtaaacgagagggatatgtaatttgactcaactaatatgaatttatgttgaaacaatcataaatgataatgaaatatgagtgttttatatatatgggtttcttgatacattttgccccaaaatatgggattccttgaaataaattacaataattaaggtttcgtgttactggtgccccagtggtttgtgttttgtgaaatttactcttaaaagaatattaacttatcgtcgacatgatgctttgtagttaatatactaaaataaagtgaagtgttcttacatatcatgaaaagctcctgctgaaatagttttattttagaacaaattacactttgcaccagttaggttagaccctttttaattttatactaggtttagcaaatactttacactagggtgcattgaaataagtttcacttaaccccaagatatatcatcatatctgtagaaattcatgattgacttcaattttcaattcttttgatggtaagcaactattttgcgaattcgatttcactgcccttcctctaggctgcaaacactatcatatgctggccaccgcctcacggggctacgcagctctgcctctagcatcctgccctcaccgagctcccgaaccttgtcgcccgtgtatcttactatctttcagcttgtgcagcgcatgctgactgacaattagtgaatcagcccccccccccaccaacacacacacgtccgaagaaaaacattgaaaagtggttgaatacaatctcaaatcccaacaattgagcaatacatagagctagaaagtaataaataatgccactatatttgattgatgataaagatatatttactcattttagtttgttttatagtggaacccaaagcaataaatgccaatctaaatagaggaattaaatagaaaacacaaaactggcgaatcagatatggtaacattaaacatcacaataaaatatagagcattaaattgacgagaccaacatgtatctatatctatctatatatcttatccctgcgattttgttttgcttctatataaacaacaacaaagttgttgccagtttaagtcccaccaaattaaacagaagtggtgcagagatactatacagttagcaccactgtcatcacggcaccattgaaaagcaatatgtcgaggccactatactcgatagctgttgctgtttgcatagtttttgtggttatgtcgaccatcccatcatgctatggaggtatatatatagcgcagatacttcaattttaatactgactagttagttttgatcgattaacccgccaatttctgtttgattcaatcaattcatgcgttaattaatattgcactgtgcattgcatattgaatgtatctctagatgaggagacattcaccgatgaagtaccacactgcaagattgtagcatgcaccaacaaatgcagaacccatcaccatccgaaatacactgcgcggtgtattcacaacaccaaccccgagcagtgttgctgcaaaaaggatgacgcccgcgtgaccaaataatttcatgcatggtattaatttctcggcctgcgcagtgtatgcgtctatatatttctcttcgatgcagataaaataaacaagtatttatttgcattattatatgatatcgacccaatatctttctgcctatatctatctatctatctatctatctaatcttgttgagcacgaccaatgttatcagaaatcgattagctgttaaatggtgaacacaagtgaacagacagtctagggactaccaaataattgacataaaaaattatcgatatctacatctacactatttttagttaaaaaaacaagtcgcattctctggttttttgctttttccactcccaaatctcgatatatgatatacagctagggatggatgtcgagctggctcagctcggctcggtctacctcgttaggataacgagctggctcggctcggctcgttatcctaactaggaaggtagcccgcatatacgtgcgggcatattgtttaatcttgtttgaactttcattacaaatgtttatgtgtagattatatttttgaaatattttttgactatattttaaacttatcttcgttaataactggtttgggtgtattacttgaaactgtatgtcctcaaatttattagaaaaaatatgtcataataatgaagttagttcatatctatttgtattatgtgtgattcttttttaaaattttttgagtttccaatctttatataacattttttaattttgtatgctatagatgactttaagtaacattttaactttagtaatgaaagatattttgtattaaaaatatagccaacgatactacttcatctaatcaaagatagacttatattacttatattccctccgtcgcataaatcgaaggagttaaattttatccctaaataatagaagaatttatatgtaactgagacaaagtgattttttttaaatactatcacgataatctccaaagtaccgtatcatattttgataaaaatctatagtgtagtgcatgttagtttagtatccggtttgttttcaacacctattttttctaatctcatgagacacctttggtaatttggagaataaatatgtacatttacattagcgttgtattttcatcaactgtttttacacctaaaatctgatttgaaattattatcataacataaatattacatgtcggctccatatttgtgatgtatttaggctatagataatagtagtttatttattttgaaggaatacaaccggatcgcaaattggatatataatttcaaaataatttaaaagatagaacgcttaaaagcattggttggatattttatatttacatttgtgtaaacttgaagattttatccctaaattgtagaattgccgattttttgactttatgataagtatgttttatgttcttccggcaaacgatatgtaagtattattgttttctcaatcatatgtacgtacggagtactttttccgatgtaacagttatatatttctcatgtatccatgtatggagaaatgtattatttttaaggcaaaatttgctacaggacactcaaatattgtggcctttactgtaggacacccgaagatcgtgaatcttttcgtggacactgtaaaaatgtggtaattagctgctggacactcctccgattattttattatttctggccgaatcagagagagaaagggtggtgaaagtaccaaaaagcccctgcgccatttttcttgtaaacgttggtcgaaccagacccgatcccctctcgtgtgagcccgagcttgacataaccaatcccctctcctttgaaccctagctttgagcctcagcggcggcggcggcggtgaggtgcgtcgtgagcgagggggttcgggggtcagcagcggattgaagcgaccgatggatctttgagctcggggttgctgcgatgacggaatcaatgtcgtgcctagaggggagggggtcacccaggaagaagaaggcagcggtgaagaaatgctcggtgcgttttacgagcagtcaatctcctttgaagccgattgatttgtcatgggtccctgactggtaagcattaatgggcattgatttgttattttctttcttgaaatgaaatttgttggggttatgtttgaagtggtttttaatcgatttcattgcgttttgtgttcacttgtgttcacgtaggatggattgcagctcggcatgtagagtttgcattcgggttggtccttatgtcgagtttactaagaacggagacccaaatatcatgtgagtaagaacattaagtggattgtagacaaggatacagtgtgttggattgatctaatgagcgatttggatgatgaggtcatacatagtcctcagcaagagctaaatgtgaaattttgggacaaaaatgcaaaccaatatgcgcaggtagcctctgatagatctttacttgatgctttcgatatgtacagggagatgaggaggctccctttatttgttgatgtgagtgatgacgcacagaataggacagagccttgtgtggagcagggcaacactgagccgcaagatgtttgcactgacattgtgttgttcacacaacaaagtcaagtaggacagtcctctatgccttctactaaaccaaagaagtgtagcacttacaaaccggttgatgcttggggagagaatgatgaggtagagtatgtcggtgtagatgatgagaaggataagtacaaggatttggtttcagatgatgaagagcatgatctagattatgaacctgggtctgatgaagatgtcgacgacttagctgcagatgatgagcagggttgtgaatctgtagtgcatataactgatcttgacaatcctaagatagctgttgatgtaacatttgaagacggtgaaacatttaaaagatgcattaggcagtatgcagtactaaaagaggttgaacttgcaattccatatagcgaatcgacgaggtacagagcatactgcaaggccaagaggtgcaaatggaggattcatgcatctagattacaagacaaattatgcctaaaacttacatgctcaagctttggacacttcacgaaccgcttgtttgggttagcaggggtcctcgatgtctttgcttccaactgcgtaccgcataacggacacttaccgacgtgcaactcgcctgtgactgggttacgcattgacgacgagcccgtgtacaaggattggtccatctcgccggccacctcaatctgccgcagatcgccgccgcacttctctgctcgaatctgctagcggcagagcgtcctagctcgccgccgcagtcaccggagcttgtcgacgtcgccgccgcagtcaccgaagcttgccgaccggagctcgccaacatcgcagtcaccggagctcgccgacgtcgccgccgcagatcgctgccgtcgccgcagatcgccaccgcacctaaccctagggtttggaggagaggggattgtgacactaaatggggaatgggtctgattcgacccatctccatcgggttaaacactgacccaagggcaaagttgccatttactaaagtttctttctccgattcggccggaaataataatataatcggaggagtgtctagcagcaaattaccatatttttacagtgtccacgaaaaaattcacgatcttcgggtgtcccacaacaaaggccacaatctttgagtgtcctgtagcaaattttgcctatttttaaataataaacctaatctaatggtataaattgaaacaactaaattgtgttttttatttttacaaatgtaaatttaaattagcgtcgtatattcatcaagtaatatttgacaccctaaaatatgatgtgaaataaaaaattataatagcataattattgtatatatcagcctcgtatggtaagttataacgaatagaggtcattgatgggatgtttcatatttataatacaaatttagtttaactatgtatatttaagtaaatttgtagtgtaatatatttatctttaaatagtagataataatatttaaaaaccatcgatctttttaatgatacacatttttttattgtttttattgtaagggattttgaaaatactattttgaaagaccaccgtgtatagattctttttcccgatggacagtaggtaaagtttcatttctttttccaagtcggatgtatgtacgaactacttatgttttttttccttttcaagccttatagttctcccgtatacgtatacagagtaataaggtattagtttttaaaataaaatacatctaatctattattaccactattttaaaagttgagtatctattaatagatggaactgtatatgtcttacttatttccaaatccatatataaatattctaaaaataccacttctaccgattaataggatacaccattaaaattaaaccattaaagttaaacaggaatgcccatttagtgggtgaagtcagtcataatcgtcaagactttcttactctactgccttgaatgataggtctctcattgggatagttgtcctcctccagaacttggagcacaatttaatgtctaatttactatcacacccctatgtagtattgcattggtatactgggatcgccttaactcagcctatatatgtctctgttatacttaggatagcatagcaaactctgttggttatgcttggtgcccctcggggaaggagaaagaaaagataaacgtgaccaagatagtagttttttttaatttttgagtagatttgtgctatagagtagacacaatatgtttaagatattaatcattactactcatatttttatagtacagctagaatactctcattcgaaaaaaagcaaggtccatcaccagatggtacttgaaagaaaattgccaaagagagacataacaccacgataatctccagagcactatattattgttcatattttgacaaatacctatagtttagcacctggtttggtttgaacacctactattgacaacaacacatgttatacctttactaatttaaagaatgtatttattcttccaaacttatttatcaattacgtagtatatttatcaagtgatatttgacatcctaaaatatgatatgaaattatttaaaaattatcattacaataattattatatattagcccaagatgtgatgtatatagaaccgcacgataaattttataagacacaaatattttatttaattaaaggaatataatgggatcacagattggatatataactaaaaataatttaaaagataactgtctatattttatatttatattatagacctagtttatatttgcacatatttgtggagtaatatatattttatatggtaaagtattatattttaaagaccatcgattctgttccatgcacatttgttttttattacatatatttcttattggctttatcattttctacggtaggtacgtgcattttttttctttgtaataatagttatacataagctttctaatacagatatactatttctgtctccttttatcagggaagtggttaagtacctcagaagatagaggagagcgtcaggcgcatatttccggaatgcttctacggggaatgctcattgaatgtgcattctccgtattataccttgaagaggactcgaacctccacgcttattagcacgagattctgagtctcgcgtgtctaccattttaccatcaaggcatcttgaaagtgaatcatattccataaatatgatatctatctaatgtgatatcttgaaagtaaatcgtattccatgaatatgatatctatctaatgtgatatgtagaatatatgacaaaggtggagtcttggagtatttcgatcgatcggtcatataggcctgagtcagacatttggttttcatctttatcgtacgtacgtacgcatgtgttcttccttcctgtaaacagtatatatagcagaaaggtattatatatagatctaatttattggtaaaaaaacgggtccaccaatttaaatataaatcaacagtatagatctaatctaacggtataaaataacgggtccaccaatttaaataaaaatcgacggtgagattagattgtgccacgtggcggcctaatagcaattgtaggagcgccatatggcggcttttgagcgtttgtaggaagtttaatggacttttagtatataatagatagatagatagatagatagatagatagatagataatagatgagctagaaacccagctcggctcgactcgttacccagctcgagctagctcgtttggctcatgagccaacgaaagaagggcaagcacgaggatgaggaagcatgaccacaagggcgtcagacggcggccatgcggttgacttggagatttgcgaggtaggagggttgggggcttggggcggtctgaggtaggcaggggagaaggcgtcgatcttgccggcggccagcagacgaaggggatgtggcgccgtgggctgtgactcctgggcggcgacgacgatttttgacaggatgagacttgagagcgattgtgggcttccagcgctacgggagacggcgagcgattgcggcgctacgggagaaggaagaaagtgagcgagcgattgtggcgctacgggagaagggaagtgagtgattggaggaggcatggagagattttagggttagaatagtgggcttattgggccttgttgggcatcgatctctactgatgggcttgtgatcttttttcgttggccttgttggacttttggtgcttgccttgccttggcctgctgtttgttttgggccttagctcgtttggctcgcaagcagctcgcgagctggctcgttatagctaacgagctcaaagcctagctcagctcgttaacaaatccaaatgagccgagccgagccaggcacgagccgagtgagttaacgagtcacgagtttttttccagccctatatacagccaaactccagaatttggtgatactaagtaatatgtacaatgaagttatgctagggattgaaatttcggaatccccctctcaatttttttttaaattttggttaaaatatagtcaaattcaaccaaaattcataaaaattttaaataattttgtggaaaaaaaatctaaaaattcacgaaattcatgaatttttttggtcgtagagaaattatgaaaaattcggtggtttctgagaaagtcatccaacatcggttatgatctctgatataaaatttaattatttgctaaaacttctggacttctttacttttgttctgatcatcaagagcccaagacccaagcttgttcatcacttcgggcatgttcacattttagctgaaatgaatcttaccaaattttagcaatgacaaaattttgataatttggcaatattgccaacttttgataggatttcttatatatttactagagtttggtaaaataaaaataaatagatgcacatatttgataactttgctaaaatttgataatgtttattttggctacaatctgaatagacccttcatctgaattgagtatatttttgcttaactcgagttagctagaagacgtagtcgcctgagcatgtcgaaaagaatcaaagaaacattggacagctcccgggctgttctattcgacatgtacaagttagaaacacaatcgtctgtatccttgtttcgtcacaagtgagtagcagttacagaattaacttcttgagttgttgcctagcaaaatagaagacagttttctacagctagagcatcctagaaacatggggtgtgccatgcatctcgttcgagaataggacaggatgtacagaaaattgccacatgattgaaactagcatcgttgtacttcgagcgctctgagctcatagaaaatgaaaagccaaaatatgaattaaacggccgaagagatttagttttctgttgccactcatttccttggaaaaacaatagtatcactagcagccttcaatattatattaatttccgtatgggacattaaaaagtcggtttgacatgcccaactagagttgggaggattaatggtttagtttcgtgagggctagaactttgggcggaggtatatatataggtcggaatgatatatgacttgaacaagctagaattgaatttttaccttgacgagtaggtagcatgtaaagacatgaatgattccttcatactgcatatctcttaatttattgggttgctacgcctacgataattaataaattatgtctttcatatatgagtgtcacggatgctcagtgcaaataagaggaagaatttagaggatagttgggcggttttgggaagaacaggggaaggaagtagttggtattttgtattttcattttacaatattcacttgagagtgtggcgacaggatatttatataactcagattcatgcacagctagaccgccgctaacctgacacggagacctgacacacttgcacaaggcaggactcagccgagcaatacaacaacgcggcactagaaatactcacccaacgatgcctcacaactccccatgcttaagcaacagcgtgacccccgctaaacctcgatttcagttgtcgcatgttttcccatagtgttagctcatcaggcacacctatacacgagaataatctagatggaacaacagtcttgtcagttgtcgcgtttagtcaggttgcggtgaagaattgcttcaggcttggcatcaagtttaatttcagctgtctgtagtggtagctcaggactcgccacagtgtcaggtttgatggcaactttcaacaatgacacatgaaccacaggacggataagaagaatggccacatcaatcttactatgtccagtgttaagaaatacattataaagacattattaataaatatgtggttatagtgacctgagtagcaccttaaggttctgagttcaaatcttcatagcagcgaatttcagattgggttatttgagggctcattttcctgtttgatatgctaaggtcctaattaaaatatgacgtatatgtccggttggatgtagagggcgggtaaaaaatacccttgtctaaaagaaaatcaataaatatatgggattataggatcacatcgaaactacattagccaaatgatattcactaatgcaaaacgcatggtgagcggcggttagatttcttcaattgtttggctctagcaaactttgatagctcttttatccttgttgatctccaggcctgccatttaccatggctgtttacattgcaggcatgaaaccatattgccatacctctgcttaatttctcgtttggcaagatggccatccattggtccaaacaaagaagctatgagtcccctgcatctgctaagcacctccattctgtgtatccaactggcataccataatcatactaggcagttcattcatgatgcctcctattcctaattgtatctttgtatctcccagcatcctctctgcttctctttggttcctctcttgtgatatccattgctaccagcttgcagctgactagtagatggaataatgtggttttgtacatatgaaactgtgtggagtaactaatatcagtttttcacttctgggtacagtgctggacacctaagcctgctgggtacttggttctgcgataagttgtgaaaaatatcaaatgaacctatacaaattgaaatatatatctggctgcgaagtttgtggtttagtgaacctatacaattctagcctaattgtaaaagaaactagtatgaacttttactttgttgggatgcaaagtacaaatatgttcaatacttttacacgatgtggatcagcaatacatacgcctgttggaacattttttttcttactaacaagaaattaaagtgatgtttcgtgcataattgaggacatttgtttttttacttcaaactactttctaaatattgccaaatcagcattgaaaatacaatggttgtagcaaaaataccattaagtctctacaattatatgatgatgcaaggatattttgccaattctgaaggcttgggatcgcttcattattgcatatttcctcgatttgtgctctcagttagttgttggagtactcccacaattaatacttgtgaagtatttgactagttctatttcttcttagttgcaaatctaccaaactgccaaatttctcatcaacgataaatcccctgaatagacaaatagattagaaactaaaagaatattatgaccacccacattcctaatgaagcagtgtataggcagcacacaagcagacaaacatctctcacttacatgtcgccatctcccattaggctggggttgctgtcatccccatatcatcgttcctactcgcaggcgttgcaccgccttcgtagacacaacccggaaagaaacaattcacaatatatgttgactcactcgatttactttaacctctaccatgcaagtgttgacgttgtcgcaatcctaaaactttggatacccggaaaggtatcatcatactgaccttcagcgcagatgagcacatgaatagtttcccgttgcctctaactcttatagaacaccgggactaaacaatcaaaatgacagtagaatatcataggccatagttaaatttcttacgggcaattaattttatggtcactaactatacgtaacttctataccaaaatatacaagcagaaacaacgataacagtaggagcagcagcagcaacatcaataaaacatttattactaatcatatataactgcattcggtaagacaaaatacacgttatttggacagagtgatcaatttacatactttagcacatataaatggccaaactagaagaataaattaatgtttttagtgctataataaaaacagataatgtagcggcacattttacatactaataaacatatatgtgagtttactctacttagcttgttttatgactttgactaacatgtagcatttgcaacgacaacaagagagcattgatagtaatcagtatctcattgaatttcaaaacaaacaaaaccccatgtagagctagccccagtaagtatacacaagcaaccatcaaacatagtaatatttcctttaatcagtaacactcatgtgtaagagtagttttaatagtctcatagtctcatattaagtgcttgaagaaagctcacgatggtactgaacttcttccattgatccttctcatgctcatttgacctgcattattcatcaacatcatctagtacatgcttggtgacagcccagcacttcacaacatcacttcaattactgtcagaactcatgataataccaagtgtggtttttactatagtaggcatcgagagttcattccccaacacttcctaataggctttgcaacagtggtcccatctcttatagcttgaaacataacttattggtgataccgagaatcccccaaacacttcacacagtaggccttaaaatagtgccatgtgaaatgattaaagagaactcaagataatagcaaacatggctgtcatctcgatcttgtggtttaaacaccatatattaattgtttggtgataccgagagttccctcaaacacagtaagcattgaattagtgccacatgacgtcaagtgcttgaagggaactcacaacaataccaaacgtgtctctcatctcaatcatatggttcaaacaccggttacaaatgtatgatgacacagagagttccgccaaatacttcacaacaacccttgaaataattgtgtcgtatgaagtgcttaaagagaattcatggtgataacaaacgtttatccttgtatagtttgagcactgtttacttacatgctggcgacactgagatttcccccaaacgcttcacaacaactctcaaaatattgtttcatgaattgcttgaagggaattcctggcagtgtcgtcgatggccatgtgccaactggcctaccgcatagggccccccaaaattctcatatttcaatacaagacactaatttccaatatggttttatcctattcattttattttttcaaaagttccgctcatcttgatgtattgatttggctataacatatttattttctttggatcaaatagatgttcaataataatcatggcaaccttaaagaaatatagtttatagcggtgacatgaacgtgcgttctaggtactaaacattccatttttctgcttgataaagaaaatcaaataattacattaagactcacttatttttcttacttaaggaggttaccgccaccatttacgtaatatttttttctgaataatttagtatccttttattgatatttctaaatataagatttcgttttatgtttcgcactggggcctaaggtgctgggtacggcccttattccttggggctccaaacctccatcatttaaaaattgaatatcatatatatggccatcacatgtaattcctgaagtacaaacacttacataccaaacttgaaaatgctggttgccaaccggagtttccccaaacacttcactataagcagctaacttttggccccatgctcatagttatgcaacagtggtgcaatgcaatgaggcctagctagctatctgctgaagtggtttgaggagaactccagtggataaccaaccaaattatgactcctagatcgacctaatttcctcgtttttgatgtggaccacttcacttgtttaatttgccttgctgatgagcacagagccggtggctactctctccgtttcataatgtaagtcattctagcattgcctacattcatatagatgttaatgaatctagattcatatatatgtctagattcactaacatctatataaatatgggtaatgctagaatgacttacattatgaaacggaggaagtagtaagctagctagtaatctgcctcctgtggactgtgcaatgcatatatggtccttgctacgcagttggcatgtattaattggatgaacttggcaacggatgcatctagccgtgatatagcctaggttaggacatggaatgtggcgaagagaatatatacaatgtgacctttgggctgcactgagctccgatcgaatcgtagaaagatagctgcaaaattccttatattaccaccggcagagcactctgtcgttgcccggtttctgtccacgtacattcctttcattgcatgcacagccggttcaggaagttgatgacatacatgttacatatactgtattctgccactctgttgaactaagctattttatgggttgattatctagtgtgatgatgaaattatcctgtgaaccacagatcatcatatattttcagttgtcttttgcctgtcagcgaccggtgagtgtcacaggcttgctagtgatcatagagggcagcaatcatacacgacctaatctgacataatttactataaaatttgtccaaatcgaatgtgctagttgtgtcattatgcgtatatgactgtataggcaggcagcacaacgagaagaagaaaaaaggttgggacatatacacaaacagaaggatggatgcattttctctgccaccaggtaatcgatgagtcatattcccaaaacccaaaactatatgctcaaagaggagaaagaaaaaggtgatgaaggtgtccaggttcaatgtatgcaatccttgtcagcagaagaatatatgtagagccccccagctgaccactttcaaagcatgtccaaacagcagtctagtttcagctttagaaggagaggagaggagagatatttgcagtacaagtagcttattaggagaatgaacattcctaaacccaagatacatcaagaactatccttcttcaagctgtagctgcctgtaggaggaggagattgtgtcagatggagttccccctttcacttcttggttcttgtttgcttctacaggtagagcggattttgtttctgatgattttcatgttcatgattcatggatggatttgtttctcagtatgctcgtttatgctgtagctggattgtatcaaggaaaataaatcgacgatgagtaaagcaattttatctgtattgtttcttgatctttttaattagctatagttacttgtctttgtctatttgtgtgctcggatgtgatggcctcattgaaatgagtcataactcataaccgtattagcgcaggtggtcttgttgggccggtcgatcttctgaactagtgtgctaagcccaggaatttttttcatttttagaattttttttaatatttacagaaataatctatcggccaaaaaaattgcaaaaatagaccatgccgccccagtggtgggcggcaagctgacgtgatagacggcgggtcgaccgcgccgtctgccgccgtcggccaaaattgcaattacccccttgccgcccatacagagggcggcaaggggctaattgcaatttttgccgcctataaagaggttgcgctcgtactttttgcatttgggccccttgccgccccagtagagggcagcaagggacccagatgcaaaaagtacggccaaacgatttttctatgttatgttaataataaataaagaagtatttattggtaaaacttattaatattgttataaaaatgtattgaagttggttgtttcgcaatttcatatgttaagtaaggtattattttgtaacttattcgacgtattagtactcggataattaataggcctatcgcagtctcggtcgtagaaacattatatggacttaaacaaggagaattatttaacatgaagaaatagtagtacaatttgaacatgatacaactatttccattgcggttacatagatgatattagattcgaactaggagggaggtagtgcaatagttgaacacaacgacgatgtagtaatgggacaaggaaacatgacagtagaaatttcaatatgcccctacgtgaggatccctttcctctctcaaaacacgctttagtaaccttgtattgctctggtagttcaagctgcacaacacggctaggtggagttagaacccttctggtatctatccattctctgtattgacatctccttggtggttcctaggaggaaagaatagatgtaaagcgaacaaagttagtaaatgttgtgagaaaataaggattcatgtaatcaaaatattcttaccatgaaatcgtcgtcaagaatatttggacaaacaaagaaccttcgatccaatgttgtaggctttatggaacgaagaacctgacaacgatcatcacacctgcatcttggacgggcttcccatggagggagtgccgtagttagcacccgccagtcgctctgttgttcacgacattgtcgttcataagccgcttttctctgtaagtattgctcagtactttcggatgcacaataccagcgaccttcttgtaaacaagtggttaggtcgagaacgggattttctgtatcgacccactcgattatgtgcaagccgtagtacgggtctgccgaatagagtagtgttacgaagaataaagcgattgcccatacggaatgaataagcatatgaagataataaaatatctcacggtcatagttagggcacctaaaaaagcgccttcctcaaatatcaggattcctcgaagccattagttggcatcgataaccgcataggcagagaggacgctggcaccaaggtggtagtaggtatacacaaggatcgctagccagttcagatcctcaacaccccggcgtctagctattgacgaaagccggtaggatttgtaatgaagcatgtagggaagagagtactgaatttgactgagttctgaaagattgtgaggcctcactcgttaaggcgacttatataggcgcaaaaaatcgagtgatatccctgacatgtgaacgtggaagggcatggtggatacgcctgattggcaccgaaagttacatgcctgatcggcgccgaaagttacattggtcgtatgcagcaaatggcgggcaaatactcgtatcgcacgcaaataaaggaggctgcatcggtgcagcagaaagtagtcgtgcatgtgtcgaaaggtatcgtgcatgcgccgaaaggtatcgtgcacatataacaacaacgtagttattacacaagtatacagtactggaaagtgaagcaaataaacaaaaagaagactgctctactggccctgccccgcgccgcgaccacgcttggtcctccaggcctgtgctcgcacgtggtcatgggagtaggtgaaacgatccggtggcacaacacgggtagcacgagtgtctggcggtggagtggccagcgcctggtcctgcgtctgcaccggcggtgcgcctcccagctgtgaggggccgatgacatcctctgtcaagcctgaagcgaagtcgaagtcagtgatatcgaagagcaaggtggaaggcagcaagcgatccaacgaggtcccagcatggtccagtggtggaccctgactcgacgtgccggctgcgtgtgacgaagtcccggtgtactgccagaactgcgctgagtgtgaggtcgacgcagctgcctgagacgctgaccctgcaacctgggagaagtgggcggcctgcgtcatagcgaacagggcgaaacctacacatcgacaacgggacccttgtaagctaagacataaaatgcatgtaaattgattgtcgaagtaatgttgtttttttaggtacctgtggggggcacaacagaaggcctagccgaggaaggcggggtgctgaacggtgcacgaaaccctgaagcaatcggcaagtgaaacggctcacatatatgtgcgaggcatgtacagaaaaatccttaaaaatacttacctccgtgcggagggggagtcggcctaggaacgtgcgcagctggacggggaccagttggtacgggtggccgctgtacagctgcgtctgcccgagcaacgtcgtctgcacgacaggtgagcactcggagaatcgagcgcatcgattccaccatccgcgtgtacgtcgtcaggtgctcctctacgggtaccggaatccccgcgcctaaacgttggatcatcgttgaaccgtcaacgatgacccggttgatgtcgtcaacctgcatggttaattttttcatacatattcgtaaaatttgacgaagagaaagacatgaaaacataaaggaatggtgcgatgcatggtactcacagcacgagcgaagtcctggtcgcggtgcctggcgtagaggtctctagtgctcgcaacgtggggctgcttctccaaggacttcgcgaaggtgaccctagtatgggtgcatggctggtactagcataggtaggccaggtacgcctcctcagtgtgtggctctccctcgtggtccacgacctcctcggttgcgagcaaccagtcctcaacaaaagtcgccaacttggcgggccagtcgccagctgactgctgacccttgcgcgagtaactgcgaattaatctgtcatattagtgtgaatcgacagatgttgcaaattattgcggactggtagattttaatgcaacaactcaaagcgtagtgaaagatcttaccggtgaacagcagctaggacggtcgtcgaaaacggtactggaaagggctgacggaagccgaactgccgcatcacgcggaaaggggcgtgaggctcaacgcagatgtcgaagaccatcggaaccatagtcatctagtacgcctggtccctggtgcagagtgtggacagacccaacggcgcccgagcctgggtagccgcggcactgtagggctcccacaggacgtcagtcggcagaaggcggtcgaactccataacaaactcaggatacgaccacctaacctggacgtgagcccatcggcgctgcaatacgagacgatcgatgtgatgtacaatgaacttagcaattaacttaacaatacgagaagatcgatgcaacgtacctgacgatggcaccacagagtacacatcgtagggtagtcgacctctggtcgctctgcgtacagtgactcctcgtacgcgtgctggtccacctcagggcggccgatcgcaatcctctcagctgcccagatagaaagaaagagagggcacccaccaaaggtcacgctgggatccgtcttcgtgcaagcctcacaaaggccacggtacagagccgccaacaacgcggaaccccagctccactgaggcacctcgcctaccgcggcatcggcgatgctcctggcgtagtgcacgagtcccttgtcgaccgcgtgcccgtgaccgccacagaacatcacccagccaaaaagccagagcaagtacacctccaaacaacggctgtaggtgtactcgtcggcctccgcctgtagctgctcgacctgcaagcgttcgataaaatgttaggcaccttaactgtggactaaatatgtagtatgcttgtcatttcggtacaaaaacacccacggtgaactgaagcagccacctcttcgtaggtccggtgttgcggtggtgtgccaacggctcgagcgggagacgcgatgcgcgctgtactagtgcgaaatgtgtcgtcagatcgtcctgccagtccacacccgtggtcactagcccaacagcgtctcccgcgagcggtagccccaacaagtacgatacgtcctgtagggtaggggctacctcaccgcacggcaagtgaaaagtgtgcgtctctggcctccatcggtcgaccaaagctgctaggagggaccgatccacagtccatcgtctggccgggtcagcgtcgccggcggcaacctccaccagccgacacatcggtaggaggccggcctcacgcagcctgcaataacaaactaatatgtcaatataaaaattattacagcgcaactaatttatagcaatacacttttcgtacccctcgacaaaggagtcgtgaaccataagtagctcaccgcacgtccgttcccggaacgtcccaagctgagccccctgcactgcagtaaggtgagaccggtgttggtgatctatcaccgggtccaacaactgagttgtatcctgacgtgccatctctgaaaaatatagtgtttcgtgttagaacaattcaaaaagtagtaatgtcaaacaaaaagataacttgtaaaattatgtacaacaagagtacatgctatttaaatataggaaacgttactaagggtacataacgatgacgtgcaatttaacatatatgtagagttcgataatataacataacataacataacattacgtgtcgaaatccgacattacatcagcatacctaaagacactaggtgccttagtctaacgttacatcacgagacctaaagacatgacatgccgaagtctgacattacacgacgaaacataaacacatcgataagttcgaataaaattacaagcaaagccacatgctaacatagaacataagaactacaccacgtaaccagacgtggcacgacgacgcctaggacgttgtcgatccttcacccgtagggcgagctccatctgttgttgatcctgatagtcctgcctccgccgcacttggtttctccttatctttaggacaatgcttgtaggtgtgcccacgttcatcgcatttgctgcaacgcttcaccctgccagcctccgactcgtccatatcgttgcggatgcgatgagtcttcctccttccagccttgcctcggagctgcgatgggtcaggaatattgagtccttcatcgttagtctctatgaactccccagctatgccgaacccataaatctcgccgctccatgtatgatatattgcttgcttactgaagtactgtgaaacatatactgcatctggtatgccacactccgctacggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagttccaaacaaaatgttgttgttcggcatagagggatgaactgcctggaaccgatccctaaaatacctgcatgtcccatgtaaaatgaactccactatgccaactagtggcagtccacggacaccgcgcatcacccagttctaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccagagtttgaggagggtcagcatcggcggtcaatggagctgctgcacgctgatcactgcatttggctgtcaactcatctaatctcttccaaagctcattgaattttttctcttggttctgattgcatagcctcttaaacatgttcatgagctccttgttcttgaattgcttgaagaaattagctcccatatgacgcatgcaccacctgctctgtacatcttcccactcaccagggtatcctcgttccatactcccaaactgcaactcttctatcgctcgcagaatgccagcgtgcctatcatgtatcaggcacacatttggcctcataccaacaacttttgttttaaccaatttcaggaaccaataccagctgtcggtattctcactctcaacaaaagcaaatgccaagggcaatacctggttgttcccacccctattgttgttagtatctagccccgattctttcctgtcatgaatgtcccatcaatgcagagaataggacgacagttcacgaatgccatcttgcatgcatgtagagctaagaacgccctttgcagcacactcttgccaggatgttcaattgaggggaatttcttcacttcataagagctcccagggtttctttccttgataacaccaaagcaggcgtggcaaattgtcatacgaggcttcgtaagttcaaaagctcatctctataattttctatttggccctccaggccttggcatagctaatagtatacttgcatgtctcttcgatgtgtcggattattgaccttagttcatatgtgagattatcgatgacatgcgcatacatctcagatgcaacaaatgcacatgtaatattcctgtggtatttctgaacaccaggtagataacatgtatgcttggtaacgactgaaactgtccaataatctttccatttccccttatacgcgtgcactttccagggacaaccatctttttccttaacacaccgaacttcatattgggaccggttggacttggcaacccaaaactctctatgaagtgacactgcaaaatgttttactacctccttcatatcttctgctctactataaatcgctccttgaataaccgcattttcattgtactcccatctcacactatcctcttctgaaacgaccagcgcagaaaaatcctcactagcccattctgctggattaatatccgtctcatcatctgacgaatcaccttcctctacacgctcattgtcagaatcctccctctccatttcatccacaatggcaccgacagtctccccctcgttggccactccacctggttgaatgcccactggagctactacacccccatcctctcgtgcgttgacctcctccacagaagtctcatttacttcagcacttggtccctcgccatcatccatgttcatctgcacacatggatccttcgggtgaacaaacggaaccatagctagaggctacccgcgttgcaatgcattttccacattccatctncacactcgagagtttgaactggcattagttcccaataaaaaccctcagttgcccgacttactataacattgattgttatgtcacttatctggggatcaactctcaagcccctcattaaccatccttttatagaaggtacactcctctcagccagtctatcaattcccctttctgatacaataaaatctgacagatctaccccagttggcccgtaacggacgtttcctgggccatggtaaacttggaatatttgtttgttcgacatatctatcaacgaaataactagatcatattaatctttcatgcaataaacatctacaacgtaatatcttcttgtgtatgccaatgcaacggtaaagtattgattccaaactagtagatctacgtagttaccgatatctaaaatacgcacttctagattagtacaactaaaaccctaaaaatataatgcatttattcaaacaaagttttaaaaaatacacactatttaactcaatagtcacatataggatctatgaatattacctgaaatcggcgtctgaatccgacagggcttcgccccttcttctcttctcctcccctttcttcttttttttttcactggatttgagggggaggaatgagggctgggggctgggcgacaggccttttataggcaggccttttataggcagcgaggcctgccgcccggccagagggcggcaaggggccgcctgcaaaatggccggccccaactggcttttttgtattcgggccccttgccgccccaacagagggcggcaagggctttactgaaaaaaaccctccctccgtcaccgcccgccccaacagagggcggcaagggatttgtaagctctatataagatacgcatatgtaccgtccctgcttgttgggcatcaaatgacaaaataaaaaacagaaatccccacctatctcgtcttcttcctctgaactctcgatccccgattccaacagcttctcaatcctcactgatagaacattatgcgtgtcgctggtggctgtcacgacttcgtggtagtttggtatcagacacaagtcgatctgccactacggagaaagcatttttgctcccggtttataactccctataattatggttttgtaaccagaagtacgaatccgggactaaagatgggtatctttcatctttagtcccgggtgaaatgaaacgggattaaaaatccatctttagtgccagcgccaatcccggttagtcaccatttttttttcttttttcatcattgtttcttttttctttcccaaatcgagttggtccttcccaaatagagttgctccctacatatccccaatcatatctcccatccgcccgttgacgcgatccctgccgccctccacacggcaaggtcgccgcctgccgccctccgcccggcacaccacgctagccgcagccgctacaggcccggcccaggcttggccgcctggagtggtagaagaagaagaaggcggggaggggaaagagagtggaatggggaggaaggggagagaagagggaatggaggctaagatcaggattatgttaatttaataagaggggagagagaggaagggcaaggggataagattgactattgagatgatgaggcgcgcggctcggggtgaattttggtcccggttggtataaacaatcgggactaaagaaccatttttagccccggttgttcataccaatcgggattaaagataattggggcttaactcgtccgacaacttcttgaaccgggactaaaaatgatatttagttccggttgataacaccaaccggaactaaaaatcaaaaagttttgtcccggttcctattcgaaccggcactattgtggtttttgggtaacggaccattgatggttagtgtgcgcacatcctagcgacgaataaatcgcagacaacactcacggagaggatagtgtgatggaacgagatattggagcgcaccatcgagctcacctccaatatcaacggtattctcggctcgctccaaggcacaggttaaacaaaactaactttccgaagtttgacgaggtcaatcccaaactctggaaaacaaatagtgagaagtattttagtatgttcaggtagagaagatttatttccgatgattttcgtattcatgattcatggggagatggatttgtttctcagtatcctcttgtagtagtatgctgtaactggattgtatcaaggaaaataaatccatgatgacgagtaaagagaattatctgtactatctcttgatctttttagttagctacttgtctttgtctatttgtgtgctcggatgtcatggaaagtgtcatgactcatgagccagccttatgtgttgccgtattagcgcgggtgggctgtttgggcgggtagatcttctgaacttgtgggctaagcccagcgcagtgtggttgt

SEQ ID NO: 73383 - DNA, 6979 bp, Oryza sativa
gtccttccgactcggcgacccttctttcggtttcgccgagtggttgccgaccccgtccgccgttccgtttcgcccgccgaccgccggagcaccgtcgtcatcgtcatcccgagccgcgccgccgtcttcttccgctccggccgccgttctcgtcgtcgtcgttgtcccggggtgagccgaggaccgccgttcgccttcccccttccctcctctctctcgggtgccgctccgccgcgccggtggtcgccggcggtgaccatcggggcgcgggcgcgtccccctcccttcggccgcgccggcgaggccgccttcgggcgcgccccgcggctgccaggtggggcccggccgtcagccgcccgcgcccgcgggtgcggctgacgcgtgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagtttagtagtgtaaaagcccttttcttttccgttggtcgtgtagacgctgcagcttcggaagatccgctcttcgtggaagccgaagccgtcatttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagaataaataaaaccccaactagtgggtactctattcatggttccactagtataaatttaggtagatgcttcgctgattaattaggcaacattaggtggttttataactttagacttgggatattctcatatcatttggacactatggaatggttggcttatgttggaattggacacacacctctcttcctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctattattatccccttgtactctccttgcattaatcatgcatctgccggtgtggcttgctgggtactgtggttgtactcattcttgctcaatctttcccctcttcagtaagagaagctttggagaagatgtcttaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttccttcttcaaatttcaactagtactagatggtcagctttgcgaagaagaagatgtcgtcagttgtttgccgaagctccggaaggctgcaggatccgctagcgaagcgaaggaagcagtgaagccagctgtgaagcaggagtgaagatcttggagaacccgtcgcagaacctaagccaccctctagtgtttcgtttgtcgtatgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaaacatcacggccagaaggacatgccatcacctggaacgagttttcatctgtattcaagagatcacatgttcccgcaggaatgatcacactaagaaaacgagagtttcgctacctgaagcaaggagatttgaccgtcacagagtacctgcacgagttctatcgtttggctcactatgcaccagaagacgtggaaacggatgaaggcaaacaagagaagtttctccaggggttaaaagatgagctcgcagtgcaactactcctagaggattatgaagattttgagaaacttgtggacaaagccatgcaactcgaaagtgagcataatcggatgacgaactgcaagagaaggattgtcaacatcccagtaattccaggtggtaaccaaagacagcgcactgagccacttcagatcaccggatcttctgttgtgcatcaagagttcctgccccaagaagatgaacgcaatgcagacaacaacactagcaatactaatgatgatgataccaccaacaaccatggttcttgccccattagtgaccactcgaacaaagcgtgcaatgtcagtagcattcaccaagatgtcaacgatagtatcaatgttggaacccagaatgacaaccttagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccatacctgtgaggcctcatgttaattctaacccatagtagatacaatgtaccgatgttaagcaccttccctttttgtttaaagcagtgcctcgtattcatgtaatatgggagaaatttgtaataaaaacaagctctaagaggattcttttggaagatgcggatatgtgatcatgtgtataattgtttactgacaaaggagacctagggtctcgtgccagaggaactacattctaacctcgagctaatcaccaacctgaggatggaaaagaaaatcaagtgattaaccaaagagacatttgtttggactaagagtttcagatgtgtctttttcggatcaaaggcaatgacagtcagtatagcttttggcgaaacacttcaaggtttcactgaaaggcagcaagccaaaggacctcatcatccccagaagcgtccgcaatccacattaaagaataccccctgttagagataagccgaaagaagattgataaaagagattggcaaagatgttctctagcatgaaagaagtaggccgaaaggtgattgataaacagaaacatgctctgcatcgctcaaggaagacccctaattgtaattgccccacaacagccaccttgtcattaagtaagcaagatgacctaggtaaaagtgtttctatgaaggcaaggggtgaagtcttcaactcggtatcagatgctacacggagtgaaaagtgcaagccccggttaccaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgcgttgcttgttcgtgggagctattcccagttatgaatcaggtgatacgttcgaagatagtctacagaggtcagacaacgaagcttcagatttggcaggataacgatcaaacaataagaagtccagcagtaaagccatttggggagacgccaaagcatgtcaagtgggagaagttggttcggttgagaaacataattcaaaggcaaagttatcgaccctcgcatcgaatagcagaagtagctagcacccggagaccaggaaagctaatatgaggcagtttgtggcaagttagaagtaaatgacaagcctgatatccttatgacgacaagctggtatcacaagcatggtatcctagtaatgtcgagctgatctcgacgcatgacatgaagtgggtaacttgtatgaggttgactccaaagatgtgaactatgcaaagttctggaactgaagccccatcttcaagtgccgcaacccagtcgaagtcagctaaaggttcaaccagggacaagtcaggtgaagagaagattccatccgcaataggagatcgagccaagcagtcccgagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttcaaaaaggaataatagaattaattaaaattcgaaaagaaattggcaaacactaaaacacgtacaagaaaaattcaaatgtgacccggagaatttttgttaaattctccttggtctaaaaggagccctcaaattttagtggaattttcagagcacaaataataagtgaaaagaaataaacaaagttaaaaaggttttataaaaagaaaaccctaaaagaagtcttttccccctcctcctcccttcttgggccggctcggcccattccctccctctctctctctctccccccccggcccatcggctccccgcgcgcgcgcgcgccgctgacaggcgggcccgcccgccactctcgctgacgggtggggcccacctgtcatctccctcctcccgccgcgccgccgcccgcccgtgccctagcgccgccgccgccgcggattgcgccgcatcccgccgtccccgcgcgcattaaagagaggggaatcactccccgcgtttccctctcccgattccccctcttttccctctctctctccctcggattcgtccggattcatcccgcgaagttcgccggcgtcttcaatggcgcccgagatctccgcgcgcggtttcctctctcttggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgtcgaccttcggttcgccgccgacgtcgctccggacgtccttccgactcggcgacccctccttcggcttcgccgagtggttgccgaccccgtccgccgctccgcttcgcccgccgaccgccggagcaccgtcgtcatcgtcatcccgagccgcgccgccgtcttcttccgctccggccgccgttctcgtcgtcgtcgttgtcccggggtgagccgaggaccgccgttcgccttcccccttccctcctctctctcgggtgccgctccgccgcgccggtggtcgccggcggtgaccatcggggcgcgggcgcgtccccctcccttcggccgcgccggcgaggccgccttcgggcgcgccccgcggctgccaggtggggcccggccgtcaaccgcccgcgcccgcgggttcgg

SEQ ID NO: 73384 - DNA, 9338 bp, Oryza sativa
ccataatgaccggaagcatgatttttcatggcttacaacatatgcagaacaacattcaaaccctaaatgatggtaaagaaatggcctaggtacctaacaggttctcatcaagttatagtacagacagttaaactacatggatataatgccggcatgatgttcgcgatcctccacaagacaaacatcgctatactcacgttgatgattcgtggccattgacagtggctggtgcaggaatttcttgctcggtggtaggtgctgcagcacttccattctgtggaggaaaagtagcagaagcttcaaaaattgatttgtttgaaatatcaaggcatattgaagaagctacagagaccggaaaagagaatttgttggttgtaacaggatacagaaacttttaggacattatacttgatgcctgaaatgggccataacttaggctgtttctttcgaggaatcaatcacatatcgagggatgaggtggttatggaccaacacattccattcctcgaaccgaacaaaaaagtgagacttgggagtatctgatggtccattggccatccaattcctcaaaacaaaacaacccctaaaattcttaaatggccacatcattataagccatactgccgtcagaaacaaatgtaaactacagtatattgatgctgaagctagcctcaggctgccagtgcaaataaaggaaaacaagttcatatttaaccggcagtaaacaaaagccacagttataggacagctttcatattttgaataccaaggagagaagaaaataacatgcaaagatgcccaaccgtcagcattaaatcttcccatagctaaaccaattatgtgtcatgattttaagtttacaactatggattgaaagtcaaccagtcacaccagtgaccagtataacaggaaacaatatcagtatatcacactatctaatatcctcaaatttagaatggaatagctagagccacagttttttaatcccctggcaatggaccataacttgatttaccttcataaaagttaagaaaatattgagaagccattgtggaccaatattttgattaatttctccaaaattttcagcaactgcttaaaaatggctacaatcatcagtaagctagataacgaaacaaggattcaactcatctgagccaaagagtcatttcactttcaacttattgtgaaaattagaatcctcaaaaagtatgtaaatagatgtgcagctaatgggggaaaatgacttacaccatcattaactgatgccacaacttgaataggtgtgggaggtgcttttgataggtccctcaacatcccctacaaaaaaaaaaaagagatttgtttttagtagaaaaacagagattccacatttatgaggtaaggtgtcaaaaatttaaagataagatctaagtactttgatcacttgatgtatggattactaaaaacaaacagaaagagaaagcaatgtgaagcatagtttaaaagacccatgctttcagtgtaagtgtataacagaccatttatggatttggattatggattaccaacaatttcctgtgtttgtcaacaaataaagtttaaaactcttattgccaattaacaaaatgctcagctatgaaactttccatgcaccaggaagcacatcagattgttaagactaatattaatgatagtgtgaaacttgttcaagaacagacagaactcactaaatagattacatattcaaacatcagcaccatgcatctaacttcattgcattggattgtatactagaaacttcaacaaaactcatcccaacaacctatactcaaataacaaactgcataccaagttggcatgacaccttgaacttggcattttaaccttcaattgcatatatagatatacatagaaataagtcaagacaagtgtgagtaactggtgctttaaatatgtcacgataatagcttataaagtgcaaattaataatgtaacttaaacaatttcaacaaaaatgatcctagcaaaaaattgctgatagaatcttaatattaagtcggtcttcagttcttagaagttataatattttgctacatctatgatctatcacaaagtttgacttataagttataactcttgagtttctatgctgacttaaatctagctatgcaatggtactactaaacatttataggtaccttgtttgcccacatgaggccacaggcattgcataatgttcttggcccatcaggtccacgacgcatcataggtgtagcctttgcatttataccacagtgatggcatctgaaaaaaaaatagcaatcaccaaaatttataaatgatgtttcatatgcttagagaaaccacaatgataaaaaggtagtaataacctggcatacaccatacaaaaaagaagcatatttgcatgtatgataagtataacaaagatatctatatcaaacttacatgcaaattgttcaactaaagttagccaagtaaaaaatgggattgatccacagttcatagcatctatacaatgcaatacactagagcacacgattccaagcatggattgattgtcaacaccttgctaataaatatgtaaaggatgtttcacacatcaagaaatattgctggaaaagtcataaaccaagaaccaaaaaaaatgggatttttctctacttactcagcagcagagggaggccgaccttccactgatccccagtttggggagccatctgaagctgtcaattccgatgttgcttcatcaccctttggttttgaagatgtaaactgacctctattgcgctgcatcctacacatacatagaaaatattttaaactatgaagatttcctgtacataatctaagcagaggtaatttagaaaacatgaataacagcaaaatataaatcctactatctgccacggtaatatcaaaactgaaagtaaccacaagaaagacactgatacttaaaaaggtactacctccgtttcatattataagtcgctttgacactgatactttgatctttaagtttgactaagtttatataaaaatatagcaatattttcaacacaaaacaaacttattatcaaaatattgtaaatgttagttctaacaaaactaatttggtgttgtacatgttgctaaatttgtctataaacttggttaaacttgaagaagtttgactacgaaaaaagtcagaacgacttacaatatgaaacagagggagaatagcttaataaaagcagccagacaactcaaaactaaaacacgcttttggtacaaatacaatgtataagttgccaagtttagattatattattcagttcacttccactatattaagtacattgttagcagagtgtattactcacagatcaaatacagcacgcttgactcttcctaattcaggtcaatcagcattcaaataggaacaaaattctatagcatttcagtacgtataaacatccacagccaatgctaagctagcaccaacctaagtgcaacttccttccgaacagaataccggatcttcttatcaaagttgcgctccttccgcttttctctgaaccgcatcaaagatgccacccggtgtggaaaattcaacctctgaaaccaagggaaaaaaaatacacaatgaactccagagtgcacaatcctgtcaaacataatgaactgatactacaaagaaagacagttcaccatcacccgtgccaaccttactgtatggcgcagatgacgatgctccagagcccaaacctgggttcagctcccttccaccgagtagcaagagcactgcttgaacctgcgagaagtaatcgaacactcagcctttttttttttgcaacatcaatcccagtctataccgaaacacacatgacaaacaaacaaggccaagcgcatgagaggcaaacgaccttgtcaggggagacagagtcgaagacgtagacctcgccctggaacgagagggtgagttggttggacgccatgggctggacagcgccggaggcggcgagcatcccgccgtgcgggtccagctgcgcggcggcctccgcgtccatcgggacagccacctcgccgcccaccccctcatgatgttgcgcgtcctcatcctcctccatctcctcctcctcctcctccaactcatcctcctcctcctcatactcctcctccgcccccagggcgcggtgctcctcctcgaagcgggccatcgcctcggcctcggcggccaccgcggcgaggtggtcgaccgtgggcgcgacgtgcgccgccgcatcgtccgccggggccggaggaggggggcgctcggggccccggcgtggctggtagggcttgctgccgtcgtggtgggacatggcggaggttgggggtttgggtgggatcggatcggacgatggggatgcggggtgggtagaggtggccaaacgggcggcccggcccggcacggcacgggcacgggtccggcacggcccgtttcggcacggcccgttaggcatggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgctgtgccggcacggcccgttactgtagcaggccgtgccgggccgtgccggctacaggttccgccgtgcctcgggccgcccgttttggcccggcccgtttggccacctctaggggtgggagagaaccctagcccctaggatttcgatctcctgctttccggtttggagggtggaaatggacacgaggagggagacgggtgacggcctgacgggtgaggggagagcgtaggactataggagggtgatgtggcagcatcacagccgtctgatctgctaccccctgtatatctatccctctgttttcaatctccttacactttcagaccaaaagcgaattatgatattgcttctcgtaaatcgttataaatatactaacgttttaagcttgtggtatgaagtagggtttaacttttcaatttcgaagtaaaaatcgattctcaccggtgtaccgaaatccaaccaaaatttggtaaaaaccgacgactttcggttagcgtcatacgaaaaccggctaatatcacccggttttcagcaatcttaaaaatttacaggattaagagtaaattgataaatataactgacaaaaataaaagaaaaaaaacaacagggtcagtaatttccataagacaatcatagcatccataacaacaagctgaacagattcgcaagaaaaaaaaacctaatgaaagaaccaactttttccgctgaaatgttcagccctatgaaagatttttcagtcaactttcagctcatgttgatgcaaaccatcttctcatgttgctgtaacaagaaaaattaaagatcaccgtgacggcatgacccacgaaaaactaaggggttgtttgactcatatactaacattgcatagggttgtcatagttttcttgccaagtttgtctaaggttaggccaacaaatttggcacgacacttcggctagtaatccacaaccttgctacattttcctgagacaatgacgcgtgggaccaaagtgctagaaaaaaaatctagccacaagtgtggcaatgaaccaaatgcatgactaacttattcaaaaagcttccttaagttgaggtgtggcaatatttggtcatgaaccaaacaacccctaaagacctatgaaagattttccgttcaacttttcacggttcaaacaactatgttgctgcgaagtgcaaaccatctcctttccatgcaaaaaagaggactttagagtcactgatacgttggtccatagcaaagaaaactcacatgtcagtgacttaggtgacttaatttgaacacgaaatgcatgctgcctccccagggccagagccgaacaagcatcatatagtagaaaacttaaaagaagaaaaaaataaatcatctgccataattacgaaaattaagtcattcaacgccaacaaattgtcgagacgaccattcagaagagttgaattgtccgcactttaaaattcagacgagaaaaggcaacatatatgtaaacaccgtactagaatttttttttcggttttgttctcccagttttgagtcagtcatttgaaattttagatctcaattgctgtacacaacgataaaagcaacacaagaatcatactagttgatcaggacttgaagatgaagatgaaggactgaggagtgaggactactctcgccgcatccaccgcgttgatctctctccagataagatgctctccggccggtgaggggacctccaccgcacatctcctcccagcctccaactcatccccgcgcaaactggatgtgggcactgggcagtgcctctagatctgcaagggcggctccaggaaggggatctggcggtggtcgttgggcacctcctcctggtctccaccacatccgtggcagcgtcttggggcgatgccttactacttcttcgtcagcgccgataccccttcccggcctcgtacgtgcaaccaggttggtggaggcagccgatggcactagggaagaaggtcaatagagggcatcatcgttgacacattgtagctcccatatcattgtggccttctgggtgggtgtcagcgggtggtgtggcgcgcgtggatgactggtgacagcggttgctgacgaaggaatggggttcggctgaacagggatttcgatcgaccgggagtgggggaacgctactagtgccaatgcgaatgaaaatgccgcctgggaataacattaaaaaaattacaaatatacctttttttgaatttataccgcaaaaatcaagtggaacatcaaatcaatatatattgttatatcgtttatactgctaatatatactagtacttgctatatggtgtatttctcgtaaaaagttatcgtcattcaaactttaaagaacgacgcacattgatgtcaactttcaccccatatcatggatgttccctggaaggaaaaattcaatagggattggatcgaccattcattcgacctggaaggctggaacacatgaagccattccagtagaaaaattaactctccaaatcttccatctgagcaaccagtactccactcagacacattgtgtgtgttcagtatgggtaagcccattctatcatgaggatacaacaaggcccaataaagggataggcatatactatagcaatgcacttcacagagtgcgcctcaaattgtttggtccgtcatgactagcagtggcagtaagcggcgacgtgatgtactagtggctgacggcgccggtaccagtgccagagaagatgagtaggggaatgcgagagaaggatgcgagagaagggaatgtgagagaaatgagttgtgcgctgtgttgctcagccaggagagaagggaatgcgagagaaaacgagttgtgcgctgtgttgctcagccaggagagaagggaatgcgagagaagatgagttgtgcactgtgttgctgtcacgctcagaaattcccgagtagaattccaagcagaatgtgcattaaaatccccgtccaggaccggccggggtacacaaacgacaatgttgacattcagatccatgtcttacaaacatcataaaagtcttacacaaatgcagcggaagaaaagaaagacaacaggagctaagccttgactagaactgcagcgggaacaccactccacaggcatcctcgacggcacggacgaagcctactcctcggagaaaccttcatctgacacatactcgagctctggggttgggaaaaaatagagcaagactgagtactacccactgtactcagcaagtcataccggaataggggtatgatgcagggaattatcaaagaagagctggagtggttcatttgcataaagcgagcatttataaacagaagttgaaagatttaaacagttgtaataattaatcaatattaactatccactgtccaacgctatcccacgttgcaacaggcccaaccatccacctaaactatccaatttcaaaagattacactagggtaagattaatcacggtgaatctggttgaccgcccataaccgcgggcacgactattcgaatatttttactctgatcagaggtgtacaactgtacccacaagacacagccccacgacacgtttccgtgcgccgacatgccaccacgacataccggaaagaggccatgacaggacccttcgcataaccccctctaaccaagcacaccacacctcaggtttcacccccactcctcgcaaagcagcgggcagtcccctctcatgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcgaaaccatgcacccacagcccaccatgtgatttattttaattaactaacaccaaagcggtggcactaatccaacaaaaccattagaaccaacagtctaaacattaataggattttccccattgtgaactagttgaactaagcatggctaagcaatccctagcccaatctctagtcatgttatgaccccaagttgacaaagggacatggtacaacaatagcatggttatgacaataggtaaacaccccatagtaacattataaaacaatgcaatatttgaaggaaaacaatagagcatttgcaatataggatcaacatgttcaagtgacaagcatgacttgccttgctctgctgctggaggaacctcggcgactatttcgaagtacaccggagcgttttgaggaaacggaatctagcgacatacaaggcaaacaatgcaaacaggctataagactactgaaacagggaacaaaaccatttttaatggattctacatatttttcttgatttactgagacttgaatgggcttaaac

SEQ ID NO: 73385 - DNA, 15766 bp, Oryza sativa
cattttgttctgcttggacactttcacacctttgaacactaactctttcatatgtctgcaaaaagataaatacgtgctaatcagcaatccacccaaaagagcaaaatagtcataagaaagtagatcagaacagtggtgggaattggtgtcagatgtgaagatcctaaaaagtaataaaaaaaattgaaactgattatttctacacaagaacaatccaacagaacatgatctagtaaaacccatctattcgacaccaagtcaccaatacttaaacaactattactaaaggaaaaagtgaaaaacagtagaaagaaagtgggtttacaaactatacatgtgtttcgtaggattgaagctgtagaccagatgctagggttccatgcgcatatggaacatgatagccaccatccagatagttgtcacaaaagacctgcaagagaaggatccgatgggtataagcatatactgaaaagaagcttattgcatttttcagtttttttgtatcgaaatatcatcatgacagtttatcgataatgcaccttccaattacattcaattatatattctcgcctgcaaatatgaggcaacgaggtgtcaatgccatttctactcagcagatccgaagcactacccagccattcatctccaactgtgttatcagcagtttcttgagagaaaccactatcaaatttggccaatacaaaaggcccccatgtagccactttaataggaatgagaccaaaatcctgtttccagaaagaagcataactgcatgagttctggcagtggaatcaggaagtatagaagatcctcaaaaaagttgggacttacatttttgttgaagttcttgattcctgatatttgtgtggcttttaggaggactccatccagtccatatgtccagccctacaaaatcgtaggactactgtctcaagagagggcagaactataagcaactatgcaagtaataatactattaccaagtcctgtgtctgctgaaataacaaagcagaagctttgtcacccccaataattcaaatagactagttaagtatgcatgcagtgatgcttcttttttattattcctagttcatacttttaagtatccaggtacttaaaaggtgtgagacgaactaccggagcacatgttagagttcaagatgttaatccccaagtcatgtgggcatatacatcattatcgagttagcatttttaagtagtatgtggcttctgtccttcaaaattcaacatttcaagataagttactggttacatttgtttcctcaacactcgatagtggaagcatccaatactgcacaggacaatgaggacataccacctattgaaatgtttcgtaaggaactcacatgataagggcactggaagcaagtcttctgaccacttccacatgcaaggagtgaggcgtgatggcgacacacgttgtgaaaagcatggagttctccatttgcatcccgacatatgacaaattctacatttccaagtctactacatcaacttgttagattatcacaatcatgaatatccaatgtaaatgattttattttacagaaatttgggggtaatgatgactaaagtgttttctgtgcggatggctatatagaaatgtcataagaccgacacctttatgcgtataaaaataaacttcatggtttgcattagccactacaagattctggctacagaaggatgaaatcaccttcctgtgaagtagtcatttgggttcttgacttgccatatgtggcctggaaaacaaccatgaaaggaagcacaaaacaagctttcagtaagaagataaaggtgactatcaacactctttctgaactggccacaaaagttagtgaattatacactgatgatgatgcaatgacagtgaagagaagttactacaaaagcataaacgacaaacggatcagaaagctaatcaaggtgtctccatgaagaactaaacctaggaagttggaactcaacataaaattgaaatgagcaaagctactaatggacaacaattgtacaaggagtctcaaatgcaagtccaccatccagataatccctcttttgaaacacctacacaagtcacaccactgtcaacattaaggatgttggtagcccttgatcctgtttagccatgggccctgaacccctgaactcaccccatttcaagcaagtgagaagcgagctctcaacttccacactcccactcgcagtctcactcacatcacacatattcccctctagacaagtcatccattgatggcatacagctcaagtaaaatccaccattagcgatggtttagaagcgatctccactgccagcgcttgtacaatcgtactaccacacaactagcaaccaaccaatcgtgcggaaactaagaacaaatggaggaggggggttgggagtgtgcgaaatcgggagtatataccaacagcctgccacccgcggaggaagacgcggtcgagctcgagccggagaaagtccgggtcggtgtaccacccgctcggcggcgtcacggcggaggccagcgggaccgccgggtcgaacgccgccacgaggcgccgcgcggcgggctccggcggcgccacggaggaggcggaggcggcgatgcggcgcggcgcggcgcgggtcggccttgggcgggaggctcttgcggcggatgataccgcggccgcggattgcgcgatcgccatcgccggcgccggcgcacgagtcgcgagaggcgtgggaatcggagagaggaggcgagtcacctgctagcgtggcaatgttgtcaaatttggtttatgaatttatgatgttgtcaaatttgatttttaaattcgagttttttttttttagagatggaaatttggtttggctctgttcgatgttcttgttttctcatgtctctccaatccaacctaaggctactaaccattattatgtgtcacttttcaaagataattaaaatatgcaaaatcgtatgttgtctattttatttcaagctttttcaaaaaaatatagagataactaaaatggatacatgcatctcatcgtctacctgttaatatatcagccttagctaaaatttattttttaaccttaaatttagagtatgtttgggggttttcattcatgcgagtgttcgtttggagaggatatggagaagaaatctctcgtttttttgcatgcacgatcccgaatggcttgatggtgtatttttttacaaatattctatagaaaagttgttttagaaaattattttaatttgtttttaaaatttaaaataattaataattaattaattatgtgctaatgactcatcttgttttatgtatgttttcaatcttcttatttccctttctcttaaatgcacaatatagtatatttctatatttttactcataagttattttgtattgctttgttttttttttgagaaatcaatgtctcttaaaattcttaaaatgtccaagtcctttggaacaatctaaattatcgctttagattttgagacttagtaacaatagaatccataaataaactactaagtatgcagaaactaggttcttcgaattctcaccagctaaatactcaatggctaatctttaccaccgaaaccaaaatctttatacggttattccctgtttaactgagcttagaattctaattctaagtggtgaaaagctaacgggcgagaatatgaaatataattttatagtttctggattctaatttagtttttaattacataagtataatttctcaaaatctatataaaagtctggacaaagggttggagatttctatagaaagtagttgataccccgcgctctgttgtgggatatgtgaatgaatttatgtgatatattatataaatgatagatgtatatgtttaaataatgtaaaaatgatgtggagatggttatttgatagtgcttacatgttgagttctaaaagaacagtaaaattataaataatatatcatatttgtatgagatttaagatactctatataataattactagtgggtgatgatgtggcatacttgcgtattaagttttagaagttagtgggtaccaatagtatatagaaagtataagctctctcttaaacatagccttaaactgtttacggtccaaggtgaagcctactcaatttgggaagtctcggttgctccttgggtactcctggtccaagatgcgtaccgtcggcccatcggcccagcaagccacctatttattggtcgggccagtctaagacaaacagaccaaatttacttaaaaaaggggtatgtacacatttacagagttcaaacttcgacaataagatgatgaagtgaatggatgttgccatatgagcaacttcctaaaatgaaaacaagatacaacaaggcgctactctcctaaatatttggaaaccccatattctttccagaccacgacctcctctttaatcaaggtaaagaggatgcccgctgcttgactctgactttggaaaacacgtatatttctcttcttccaaaccatccaatagacaagcagcacaagagtgtagaaagcatgcatccctgtaagctggtctgaaacccttgccgcgccgtgagccaccattctcccaattccattcgcgcttctgcccacagttggaagccgattcatgtccatcccttgatcatcctctagactggaagtgcaagggcaggaaataaagagatgcccagagtcttcgttgctgatcatgcatagcgcgtttgctcagattatcagccgttagacaacgtccaatttatgttgtgttgcttgataatttcactgttcgtcgtctactcttctggcaccaatctgaacatttaattggtgttactatcaaattacgaatctaccgatctgaacaaaaatcatatcacaagttccctccgaaggctgaatcagaaccagtgaatctaccaacagaaaacagtgctacgcgtttagagcagttacaatagcaggctataaaccagctgcaaacatattttaagaagataaataaggagagagaagagcagcgtttgtagcccgctatagcacggactccaagacgcagtgtgtgtataacaggtgggaccatgtattattagtgtagtatataactattgtatgaataagctattagattaattatagttattgaagctagtagttaactatactattaaacttggcccttaccatttcttcacaagttgccgtttctgctgtgccaagcaggtcgcactcctgcctgtgcctgaagggcgaaagaaaaggaagagaaaaacgtcctcaccacaacccgtgccgactgagacttaccgatcgctctcgcgaaccaagacagaataccgagacaattagcagcgttccaacccgtactaacacctccaattaaatcaaatcaatcgctcgcttaataattactaataaataatctgatgactcagcggctgcagcttgagctaaaccgacagtgaacgaaacggataagatcatgtactgctgctgcgctggtccaacgacgtgaccctggtttcgatctcactcattatctctccatctatctcctctccaaagcttatcctctctcgcctcacttttcacaaccctgtctttcccatccctttcgcaaccaaccacattttgaccctcctaattacaccaatttaattaggctgtgtttacacacaacttttcagtcacatcatctccaatttcaaccaaaattcaaactttgcgctgtactaaacacagccttagataattaattaccccctcactcagtcctaaaatataagcatttcatcctaaaatatacttcctcggtccgaaaaacgaatttagaattgaatataacatattctaacactataaggcaccctttgattcaaaggaaattcataggaattttagaggatttctttcctataggaatttttcctatatagccctttgaatcaaaggaatggatcttatggaatcctatgaaattcctatggattgcctaatgccatgcaaattttggaggaattctaacctgaggtaaaacctcttggaaactttcctttaagtctttatctctcctctaattcctgcgtttttcctgcggttcaatcaaacgactattcctgtgtttttcctgtgttttgcaatcacctattttacacttacattcctatcaaaaacctgcgtttttcctattcctatgttttctcattcctgtgattcaaaggggccctaaatctagatatctagtactactttgatttttttataagacagaggaagtaaacatctttggctataaaactagataaatgtatatccagtaataactaaaagttgttatattttaagatgaattagtaattcttttccaaaatcataagaaattctgagtgttttcgcgtcaaatccatgctaattattgagcaaaacctggtcgattagtactaagcgctatactagataagctctccgctgaacctggtcaccgatcacgatcagttgcggcgtccacgtcttgtaaaggcgttttggataagcctccctctgaacgtcctgtccccagtatggccgatgtgtaggtatagtagctagtgtgttcccctgatggccaagaaaagataagatgatgaaatggagattaaattactcctaataaggtacaatatgggcaccaaccagcaggaagaatcagtttggctttgcttctgatctttagcaaaacagaaaaaaaaaaaaagaagtcatcatgctgatgatagtattgttcattcatggatggatgcacacaaggtggttacaagtgtggttgttggtccctaactaggagtacttatatacatgaaacaattgcatatgcattatgcagatgagataagtgcaaagaacagattgggatgactaattgggtcttgattaattcatctctgcatgcctcctgcagctatattgacagaaggttattgctattgaacaaaattgaaggttagcccaatgagatcaaaggcactagctagttaggaattagtaggatacatacatggcatatatatgcaccaagaattaaacattgttcaataggagttctccataagtgtatttggtgcatgatatgatgctctcatctcttggtcaatgcaattatgcaactaattaacagtgagtttgttcataggtaggattggcatgcagctaatataagagaagaagaaatcaagaaacctaagcactaatataaggtatttttgatggttgatttgatgagatgagatcccaaactattacaaaagggatccatccatattatccatctctgcttaattaatttgtcctcactgaatttgattcttttcatcatttcatcctcctcctcctcctcctcgtcgttgtcctcagccattgccgccgccgccgccgccgtcgtcgggcggcggtggatggtggtgcggcggcaggaagggcgggagcgcggtgagggaggtggaggagacgcggcggatggaggagcagcggaggatgcggcggcgcttgttgaatgggttctccggcttggcgaggctcgccgtggttgcgccggcggcggccacgtcctgcaggttggcgaacgacctcgacttgccggagaagaagttggacagccccctcctgcacccatccaccattagcgcgagagatacagctagctaattgaccaattcgatcgaagaaacaatgcttgcttgattgggagcgcgtcgtcgagggcgtcgaggcaggcgagcgcgccaccgccgccgccgccgcacttcgtcttcgtcttcctccgacacgtctcggccgccaccgccgccgacgacgccttgctctccacctcctcctcaccatcatcctgttcatcctcggagtcggcgccaatggaggaccgctcctcctcctcctcctccgccttctcctcgaccgtctccagcacgaacagcccgtgcacgacgtcgccgccgccgccgccgccgccgccatcatcccccactaccccaccagccagatcctccagctgctgcaccacgtccttcctcttcctcgccccaccacccccaccaccaccgccgcacatcccgtacggcgacgacggcggcgccaccgccaccgccgccgccgcagccgccacaacggacatcgcgtcgcccggacgacgccgccgctctcatcaatggcccggccggcggctcacctctcaaacgagactcatggccaccaccaccaccaccaccgatcgatcgagacgtcgtcgacgacggacagatcgacagacagaaggaggcaaggtgatcgccgcggcggtgtatatagccaccacggcgaggggaggaggaagacgacggcgacgcgtggagagggggagacgtgtcgggggcagcgagggcgacgggggcaccagagacacacaggcgagctgcatgcacggcaacacgtacgtttcagctaaccttagctattactattagctttaagcttagcttagctttatctcatctttttgtcatgctatgcttgctagctgcatgcattattggcttattgcccatactctctcaccttacagtactaccttaggttagctgtagcggctgagtgaacagcacgctatagctcacgggctatcttttcgcttgtatttatgcttatagtaaaaattaaaattttcaacttcaaattaaaagttggtcacagggtattctcatcctgatttagttttaagtttacttttagatcgttacgagaaagtacatagaagttttttatttataaattatttattttgcaaatatgttatttttggtttatatttctctaataagctagacgatgggttgttagctgtttccataatcaagaagtatcatcttatctgcaagctaaaatttgctctgtttaatcaattattaaattgatttggcacacacatatgatgaaccagtttagcataactggggtcttatccacatccacaacaaaccatattgatggatactccaaatcaagatggttcgtcttatctgcaagctaaaatttgctctgtttaatcaattattaaattgatttgggacacaggcgatgaaccagttttgcataactggggtcttatccacatccacaacaaaccatattgatagatactccaatagcatatgctctgcctcgtgttaattccatgcttgtaattgtaattactactccccttaatggagtacaagccagtactacattatatcttccccttgatgatttcctaagcatgcagatttactcttgttcacagttacttttagttaacacagagatgcaattatcttcttcttaatttgcacactgccgtgtcattccttggtattaattaagttcttcttgattttgccttttaatttgctatatataaagtgagcccccatttgcaatgtgtgggaagttggcgtgaaatgctgggaacattgccatgcatgcatgcaaaatgatatcctatcttcctataaaattatcccctactaactccttaagcttaacatgtaaagatgccacatcatcatccactactacctccgtcccataaaaattatatttctagctaatttaggacaaaatagtaggattggaaaatgaccacaataaccttatttaataaacgcactgcatgcacacattccatatatacaaatgattaaaaggaagtttgagagaattaacccatataattagcatacttaataaaattacaagcattagcagcccaaattatgtgggatggaaggaaacttatatagatgaatcaattagttgggccccacatggctagaaatacaatttttgtgggacaaaaccttggagctagaaatgcaatttttatgggacggagggagtaacaagatgccacatcatcatccactaacaatcatcacatttaaacatcatacaaatatgctatatctttatagtttttataatttaagagctttttaaatacaaacatgttaaattatcatccaacataatttatataatgttttaatgtatatttttattatgttttatgatatgtcaacttctgttagatatggccggtgataagtaattagcaagcaaattcaccttgactaatggttataaattctgtcgctttcatgatcttcagagataaacgataacacttcgtattttttttgattaatttcattgcaaggcatacgtgtctccaggtaggattcgattcccgtcaattaatttttacccctctgaacatttcaaggcacatagtttcttttaacaagtgactgcattttcgacagagacttcttgtatgctcaattgtttgagttgcatgcttgattaagtgcaaaattagagatcgtgtgtgaattaaaaagttacaaaccgatgatgattaattctgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgggtgtagtatagatctaacgatcatatgtgctcatgccccctagagggcctcctgcccaccttatataggatggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacagtagcccctgagaccttcacagtcaaaaagataatcttctcccgaactagattattccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatataaatatgtagcatatgcggtgtaaatccctgaataacatgatccgagtgatataccgactgctttgtaaaacatgatgagtgtaacctaaagttggctacattattgaaaattcacatagcaaaacagctataaaaaagcttgcatgttgtgaataaagaaatttccaaagtattgggcatacgccatgcgcatactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaggatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagcagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccataatgacaaagttgtgttgccgtgatgaagtgaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactagcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcagatgaggcggccggtcggtgaagacgtagacgcccaacaacggcggtataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccacccgtgcaggcgaggactcgtcgtcggcaacaaaggcaagccggtcggtgaaaacttaggcccccaacaacggcggcttattaggccaccccttgcggcaaggacatcggtcggcggcaacaaaggcaacccggtcggtaaaaacttatacccccaattacggcggcataaaggccagccgtgcaggcggaaacaccagtcggcggcggcgaagcaagccggtcggtgaagacgtagacgcccaacagcggcggcataaaggccagccgtgcaggcggaaacaccagtcggcggcggcgaaggcaagccggttggtgaagacgtagacgcccaacaatggcggcataaaggccagccgtgcaggcggaaacaccagtcggccgcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagtttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagctcccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcagaagtagccgatgtgggaataaagcagtccatcaatggtgacaaaaacaccagtcggcgccagtggaaccaagccagtggtgtagatgatgaagcccattaacagcggcgaagtccgccaaccgtataggcaaaaacaccaatcggcagcggcgaaggccagccggtcggcgaagacgtggacgcccatgaacggtggtgtgaccaaccaaccgtataggcgaggacaccagtcggcggcgacggaggcaggccggcggtgaagtcgtagacgcctaacagcggcggcataataggccagccgtgtaggcggaggcaccactcggcggcaacggaggcaggccggcggtgaagtcgtggacgcccaacagcggcggcataataggccagccgtgtaggcggaggcaccactcggcggcaacggaggcatgccggcggtgaagacatggacgcccatgaacggtggtgtgaccgaccaaccgtacaggcgatgacaccagtcggcggcgacggaggcaggccggcggtgaagtcgtggacgcccaacagcggcggcataataggccagccgtgtaggcggaggcaccactcggcggcaacggaggcatgccggcggtgaagacatggacgcccatgaacggtggtgtgaccaaccgaccgtataggcgatgacaccagtcggcggcgacggaggcaggccggcggtgaagtcgtggacgcccaacagccggggcataataggccaaccgtg

SEQ ID NO: 73386 - DNA, 756 bp, Oryza sativa
cctgcagccccggtttagggtgtaattcatactcattcaatactccatgggggtaattcgtacttttttttcttttactgttaacttaattaactaattaaaagacatagtaatcctctctagccaatttattctagactgttgtccttggattgaatgctgattatagatcgttcctcgtgttcgataccctagaatactctaaggggaagtgctataacggtgtggttaagtacttatctgtgatcttaagactaccaacaatacctaccctcattaactaactatatttatttctcaggccaatccaagtatgtacggattcactatgtggtccaacaatgccagtccgaattatcatggccaaaaaataactaaggctaaaacacacaaatagagtacatgcgaatgaagcagcaggaaatttcaatacgcgctgaagaacatagaaggggctggtaggcaagatcaggctcgagttgtcgtcacagatatactcgtatcgttcatctatgagacattttagctctattatcatatccttctaatggtttctgctactgtatgggtcatgaatagaaaactaatgtatctatttcattttccctcaattacctaatataatgatgtgatgtggtgagaacgccgccagcctcagttgagaagagacgtggcgttgacatgttaggttgatttatcggtttattagtgccgataaaattagagaaaggaaaatctacctttttttctttccta

SEQ ID NO: 73387 - DNA, 908 bp, Oryza sativa
cgtgattgatatcagatgctcagtgacacattacgcaactcaagcgagcatgctcacttagtaggcaccctaggctgtacactttatgcctgcggcttggatgttgcgtggcatcgacagcggctaacattttgtcaccgggagcagatatcattaggattggcagatcgatcaaaaccatacaattatggcgaaataaatccatattaatttcatgaatcatcatcatcatccagggctctgctgcacaacatggaatggaagtgggttaaatgctcctgatgcctcacaaacctagctaacctatatgttttatacttctaattaacgtgaaaaaaatagaaaaaaaacaacaacccgtttaaatcaaatgctagatgtgcaattttttgcgagtgagggatgcgcgcgcgcgcgcacatatatatatatatatatatatatatatatatatatatatatatatatatatatatatatatatatatatatataatattgtattatacattctcttgttttatagatgaacccttttcaatgggaaattgtatctttttcactagaaccaaccaccaaagaagtacatttgtatggttaacaaacataactccggggccccacttacattacaatatatatttcttgcacgcatgatcgagcactatatatatatttatatataggagacacaaagggtcctacactataatgtgcactcaagcagatatcaatagtgcttcagaaagttctccatgcggcgaaattaagacatatacaacagtgtgtttgtctacattttactcgtgtcaaaacatggagatgttggtttgggaactatatgatggccccccatttaaggataaccccgatcaacatttagttctaatacaatatatatgtataag

SEQ ID NO: 73388 - DNA, 10864 bp, Oryza sativa
attcctgcagcccgtggaggtggcatttgaacgtgtgacagagtatttcaataacagaagtgctgctgcaaacaaagcaacgggcaacccttccatgggcttccctgaatgtgtccaggatgagatgaatgcaaaagtgcaaaaagcacagacgtatcacgtgacccgcatgaacactgcggatacaaatgttttctccaacgaagcgcatcaaaggtttaaggttcagtcaagacagaagggtgtgattgttcatctgatatcgaaacgtatccataagaatcacaaaaggaacatagcgtgtcaaagcgaaatcagaagaatcgctcgatgttcatgcaacaaagcaaggctgcttcacaagccctgctctcatgtcattgccgtctgctgtcaggttggagtcagcattgcctcatacatgtcccccttctacagcctgtcctatctagtcaaaacttggagtggaaaatcagatgcatccaaccttgttgaccggaattttgctcggaatgtcctaaactacaaatttctgtgcccaggggagacgcaaacatggatccctgataaacgtttggagcgtggccttcctgcctttttaacatcagacaggatacatgatgaggagagcatggatgagggagatcaaaactgcacaactcaggttataacaactgaaaacagtcagggaaccaacaagttctcaggagaaactagtgatgcttgacttgtgttatcatccgacaacttatctatgcatgttagttgtatcataaatatgtactatccattgaacttaacttatcctacgtgacctttaatttcctttttaaaaagaaatcatgtgtgtgctatgcctattgtttgttctctgcaatctctaccattttctgactgtcaccgatattcttcttggctttgcagttaaactgttaaaggcagtattttggtgcatacatatgtacgggataatttactatttgccactctgttaaagtctgtgatgctttagcttatgcttcgaaaaatctttgatactgccattgatttttctgtgccaacccgcaccgaagcgcagggtgcacacctggaagtataatgttagcaatagtgttaattcaagcaatttctaatcaatctagcatgtaatactatactctctccagccataaaagaagatcgattttgactattcaaagtccacaagacacaaatttgaacgctagattctccctcataagtctgaaaataggttaggtaagtgcaatgccgttattcaagcatttgctgtaataaacttggatacataatttcatatgcgaaatatacattctaaataataagtataataaagttaacattatagatctagtgagatcaaagatgtgccgttgatttttatctctttgagcgtgtgttagggccatattcatgggtgtgtaaatgtgatgttgcatggcccactctgttacagaaacagaggtatcactcgtccagaaagcaaagctgaccaagtcacctttactgagattaacgcaaaatcagtctttatttcttgagtatcatagccatggattttctccttgaaggaaacataatgctggtcgaaactggatggaaacgcgcccacttcgaacttcaaatctatgaaagaatccctcgttacagcaaccaccgacctctttaaatcacgtgactcactgatgacaccatcaaagagacggatttccttatccaagtcactggttaaacaaccgagcaacaaattgaaactgctttgcacttctgatataagaatctctacggtggcctcagctgaacaattaaaacgtgataaagttatgtcaactgcaccgtaatcgccaggaatgcaaattgtttctggccgattccataggcctccagagcctatcattgatgcaccatcaatcagctgtaggtcatctttttcttgttcacctgtcttgatcctcatgtcatattcaattagagcatagtccatcatgtctattcctcggttagggccttccatgttgatgagcgaaccctacaaaattattatatttagttgctcttcttataaaagtaagaaatatctaaaggtggatgcttccttatgttgtttcacttgtaacagcatttacttgaaaggtccttaaagttggagcgtggtgtcacttaggtccacgatcttgtaaaatcaacattaagatccatgaacttgtttaagtgaatcattgcagtccaaaaacacgtctgaccgggttgaccgtcctacgtggcagtctagcgtggctacatgtttgcaattaggcccctccacgcccgatccacagccttcatggtgttggagacgcggttcttgccgatgagcgacatgacggcctcccgcgccttggtgagcacctgcgtgagcgcctcccgaccttcgccatcatgttgcccggcgccgttgccgccttcggtgggtgtttgttgcagcagcagcggcggaggggggacaggggcagatgcactggggaaggagaagcaacacaagccggtgctcaagaacaccatcgccggcggcgaccacagcgggaacaatgacggcggaggtggcagggagaaacagcggcgaccgcgctggcgtgagcaacaacagcaacagcagcgaggaggatgaacgcgatgtggcggcgcagaggatgggtgatgtggactagcgcaggtaccaagaggacatcgaggacaaaaccatcgccatggattccgatcctgaggttcatatcgcgccgagtaagctcttgctccgttgatctctagctttgcatgtgccgccgctgacggtgttagatttgaaacttttttggttgtttgcgtgtgccgccgctgacggtgtcaggtttgacatggcaaggaccctagcggtgcaggagatggagcagtggagggcgacggcgcaacgtgtcaaggtgtcggctcggtgacctcggcggccccgtcttggacgtctcggcggcaccacactccacgatgcgtgtgctgcgggaaggcgaggacatcggcacgacgcctgtcgtcgactctttcgagtggaaggatgcggccacgtacacaatgcctgaaggcagcgctgccgcctgtcgtgtccggcgtgacgtacaccgacaagatcaagttggcagcgacatgcaccacggagagtacagcaagaagctagccaccacaatgtacgagaaggtcgccggagtcgggaccgtcgtggactcgtggctggcaaggtgcagcaagtgacgcagtccgctggcaccgtgatctcaggcatcagcggcacctcatagtcacagggtaccgcgcaggactcggacgcctccaccacccttgcctccggcgagccagcgaccgggcagcaacaggacaagggggcgacggtcaccggctaaatcgccgacatgctccgtcggggcgatgaggaccgcgtgctcagcgaggcgatcttcggcatagtgcagtggcggaaggaggtcgtggcacagcgcgtgccggcggtggcggcagcggtgccgggcgaaacgatgatgaagatccgggaggcactcgcataggtgctcgctaaggtgcgggaggccgttacgtcggtcatcggcaagaaccacatctccgacaccgtgaaggccgtggatcgggcgtggagggcctaattgcaaatatggagccacgctggactgccacgtaggacggtcaacccagtcagacgtgttttgtactgctatgattcacttaaacaagttcatggaccttaatatcgattttacaagatcatggacctaagtgacaccacgctccaactttaaggaccggtggtgtattttactctttttacaactaccaagatcttcatcatgtatcaaacaaaagaaaaaaaaattatgtagggtactaagcaacaacaaagtgtccaaaactatttaacatgatttttctttggaatacatgtgttccttagtttcataatttaaacctgttctcatagtaaatcatcatttcataatatagagtacactccctatgtaaggtgcgttttggaaggagaaattcttgaaaagtagaattttgacctttaatttctctatcaatatatcaccaattgcaataaaattaacatcttaaaagtaattcgagtaccaataatttgacgatttttgccaaaactcatgaagtatgaattttccaaatcaaaatacacaatgatatttctagataagtcggatgtgtacctgctccacaatgatgggatcatccctgctacagttgacaatataattaagcaacggatctagatcatcccgcacagctatgtatccatacaactctactgaaccaccatccagtgtaattttagccaactccaatgataaaatttgcagcatgttgcaatgaacatgtgacatgcaagttccattactgcgaatgacacaatttgtgggattcgaaaacctcattgcctccaaccgagcttcaaaaaaagtaaagtcataatgtaagtttgtgaccggaaattaatacagtgaacaaacacttgacatttgaaaagtacatgtgatatttgatgattatatggccttattggatttttttttccttttcatctacaaagtagaaacaacctatgttctttttactaggagagcaacatctatcctagtatcaactacaagaaaaaaaaaactcaagggcagactacctcttcagaaagccaggtatattctttcctgtaccagccttttacctctacagaaaaccacgtgttttgggaagtggtctatattttggaaactggcaacccgctcctcatattaaacaggggcatttgaatgtttggttggccccttgaacacctagtagtcctttaggttatatatagtatgtgaactgcctgagtactttctattattgcttgttgttgctccctgcatgcttggaaaacttgtactattactgacagtttgtggctgcatgtatggagaatttaaacctaatggcaattacaacagtgtggatgcgatatttagattattatttgcacttatagttgtcattttcttgtgtattctgctattgaaatacatgctcaaaggctgtgtgatcaccgtgttgcaaagttcagggataaagtactttggacatttatgtaattaaatggcatggaataaggtcctagtccatgtcatcagaactctgcatgcaacctcagtccctcccatcaggctgtggcgcagattgctatgtatgcaaatggtgctaagctgaagggccagtaaaagtaaagtacaaggcttggggtggaagtgttactctcatccacgtttaaggacctccagtacaattatctcatagctgaaaagagtgtaaggcgggtaaaattatggcagtgctgcatagcaccacatatacaatgatctctaggatcgcaataaaatatttatagatatggaaagagattcgttatgttcaaggaaacaaattatctctaataaaaaataatatagcaaataaagatagagaaaagatagcttactctcattacggtctgcaatatgaaactcccttttccacggtgtgtccatgatgtccctatatatagagccatcacggtgtctactttttggaagtatgttgttcacagtatattcttcaggatcaagaacttcgtcctcctcaacatgttcctccgtttcactccttcgatcatcctcatcacagccatcctgcttcgcactttgccccagtacatcgtatttgatgtatgaaacctctgaggacgccgcatctctattacttttctcatctccagctctagcctccaagattgtgcccctggtgtcaatggttttcataccttgagtgatcgcagtatgcttcttttcctgggatggaagtcgcctgtatgactcgtcgccttttactcgactgatggtggtcatgttccgaggttcccaaggaaatctatcattaattaagagaatgaaaaaccaatatcaacaactaaaataaataagacggtaccatcagtcaggattgagatcatctaaccctgaaatcgataatcgatttctaaattttttttctcgatctcctttgtctttgtttcgaattagtttaaagaaacttattttccacaactaccttcaaacaaatgaaaacaaaacccaaagttttttttttttgcgaggaaaacaaaacccaaagttgatcgcagatccaaaaactgtggcaaaagacgcaaactttagcatcagaacaaggaaaaaaaacacatgcccaaaaaatctgtctatgaaaatcatgccaaaactgtagtaataaccaagtaaaggcgcagactttagcatcgatcagcacaagaaaacacaccgggaaacacgacggacgacaggtcctcctcgagcaagcaatggtgaccaccagcaccagctagccgctgcagatgccatgagagagggagaagagatgaggcggtgcatcggggcaggagatcgggcggcggcgttagagcgtcggagcagacgcggaaagcggcggagaattcgcatctgggcggcggcgggggttagggggaatagccgtgctgtggctgcgtgggggatttctgtcatcatcagaaacgggcatcatgtggatggacataattggagaaatttcattatttgacatccaattcgcaggcctttcagggcaagccactcaatacacattcctttcagattttgtcactgcgatagcgaattcctttattccgtgccactccgtcgccgatccgtccgtccgtccccaacgccagcttttccgtcgtcttctccacctcgtcacgctcgtcaccggcgccggcgtgggctgcgctctagaggggctcgagctcagattccggtgtggatgtcaggaaccagtcgtcttgtaatctcgcaaagcagcagccgatcgaaacgggcgagccgagacgcacgaggcggggccagccgcagacgtcgcggccgccctccacaccgcagaatcgttgggcaactcggagaagaaatttccagcgtcttccacctcgacgtagccggcgagcggccaccttcgcgaacccgggccacatcgggaacgaaggccatatctaatcccgcagacgtgcgacctcagcaccaggcagaactgcagagctaatctcttccatgccataatcagcaaaaaattgttaatcttcccaaacaaatgcattgagaaaactgacagaggaatctactgttttcattgataaactaccaagcgtgctcctcagaagtcagaacgaagaagaaagaaatcacattacgcaactaattgatgggagagaacgaagaaactagggaagaaattagcgagctgcaattaacacacaagctatatctatgcacaatcagttgctgctgcttcgcaagattagaccccgcgccgtctcgcgcctcgtgtgttgatgtgatgttttgtgtggggggtgaaatgtgcgtgctctgaacacgcaggctgacggcgccgccaccgccgcggggaagaggaagggcgccccggtggccgccgccgccgccgccacggcgccgccgaaggctaagaagcagcaggtctgtgccgcgcacattccgttcctttgaatctcccttgcttgctcgatctcgttttggtgctggatcttggagcaatgggaggtcactagtggtattttgcttcgcaagcgtcgagtttaggatagattacaatctgccaatctgggccttgcttaggtacgaatactgaagcaatgtgctgttttttttttattattagataggtgggggcaaaatctgtatccatataaaatgttcttggtatttggtgaggaacaagtatttgatttcatttatttttagattgttacagatttgcctgaatctaatattgatcacttcgctgtaagatttgtagacttttctaagacctgatgtctgatgtagcccccaaatatcaaactttgatgtctgatatttgtggtaagggacaaatgtttggtttcatttatttttgggttgatacagatttacccccaaccttattgatcactttgctgtaaaatttgcaaactttaatatagcccctaaattcaacactgatttgatacatggaaatctcattgtttggtgtaggattttggaacaaaccaggcttacgtgtactatgggctacgagaggacagatatgggctatgtgagagagagtttgaattcatgaaagggtctgatttgaggctatgtgaacgggtaatcggtgagctcccacagcctcgatcgatgtcattggtggatctgcagtgctgggtcatcaagttgcttcgactccatccagaaatacaagatcttcaaatcaaagggttcttctcagaaggcttgccccttgagtttcgtccggagtggttttataaaggtgactgggagacacaccatatgcataatgatgattcatgggcttcctatgtcaagaaagtaaagagaagatatggtatgtcaatgttcgtgctctgtgtggattgctctgaaatcaagcactacagaagtttggtcaaagctgggtatggtgtttacgctcaagtggggaaggttgcggatcatgaatgcatgcctacggaggttttgcctgggcaaaaaagtctgtcatctaaatttcctgctcagtatctctcctatcgccttaaggatgagcataacatgtcaatgacagctgaagaaattgtaccttttattgctgacagatatggcgacaagatcagtctccctgaggcatggaggataaagatgaaggctttggagattctatttggtaccttctatgattcatacaactctgtaccaaggttacttaaggacataggatataaaaactatggcaattatgtgaacatcaaggacacagaggttgtaggctgtaaaagtttccgagtcctcgatcgtatattttggtcacctgcaccgtgcgtactggcctttacatactgtcgtcctgtgctttgcatcaagggcacttcactatgtgggaaataccaaccacttctgttaactgctctagcattagatgctaatgataacttgattccagtagcatttgccatcattgaaggtgagagcaaggagagctggctgtggtttcttaggaatgtgaagcaatcagttgtgaaagagcgatctggtatctgcattatacatgactacaaaagggagttgcttgatgctatagaggacctccagaataaccctcaagaacaagaaccacacacatggagagacatacaaagcaggtggtgcatcgaacaccttactgaaaacttatctgcacattttggtggcaagaagtcggcggtgctgttcaataaactctgtcagcagagccaaccaagtaagtttactgatatctggaaggacctagatgatttgacactcaggtatacgactgagaatgactctgttgctagtgaggaaatggaacaggagtcagtcgagcatgatgaggcagaacttgaatcacaaagcccatcccaccaacttgattcagcggatgatgaggaggaagtaaatcagggcggtgacagcaagagcaagattacaaggtttactgagtggatccgtctgaaaccattggagaagtggtcgctgctgcatgacacagatggagctaggtatggcatcatgggcattaatatagctgatatatatgaaggtaatcatgtgttgaaggggataaagtgccttcctctcaacgcaatagtggaggttacacaccagcgcatggcagaatacttcaaggaaagaagtgctgcagcgaagaaagcaattggcaatccttcaatgaactttcctgaatgtgtccaggatgccatgaatgccaaaatgcaaaaggcgcagattcatagtgtgacctgcatggaaatcaaggagaacaaatattttcccggggaagaggttcaaaagtttaaggttcagtcaaatcagaagaaggttgttgttcaattaacatcggagtatacccgcatcagtagggatcatgcacgcgagctcacgaaacgcgctgaatgttcctgcaacaagtcaaagctgcttcataagccctgttctcatgtcattgccgtctgttgtcagattggagttaccactgctgattacatgtccccgtactacaccctgccctatctggataacacttggagtggaaattgtgatgtacccaaattctcaccagactacaaaatcatcatgccatttgacaaaccaacttggatccctgacaaaaagctggagtgtggtctttctgtttttagaacatcagatcgcgtgcagtctgtcatggatgaggaagagcaacagagtagcagcacttagagtagatcagtttcagacaattcagggcagcaaaaagcacctagaagaacctagtcaagcttgaacctgtgttattgtctgttggcttaaccatgttttgcgttagacattaagttatggtatgcaaaacctgtgtttctattacttttgtagtgcttatgtgctcccttgacaactgatgttttcagatcttttaaggcaatatggttagtggtctcatggatatttcaaactgtgggcatgattatgttctaaatcaggttagttttgctatcctatactatacccttgctctcttttccagttggttacacttttgatatttgaataactgttataggattacattttttcatgccctgatatgcatgaatgggttgatgccaaattatgtcgaaaggtatcatttctaggatgatcattataatgaatggcatgcatgctctctgacaaatcacatc

SEQ ID NO: 73389 - DNA, 635 bp, Oryza sativa
aaaatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctttccccacagggctacccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgactggaacttgcctgtcttcctcctttgcttccttcaggtctctgctcacatgtcatgctattatcaaggacgtccctgacaccctgtatgacagcactgtcctgcagaaccatctatgatatggaaatg

SEQ ID NO: 73390 - DNA, 550 bp, Oryza sativa
cccaagacgaaaagtctaatttgcctccctcaacagtgtagatcttctacctctagcagccgaactgagaccgatttggctcggtttttctcctccaaatctgacctttccccttgtgtttttctaaaatagttgaggggaaatattcctcttatcctcctctatctttacccccaaaaatcggagctaatcgttgagtatcttatccgaatcgaactcgttttcgagtttatctccaaaaccgagttttgattttccggatcgatttcttgcgggaggagtccgatctcttcaatccaaggctataaataggaccccctagtcctcctctttcgtttgcccctctcccgtggtctcccgtgcctcgtagcgccgccgccacgtgctccaccccgccgtcgtcgccggccgagctccatccgcgtcgcgccgccgcctccgtcgtcgccgccggtcgccgtcatcgccgtaaggtgcgccgaggtgtggagaagcccggccgctctctccccgctgtcgccggtcaccggaaccccgtcgccaccgccga

SEQ ID NO: 73391 - DNA, 20624 bp, Oryza sativa
acttgtctgaatcacgccctggtgatgtcggtgatggtgatacgaaatccgacgttcccgatgcatccacgtggtcagcgtttcaccgacacacgctgctatactattccttaatcattttctggtctcttcctctgttgtttcagtcgtcttcctcgtgttgctcatggggaatataggagtattatcatatgatctgaaattctgatttctgaacacatatgcatcgcgatttgaacttgtccttccatctgtttctctttggaaacaaatacgtcacgaatttgcatgataagctgttggattaaacgataaataattgcaaagtcgctgtatgcatgatctttcagaattctttctctgacttaaccaatcataatcaagcaactactctaaagttgtaacggcaacgttcgctcgtcgagtcctctgctgtgcccagaggaataaagaaaaaaagaattgtccattaagaagctgaccattcaaagaaaaactttcatgattggaactcacttggggccatgaagaacagttcattgcgatttgcaaaggtgatttggtcatcctttcctggcactcaaaacttgaggaattaaaaaaaagaattaatcaatcagctcgttacaaaacaaacatgaagaagcaattaacccaatgttcagatcactgcaggcgtgtcggttggatcgatcgcaaccgacacgatgatacatcgagacacgaccatcagattaaacgaaaggattaattactgcaagtgctgaagctgttcttgcttgtgtgttttgcacgtcgactaactaacggcctctcacgccatcgcctactaagctagcgtgtatgcttccaacaactatatacttcgatccctctgtccttaaatatttgacgccgttaacttttttaaacatgtttaatcgttcgtcttatttaaaaattaaataattattaattttttttctatcatttattcaatgttaagtatacttttatgtatacatgcatacagttttatatattttacaaaagtttttcaataggacgaacgatcaattatgtttaaaaaagtcaacagcgtcaaatatttagagagtatttcatttgcaaccaaccaccggcgagtcggcgacgagtggaattatcatggccatgcaggacgacgacgacgacgaccagcacatgcacagcatgtctcgctggcgcgcggcgacggcggcggccgggagagaacgtgcgtggtgacccaaaccttgacgcgcagaacacaagctgtacactaccacttctctaattctttaagtacaaaccaacacgtagcaccacctacctaagctttagcttcctctcacattccactcctcacatatatatatataccacattgttgtcatggcacggctcctactccaatcaatcacaaccaacgaattagaatctaatcaccctgtcccattaaccaaattaacatcgatcgatcattagtacaaactaattaatcaatcaattagttagagatcaagttattagtgtccaagtatagcttaggaaggtaatgggaaagagagacacgccggcgaggtcctcctaagttaggaccttggaccgtccctcctccatcctcacggctataccaactttatcctcgccccctccccaccacccctctctcccctcccctctcaaacaccaccgccaccgccatggtcacgcccttcccctcctcctagcaccacctctccccttcccgcgctacgcgggacgaggaccagggatggctccccccaccgccgtctccgcctccaccgccggcctgatctggtccttgtcgccctcgctctcgctcgtcgtcaccacctcggtggcgcttctgctcgtgctcggcggtgtgtccgggatccgcgtcaacgtcatccggctcccgtcggcgtcgccgttcccggcgttccgggaggcgccggcgttcaggaatggcgacgggtgcccgccggcgagggggtcggcggcggcggagggggggcgggtggacgtggccatgacgctcgacgccaactacctgaggggcaccatggccgccgtgttctccatcctgcagcacacggcgtgcccggagagcgtcgcgttccacttcctcgccgcgcgctccgacccggacgccggcgacctcgccgccgccatccgcgccaccttcccctacctcggcgccgccgtcagcgtctaccgcttcgacccgtcgcgcgtccgcggccgcatctcccgctcggtgcgccgcgcgctcgaccagccgctcaactacgcgcgcgtctacctcgccgacacgctccccgccggcgtgcgccgcgtcctctacctcgactccgacgtcgtcgtcgtcgacgacgtgcggaagctctggtcggtggacctcgccgggcacgtggtggcggcgccggagtactgccacgccaacttcaccaagtacttcaccgacgcgttctggtcggacggcgagctcagcggcgccgcgttccgacgcggccgccgccggccgccgtgctacttcaacaccggcgtgatggtgatggacatggggcggtggcgcgacggcgggtacacgcggcgggtggaggagtggatggcggtgcagaagcggaggcggatctaccacctcggctcgctgccgccgttcctgctggtgctcgccggcgacatcaaggcggtggatcaccggtggaaccagcacgggctcggcggcgacaacgcggaggggaaatgccggagcctgcacccgggcccggtcagcctcctccattggagtggcaaggggaagccatggctgcgcctcgactcgcggaagccctgcgccgtcgactacctctgggcgccgtacgacctctacaaggccgccgtacccgcgctcgaggagtgagctagctagctagctcgccgccggcgagccgaggcggcggcgtgattgcattgcatgcattcgagggcagacatacgagagaagaggagagagggagagggagaggaggtgtgtacacgtacgtacgcacgtgcgtgcgtgcatgcatgcatgcatgtgtccatacgtgcaaaacacaaaaggggcaaaaaaaaaaaaagttgtgacgtcatgcaaaacggcacaaataagattaattaggactggaagtggtgaagaaatacatgccaagaggatcaatggaaggaaggcgctccgtctcgtagaaaaactaatcctaattacgaatctaaatacatatgtatctaggtttataactaggattgacttttttttacagagtagtacatatgtggatgcatgtgccgatctctttttctttcttcctcttgttttgggttccttgaaaaattttctaccgttgaatttgattcatcatggtgacgatgatgtacataggtgttttgattggagtacgatgtgtaaaaaattagggtggtgagatcagaagtgggtggtgcactttgcaaatgtgtatgtactatatgctttgatgttgatatatcatacaagaacacacacattcaggggggcaaacatcggtccatagctttattttccgttcatccatttgatcacataaattgatataaagagtaaaatacattatcggtccttaaagttgaaggtggtgtcacttcgatccatgatgttgtaaaatcaacattaaggtccatgaacttgtttaagtgaatcattgcggtccaaaacagaccaggttgaccgtcctatatggctgttcagcgtggccgcatatttgctattaggcccttccactttcgcactaccggtttggttggcagaacaatcggggtgcgacaaatatgggggcagcggtggggacaaggggcatgtaaatactatccatcctaggtcggatgcaacgctgatgactggtgagaaggcaggatccaacgccggcgcccgagtgcagctcggcatccatcactctggcgccaaaggagcgtaatggaggccgcgcccatctcttcagctcaacaacgcccaacgacttggtgggcaggcaagcggaatccgcggcatgaactcaccgcccatggccaagcctccaagcttgccgcttcccaatctgtcgtcaccgggaacaggagagaccctcgcggatcttggggccccacgccctctccggagccatccctccaccgtcgccggatagaggggcaccaccagggagaaccatgcttcatcgacggccagatccaccggtcacccttcccgctggtcgtcggcgctagatccaccacgtcactagatccgtgccacgacgctttgccgccagagtgatggatgccgagctccactcgggcgctggcgttggatccggccttctcactagtcatcagcgccgcatccgacctaggatggatagtattcacatgccccttgtccccaccgctgcccccatatttgtcgcaccccgattgttctgccaaccaaaccggtagtgcgaaagtggaagggcctaattaaaaatatgtggccacgctggatagccacatatgacagtcaacccagtcaaacatgttttggactgcaatgattcacttaaataagttcatggatcttaatattgattttacaagatcatggacctaagtgacacaacgctccaactttaaggaccaatggtgtactttactcattgaaatatatgttgaggcatgtgcatatcagcatgaacaaacaatgttgctcgcggcttttgcatctgacgggccggggctaggtgtggtggcaaaggaagtaagttcactttgactcccttcactagtggtcgaatataattcgtattccactatccctgaaccacaataccgaatattttgaccccttcctcccccaactattaaaaccgatgcaatttgactcccttaacggttttggagagcagtttcgctgatgtggcgcctacatggcagtgttcactttgtcttcatccaacgtggcattgacgtgacatttatatgacaatacaactaaaagaaatgtgggacccatttgtcatttacacaaaaatattatgggacccactgacatgtggggcccaaagtcatcctcttcttcccttcttcttcctccctctttctctcccttctctttctcttcccctttctctcccccttcaccgtccgcgggaggttgccgtgtagggagagcaggagcggcagcggcgaaaggggtcggagttcaaagtgaacttattccggtggcaaatgctcgcggtcccgcgtttcgtgggccacgacctaggcgcaggtgagccaaaatggctaattttgctctagaataagttcactttgactcccttaactagtggtcgaatcttattcatatccttaaaccacaatatcggatatttcgaccctccaaactattaaaaccggtgcaagttgactccctcggcggttttggagggcggtttcgttgacgtgacgtctacgtggcgatgttgactcggtcttcattccacgtggagttgacgtggcgcttatgtgtattagaattaaagacaatatgagcggaccccatttgtcattcacacaaataatgtgggacccacatttcatcctatttccttcattcttctccctctctctcccttatctcgctagatcggatcggcgggcggttcggcggcgggcgagcgctgtgacggcgacgtgtgggcaagggctgaagcggcggcggtttcggcccgcaaggccacatgtggcatttcccctctccttctcttcacgcgtcctcatacgatggtttccaccttcttcgatctggaagcgtggttcaaggaccacagtgccacaatgctcttcgagaaggcgcacgtgatgtccccgtcgagcttaaccaaaagtggcgcatcatacaaccatgcgatgaatgtcgcatgcgtggcagacaacaccttcatcatggacttagtgctgaattcgaaagaggattttttaccaatgtggatcaacggggtagcattttgaaattcatcattcagttgtagagatttggttcggtttcctcctattctcccgactctaattctataagctggatagagatacaggaggactaccaacctatatatgtgcacgcgctatctggcaatagattacttgtgtcgagtttaatccgctttacaatttggcatttccattatcaattaaatatagccatctaaaagaggatgagagatttttttctcatatgtcgaacgaagaggtgagggcaactatagtggaaccaagcgaggggtagtgaaggaatttggcatttccattatcaattaaatatagctatctaagagaggatgagagattttttttctcatatatcgagcgaagaggtgagggggcagctatagtggaaccaagcgaggggtagtgaaggcagtggtgcagcagaggctgttgctgccgcttagcatgatagtagttcagttgattttagtggaaatgttggtactgtcgaagataacgctcaatgacgggatgagcccgttcgttattattgtgtaccgcaacctgatcgccgctgccgctaccgtgccacttgtgttcatatttgagaggtactagattaatgacctatatctttcatttttaggtgttttcctttacatcttcatgtttataattttttttctatgttttttctgttacagggatatgtggaaaaagtgaactgggcaattgggggctggctttttataaactaggtgaaaccctgcgcgttgatgcagagtttagtatgataacaataagtaaaaataatatgtgtgatagctagacaacataagattatgtaagttaatgtggtttatgataatttaaatttaaatagtatatagaatgatgattcaaatgtaaaagtaaggtgatatgactttatgaaagaagaaaagtattgagatagtttgaaccgtagattaatcatctaaaggctaaaaataattgaggtgatatggattaatgagagaagagaaagagagatataatttggactatagattaatcatttaagcactaaaaacaattaatgtgatatggcttaatgagagaagagaaataacattaactaagtgatgatgaactatataggtacatagcatattataaaaaaaaatgaagatatatattaaaatataatgtgaattatgtggaattatgatttaacatgtttggattttaaatgctttaaaatttaataaattataaataacatgtttgcatgttgtttaaatttaatgattattagtggatgatgatgtggtatcttgttaatgaatgatgatgtggcatctttgcatgttaaactttagaaattagtgggttataactttatagtaagagaggatgctgtatttgggtgaggtctcccactctacctttagatttggacattttgtagccgtactactttttattccttagtgtcatgggcatggaccatgcttttattccgcatggaccatgcccatgtagcagtttgcatgtcagatcgatgttagtcataatgccaatatattttttttggtctattgagtatatctatattccatgactctagaagaacatagtaaaccacaggtaccaaagatctttaagataacatattctaatcagtggcgaagccaggatttgggtatagggggtgctggccaggagacgtaagaactcaccagcgcctcggtagataatatagcgtggatcttggtgtataaaattgaacttatttttagaatggaggatgtatgtccgaatatatgttaatatagaataaaaagaaccatttttaaagtcactaaatagcaccaactttactcaatacagaatgacacacgacatcatttctattcatcctttttaattttggagacttgcaaccacatcgcttagttacgttaatagacttgcaaccacatcgtttaattacgttaattaacttaggtaatcacgtaaagctaaaacctattggacagctaggtaggtataggctcaacttgcaacaaattaatgagctaattttatggattagatggctaatcatccgggggtggggtttgcagcgcatggggatgggggggtgccaggctcaccccggcaccccctgtggcttcgccactgattctaatcctaacaactataacgcaaggatccaaatcattttttttgacaaacaaagaaataatgtgaacatatgacagttcttgggcagtaaaagatagaaagtgctagagacttggtgtagtgaacactttactgaaaaggcttgaatttaaccaccacaatggaactaagaaattttacaacttcaaattgattcaagctttgtaataatggcatataaacaaggttgccctaatttaggtttattgtatactattaagtttgattacatggcctaagtactaaaagttactcagtaatctctaatttaggtttattgtatactattaagtttgattacttggcctcagtactaaaagttactcagtagtcaattcacaagcgtgttgacgtatttcaggcatatagcccacttactatagacaacttacatggaagggcggtagttagacctaagttatagctaagctacaaaataataaaaaagacacctcttggcaactctggtgcttatctttgtgataaactagtggtaagatagtatgccgttaaaaatctcagctttgcatcatgtacacagtatttcagctgatataactttcctgaaatacaaagcactcacaaattcaatatggcatacatgagaatttagagaatttaccatcaaattcatgtgcctcaactttttttaccacccaatccgcgtgccctctgtaatatatcattatgactgctaattcgtctattttgtaccactttctctatttttcatgtgttttttaattcttaattccatttgtactccctccgtcaaaaaaaacaacctaaacacatcctagtaccatgaatctggacatgtgacacatcatagtaccatgaatgtagtactagtatgtccagatttattgtcatatcgtagtacgatgttgagttttctcgacggagggagtatattttttacaggtttgtgggcatttttctctgggcccacctgtcagaaccaaaagagatatttctctttggatcgatcggatccctccaggcaggcgcaccaccccgccgccgagcgccgccgctgccactggactgtgctggccaccccagctcaccgcccccaccgccgagcgccggcccaccaccccgccgccgagtgccaccaccgccccaggtcaacgcccccacagccgaatggcaggtcaagttcctgagtcctgacgaacgaagagagagttgggaggccctggctgagaccaacaccaccagatttcaccagagttgggaggtcctgactgagagttgggcggagatgtccttcttcttccgggcggcgtcgcggccggcgcgcccgtcgccgcaggagctcgtccgctccatcaaggagtccctcctcgccctcgacaccaggaccggcgccaaggtactctccccgcatcctccctccctcgcgagcttctttccttagtccgcacatgcatgagatcttggttgattagtgctcgaggtgtcgcttgctttaaccgtagcttgtgtgttgagattgagtgtttatctgtctggaactctggatcttagtagatgttagtgcctgaggtcgttggtagtgcaagatgtgctttattttggtcggaattcgtcctacctacagtgtagcaaacccggaatgcaatgtaatccgtgttggtagaaccgtgggattagttttttgggtttaaatcttcaccgatactgacctttggatgctatggcctgtgctgagattgtgcttaccattggagtgctcatttttacccccaatttagtggcgacgaaggcgtcaatgttagggtgattcaagcttatctatgatggagtttggttgtacttcacaaggaaataggcaaaatagcgcaataaattgttggttcataatgtgaaacaagaataatgcctgataatttttcaaaataaatttgcttgagcaggtctaatgaagattcagggcatgtacttagctcaagtcactgatattgattcgggaaaaggggctcttgttttatttattcgctgcagggactaacttggtactacttgggatctttgagcaactggtttccgtgtatcacaaagagtttcaagagtcacattacttgtaaaatatgctttcttgttgagagattctttttaacagtgttgatataccagtatattgcatatggcacttgcatctggagcctactcataagcaatggcatatttgttcctttgttttactgttctagttgttttatgctcttctttatacacagaacacgattctacagtcccactggttatctcacgtagtatttgttttctaattaggctcttgaagatgttgagaaaaatgtatctactttgaggcagacactttctggcgatggagaagttgaaccaaatcaggaacaggttctacagatagcccttgaaatttgcaaggaggatgtcctttcgctctttgttcagaatatgccttccttgggttgggaggtatggtttcatcagttgaatttgatatccctttctgttcaagcttactcgacttattagttgagttctatattgcagggtagaaaggaccttgcccactgctggagcattttgttgaggcagaaggttgatgaagcctattgctgcgtgcagtatattgaaaatcattttgatcttctagatttccttgtagtttggtaaggcccatatgctcaagtttttttatggaaaacaatcaatatttagcacatgctaattcgtttattggtagtaatgcagatataacaccatccaaaaaaatgtctatttgctgcaacaaaaaattccttctttttcccctttcctcgtggtcccatcattcacgtcaatttattgccgtcagtcctcacctataactacaatattaattgtatttatttatgactatgtctactattatgtcattgaatattttcctggaagctgattgattctcttgcatcagctacaagaacttggaagttgcattgaactgtgggaatatgttgcgagaatgcataaaatatcctacacttgcaaagtaagtcttcataaattttgtttcctttgcataagtattagggatttaattgagccttgtttttgttgcctgctaacatacggtatccaatgggtatgccttgaagaaattctgtggttgtataaacagaaacagtgaatcaatttagcaatttgcataccatggcagttaccatactacttgctagttcccctcccctgttgattgcttactaaattgatatggttaatttacaagcattatgaagtaccctttactcctttcagttttacattctggaatgtatcaatgaacaacttgggtttgttatcagctatgagatcagttaactaaaccatgctagaaaatataccaataataccatttagttaataataaatcaattaattgtacatgcattgaatatttgattttgtagctctctttcagatatatattggagtcaagtagcttcgagttgtttttccagtatgttgaattatcgaactttgatattgcttctgatgctctgaacaccttcaaggtaaacccagttttattataacttggtattttatgcttcggttcttcaaaattgatgtttgttcttgacaagattcttgcaggatttgctcaccaaacatgaagccgcagtttctgagtttctgtgctcccattatgaacaggttagctggagtgttatcttttgtgaaatgtgtttatttatgatgtcctcacccttttccctgccttgttggcaccatcatttattcatttgtacatgacaatttttggaatcatgcaacttgtctatattgctatatcttttaatactgatagataccatgtgttcatttgcagttctttgagctctacacaagacttctaacttcaactaattatgttacaagaagacaatcagtgaaggttggactaatttggattaatatattcaatttattattgcgcatcaaaagaggaaatctaaaagtattgtgcttcatttcagtttctttcagagtttttgttagaggccccaaatgctcaaataatgaagcggtacattgtggaagtcagttatttaaatatcatgattggcctgctgaaggtatttgattagtagttatatgcttccttttttttacattcagaagtcactaatgtagtaattacccatttttgctttcacagcttttctttccttccttttttttttcttttttgacaattctggatattagtgctaccagtatgagaatcgagaaatcctgctttcttactgtattgtcaaccaaaggatttcctaggttagaattataaacctgtaactattcttaggtctaccagagcccctaggtccagagctaaatgggtttctatttgttgctaagttacatgtcatcatcatttgcagtttagctgataaagatcgaacacttgaatgccatattggtcataaagtggtaattggttgagcaaccacattgcttttccagtatatgaaaatagtacaactagtcaacactcctgaggagaacagggtttaaagttttgtgttgaggcaatagatccatggctagaacacagttaccgatgacttcctttgcttcatggtaatcagtttttcatggctctgcacatcctatctttatggctcaactaaagtgaagcttttgtaggatacaagcaaaaatatcaggatatgtgccttccacattttcaaggtaatttttatccttaatcttttgacctttgtattcggctagctataactaaccatctaatgccaaataaatcaataccagttgtcaattatcacataatcaccatttgaaattgcttgcttgacccttcagtggctataagttataacctccatggagttttgtatttcttctgatataactttccaacggaaatttcctttgttgctgatcctgtaaacatttcgttgaatagttcgaaatctattccatttggcacttgatgtggttattgttatagtgctatctcatctaatcaagtcgtttttgttcttgatcacatgttgtttgatttgtgaaattttctgttgaacttgatattgttagtccattgtaataggataagcacctctctttcaccattttttggggtttcactttcactgcatgtaagcaggtatttgttgccaatccaaacaagcctcgtgatattattcaagttttggtagacaatcacagagaactgttgaagctactaagcaatcttcccacaagcaaaggtagtttttactctcaacttccagcctgatgccagaaatggaatagagtaaccaagcattatgagttataattgcatctgggtgtttaaggaagatttcttgttaaattgttgagagatgcaagttgtggcactactaattgcgctccttttaataggtgaagacgagcaacttgaagaggagagagatttaatcatcaaggaaatcgagaagcttgtgcattcatcggtatagaccctcaagaaattcaaatccatccgttcaagtttcgctggtcaagaaatgtgatccctttcttcccttcttgtttttaagacctgtgtaatgtgatccctgtatagagggtgtttatcatagggaaatagtttgaccaagaagtatgttggtcacaagaacactttaccattgctgtgtgcatttccattgtgaaaatttttggaacaactggtgggcacatgttcgaattatgaatgacagctgatgtcaaacatatctttgttcataattgaaatgaaatatttcgagatctgtgacagcagctatcgaattatgaacggcagctgatgccagacatatctcctattcagaaactgaaacgaaatattccaagatctgtaacaacagctatcggttgaaacttgttacgtatgggtatgcttctatacatattattttttcagttgacatttgacaacattatatatatgtggtatatatatgtatatatgataatttacagaaggaattaattgaatccgattaacatggagggtgttcttgagtagtgtgctaagctgcggctgacgtcagcggccggaagatcaccggcgcgccgaactgcgggctgagtatcatgagcaccctgggcgcgtgcacgtacgccggcgatagccggaactcgaagcgccgcaggacgacggcgagcgccaccttggcctccatgagcgccatgttctggccgatgcacacccgcgcgccgccgccgaacggcatgaacgccatcgggtggcggcgccggccgccgtcgtcgtcggcggcgaacctcgccgggttgaactccgcggcgtcgtcgccccacgccgccgcgtcgtggtggacggccatgatcgggatcatcacctccgtccccgccggcaccacgcacccgcccagctccacgtcctccttcgccgtccgtatcatcgccaccgccggcgggtacagcctcagcgtctcgttcaagatcatcccgagctgcaaggagaagacgacgaccaagaattcatggatcgttgcaatgtaatccctctctcgttttgatttttaatccaattattttaaagtttgactaagcttatagaaaaatatatcaatattttcaacataaaaccaacatatcatcaaaatatatttaatgttacgtttaatgaaactaatttagtgacataagtatttctaaattttgtatataaactcaatcaaacttaaataagtttgactagaaaaaataatcaaaacaccttactccttacgttccattttataagtcgtttgacatttttttctacacaaatttctttgaatttgatcaagtttatagaaaagtatagtaatattttcaatacaaaataaacatattatcaaaatatatgtgatgttatatttaatgaaactaatttaatattttaaatgttattaaatttttctataattttaattaaacttaataaagtttgactaaaaaaatcaaataatttataatatgaaacggatggagtatatctgaacattcgacatcgtgtgacgcaagaattacatacggttttgagcttggggaggtggtccttggtggggaggtcgccacggccgcagacggcgacgacctcgcggcgggcacgttcctgccactccgggtgcatggcgagcgcgacggtggtccaggtgaggaggttggacagcgtctccttcccggcgaagaagaagttcttgctctcctcgatgatctcgcccgccgtcatcgccggcgccatgaagctcatgaactccctcatgccgccgccgccatcgccgccatcatcggcgtcgtcgccatggctgctgctgcagctctgcaggccggtgacgaacttggcgaggtggctcctgatctccctgtcgagctgccacacgcggcggttcttcctcgtggggaggaacctgtacccggggatgtacaccttgctgtgcgcctcggtggcgtagccggcgagctcgtcctggagccggaacacggcggcgccgtcgtcgtagttccggcggccgaacgcggcgaacgtgatggcctcctgcggcacgcgctggaaccactcggcgacgtcgacctccgcctcgccggcgccgccggcgcgcgcgcgctccgccagctcgtcgagcatgcgggtgacggtgccggcgacgaacggcgcgatcatcctgaggttctcggtgtggaacgccggcgtgagcacccggcggcggcgcgcccaccgctcgccgtggaggttgctgaggccgtagccctcgaactggcagatcatcgggtgcgcctcgtaccggtcgaagtgatccgcccgcgtcaggagcacctcccggatcagctccggctcgctcaccaccaacctcggcgtccgcccaaaccaaatcaaatgcatcggacctgttggtaaatttcaaattattcaaaaatttaccaccaagagataatcagaaattttcttgagcctcgacgaagcaaatgttatatctagctagcctgctatccaccggctttatcaaatgttagtaataaagtggggtcggaacactttttaggctcctttgaaacataggaattttacaagaatacgttcgattctaaggaaaattctcgtaaaatccattcattccaaaggggtccttcctattgtcattttgccatatcagctcagtggcagtggaaataaataagggtgcatttggacttgattttccgaccgtccgatgagaattggacggtagagattgacactggaaagaaactatatgtgcatgtgtatgtaggtggtcaactttgacagattcaaagaacacgcagccagcatcaatgtgatgctcatgatctattgagttgtaaacaaattgccaaaacaaaccgtcactggaactgacagacgacgattaacttcatcatttcttaactgaccgaccgatcaacaataagattcctcacttggattaaacgcgggtgcatgcctgtaggtagctaacttcgagcatattatactccacaaaccgttgaaaaagagggaattatcatcggctgccgtgacaattaatgagataaactaatcggagcatagcagaaagcaaaccagatcatgaactgaaatgctctggcaatgtgcaggagatgctagctgctgttgatatagtcatatgcaagtatgcatcagctgcaaggaggactcattgctaagcaagcctgcatgtgggtagtgtgtcctctgaaattctgaactgccggatggatctgcatggatgtgagctaagccaagctaaggtaagctagctaattaagctcttgtttatttaattaattactcactcacatgatcattaacctacattgacagcctgttggaaagatccatggatggatggatgaatcatgcattgtgatcagtgatgacaacatcaccaagtttgacttgggaggctggctagctatacttccttcgcttctgaatataagcatttgaaggttgtttagtggattaagagggcaaaatccttcttagtcacttcattgatcaaattttgaattacttggattcccctcctaagcactcgatctcaatgggctgaaaatgattgaattacgtccgtgtcccaaaattatttgtattatatacaacatttgaattcttgaaatttttatatttgatattacggagagagaatagctagctgcagcattttttttttttggttatcaaagagcaagtagtagtggagaggaggcatgcagtgctagtacacctagctagtactactagctactacccacacccagcaaaagtgaaatatgaaacgaaatgaagctctcatctccacctaatcaaccataatttaaccttttgcatccttgtttctacttgcaaaagcatggaaccttgtccccttcctaattccctccgcgttcacgcgtgatagcctacgcgtatactcatatatatactactccctccgtttcaaaatgtttgacatcgttgactttagcacatgtttgaccgttcgtcttattaaaaaaattaagtaattattaattcttttcctatcatttgattcattgttaaatatatttctatgtagacatataatttttcatatttcacaaaagtttttgaataagacgaacggttaaatatgtgctaaaaagtcaacggtgtcaaacattttgaaacggagggagtctatatataagtatacatatccatcaaatgccccaagttggttaatttcttcttattttttcgtgtgaaagtgttgccaatttcatatgtaaaaatatgattcgtgtgaaaatcgaaacaaaaatgagaaacaaaatcaccaatttgaaatttcaaagttatagtaagtatgcatgcacatcgatcaataagagtgaaattaaattggagagtggaactagagagagaaattttttttgaatgaaatggagattaattaattagagggtgatcgatcgaggtggtgttgattgattaccgtagagcttcctccaatggtggtagaaggggaggacgcgggggaggatgtcgtgggaggtgggtggctccatggggcgggaggcggcgtccaccatgaggcggacgagctcgatcgagctccccacgaagaaccggtaccccggcccccgcaccccctgcgccgcgaagtgccgctccacccgccgcggccgccaccacagcgcctccgccgccctcgccgccgccgcgtacaccgccacccacgccgccgccgccgccacggccacggccgccgcgccgctccagctccacgtccacgcccacgacgaccacatggcgcgctagctacggcggcgcgcgctcctcctccctgctgctgttgttgatgatgatgatgctgctgctacggcggcggcggcggcggcggcgaggcggcatatgtgtagacgcgtcgtgccgtttcctgcaggtttatatatacgtgctagctgcggttgggagggagagaatttgagagggatttgatgattgaaatttaatttttgatgctgttgatgacgtcataaacgtgtgtggttatacttccaggtatgcatggtttgatgcagaaggaactgatcatatataactcttggattagctggtgcatggaaattgccattgagtttgttattattccattcattttataattattttatattataagtcgttttaatttttttcaaacttatttaagtttgatcaaatttataaaaaaaattaacaacatctgcaatccgaaatgaatttcattcaaattaaccgttcatataatatgttcattttgtgtaaaaaaatattgttaaatttttaaaccagtaaaaaatcaaaacgatttgtagtatgagacggagggagtatttattatattggtttactgtgattgtcgaactgtgattgtcgaactaactgaggtcaatgcttaatgcttccttattaccagtgctactacactttaaagaaattcttacgaaaacttttacaaacaaaaagtctcaacagtttggtttagctagttataggaaatctagatttttgttcacgtacatgccacatcagctggttataaaagttttgtcaaagaaatgtatgtgttgatttttccttcttcctaagaggtagaagggtttctactgcatcagtaacaagtgtactagttacccagtagcattactgcttgtgtcaacacaaaccatatattgatggatgtatggacattttgaaagacctgtacatcaaaaggatcaaatgaatacaattgcacatcgttttgtaatctttaaaaaaaaacaaacatgtttttataccatcgatcatgggaactcggtatagactttaaaaagctatgttccatatcaaagagaatgtgtactgtctcatcccaagataaatttattttcaccccctgccacatataccaatacaaaacttaaaaagacaataataaaatcagcccacccgagtttaaatcttagatttgatacgagtgcttgtatttatggctaattattctttcagtgctaggcaacgtacccgtcgacagcgaggtgcccatgattcgtcaatctcaatctcaagatatacaaatccagttttccccggaggtgctcatacagataagtcgtgcgtatttgtgtttatagaagtgggtatgcgcgcatcatgtacacatgcatttgtactatgtttccaaaaaaatcacaatgcaattatttttctctttatttatttctaatgtaattatttcgtatttttacaaattctgatgtaattgcttaaaaacaaaactattttgggataaacggaaagggaaaaatgatcaaacggagtgagtataatttaatagcaaaccgccactttcatccttcgaaacaatgtgatatgtttcgttcaaacagtacacgcatatgcgagttcggtggtgtgaccgagtttaacaacaaaaacacggagcacgacatggtacactcccaaaaaacatccccaaactattaactgcaaataataaatccccaaagtacaaaaacatggtcgacagacacttcataacccccctctcacaatccttccaaagtaaactagattaaggagcctatcacctccaaaaccaaaacgaaactaactttttattttttgttaatgcattttggggttgtggaggggtggcgcaagttgacgagggtggtgctagctacgcatttgtttcttgttctcttgctgtccccccggaaaagcatggcgagaggttgcagcggtcgggctcctgtcgcacccaagtgcgtacagtctgttcctcacaacctgtccctcctattcttttttttcttgtgtgttaactactgcgatctaaaataagttcattttcacccatctcgtacatatcaatgcagaactaaaa

SEQ ID NO: 73392 - DNA, 7677 bp, Oryza sativa
acagcttttcaacggccacccgggccaacaactttttaaacggccacccgggccaacaacttttcaaacggtcacccgggcctagctgatcccatcagctacagatttttcaaacatggaacccttttccacaacagcaatttcacaagcagtagtcaaacaaaactacgctaggaatcacctcacatccgcccatgaccgtgggcacggctgttcgaacagtttgttaccctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaattcacatgtctctcggcatcaaggctcccctgataagctagttactcagctaggggtgtcccattccacccatgtggtcgtacttgtcttatgtttagatgaaattccaaggaaacggtccttaagtgcaagagcgggaaaccgtacacccggtacgttccctggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtacacgaatatcgagacgcaactagatggttgcaagggggcatggtatcacaattaacaaaggaaggatcaaatgcaacaaattaggtagatctgccaatctgccttgcagacgggacaacagattaagtgcggtcctatcaatgcataatattttttaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaggatttaattaaatcttttttttggaaaagaaaagaaaagaaaagaaaagaaaggagggagggaaaatagacttttctcgggcggctagggcgtggcccgagagagagtgcggctcggccgagcttaacgggccggccggcccaaggtggcccagagcggcccaagacgcgcgcgcgggagggaggagagagcgagccggtggaccgggctcaccacgcgcggtcccgggtgggaccatcttgtcagcggctcggctcaccgtgcggagggagcacgtggcgcggcgctagggtgggggagggacgcggtgcacgcgcgcggttcacggtggacgcggatgcggcgggcccacgcgcagcctcacggctcgcggtggaacgcgcgcatggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcaaaccacggcgatacaagcaaaagcgagcacaccgggtggttgcacgtgacgaggggagacgagccaacggctcggattcgccggagggagcttgacggcggcgaatcgcggcggcggcaaccggcggcgggaaaaggggaaaacggcgacgaggtcacgaggggccaattcccgacggcgagagcatccacgcggctacgggaatccgttgctagcgtcggattgggcggaactacgccgagcgaggccggcgacgagcgggtgccacggagctcgggcggcgacggcggcgagcacacggcgagcgacgacaacggtcggggcggcgccggctagctacggggaggctactcgtgctaccaccgaaagctaagggggagagatggagcgaggaggaagaacggagggaggcactactgtgcggcggggcgcagtgacgagaggccgacggcgcgggagtaatctctccggcctcgggccggggaagaggaaggagagggcgcgcccggagtccccttccgcgtccttgctcgtgccggctcctccgacacgcgcaacgacgaacggcgacgacgaacagagcacggggacggcggcaatggcgcggaggcgaatgggagaggaagggaaagggaggctggggtttataggatggcaatgtcggtttgggaaccggcttagggcggtcaaagcgcgagctagcgctcggcgctcacgtccaaatcggcgacagggcggagggaggaggatgacgccggcgggaggaaaaaggagaaaaagagggagagaaaagggagctcgtcccttgcctctttgggaaaaggaggaggggagcgggggcgttgcggcagagggaggagggctctgcctccgtcccttggcggcttgcgcgcggagaggcggggccgaggcgatgacgacggcaatgacggcgggacggtttggagcggcgcgacgacacgagcgacaggcgctgacgacggcggcgaccaggcggtcggccaccacggcacgcgcgcgcgcgggaaacaacgggcgacgcggtggattgagcggcgcagctcgggcacgcgcgctggctgcggggccgagcggctgcgcggcaggtgtcacgccctgaagtttccccctctccttgctttaaaaattggctaaataaatcgtccgaagaaattatcttaattaacctagagctaattccctaattaataaatgcaattaataattgaattcggcgtggtggaatttttcttgagttccccatgctccaatgcattaacaagattttagtggaattttcagagccttggaaataattttaaccaattaaaaatgagcaagcgcaatattttaatcccaggaaaatcctttttctctttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgctggagccgaagctccaaccgctgccgccgaaaccgccgcgccgccgtcttcttcgctcctcccgcgtccacgtcgggccttcactccgagcccgcacctcgcgcccacgtaggccgcctctccccggatattccgcgcgcgcgcgcccgcaagtggtgggggatttgaaatcccccaacaccctctctctctctcctccacctctccacgttgccggccaaataggggccatccccggccgtttccgcccctccctcgcccataaaaaccctcccctgagtcccctccctcgtttcccccatttgccgtcctctcccacgccccctaccgcgcccacgccgtcacacccgagctccgccgcttgccgccgccttcggccgcgagccgccgccgctagagtcaccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgccgtcttcatccttcgcgccggccgccgtgctcacagtgaggagctcctctcctccctccttccctctatcccgcacgcgttgccgctccctgcgctcgccatcgccttcgtccgccgccgccggtctgtgcgccgtctgccgccgcctcccgcgccgtcgcttgccgttgccggcgttcgcgcgccgccgccggtcatcgccggtgaccgcgcgtgtcaccaccggccgccatggctgccggtcggctttgaagccgagccgtgcctagccgctttccccgcgccgtccgatcgcctttgaggccgatccggaccgtcggtcccgtggaccggcggtggaccacccgcgtggtcccggtccacggtggaccggccaccttgtgccgctgacccatggggcccgcttgccggcgcctctctctcccctctcttgaaccgctgacccgtgggccccgcctgtcggcgccgccccccttggatgacgtcagccctgggctttattgcgcaataaagtgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgttttgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaacatcatgtgggatgggtcctattactcagccatttattgtttaccatatgccattgataacctgggtatcaaaatgattagatgttggtttaggaaatgcttagccatgcttagttcaactagtacacaaatggggatcacattattacatagactttgtctattggcatagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaaccgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacagctgttttactgctttcaactactgctttgaaatgcctgctttaggcaaaagaacccctagcttcctttggttatatcctgcatcgtacctcctcttccggtatgacttgctgagtacagtgggtagtactcagtcttgctctctttttcccccacaccagagctgaagatcttcctagttggagctgttttgtcaaagttggtttcgtcgctgccgtcaaggattgcctgtggagtggagtcgctcgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacagcagggcagcggggtcgggcgacgcggacggcgcggctttcgcgcacgcgcgcgcggcgcacgggcggagcggagggagggagagagagagagagagcgccaggagggagggggagatgggccgaaagaaattcggcccatcgaacccgggagaggcaagatagaattttgcggaggaatttgatttggagggatttggattcggaattgaactcgacgatagatcgggggatttgagatcttgagatggcacggacgctagacaacaagcaaggaagcaaatttcgcaattagggtttttaagagataattttcccgctaggcgccacgacggaacgggcgctacaaatagctatacatttatcaacaaactttttttctaaaaatttgatagatgaaaatatatatacaatcgtaatatgattacactataacctgcatttaactatgatacgatttgtatgtaactttcaaaaattctacggtaacatgttcttttttcgtgaatcagagttcaacaagacccaatctcatcatccacgcgcattatgattttttttctctttcccacttgcacgaatcttaagttaaattattttaacgatttaaaattatgtgaaagttacactgtagttatatataagttacaatataattatactataattataatatacatacatctgataaatttttgaaagaaaatttgtcaataataaatatataagtaatatcaaaatatagtggaagaaaaactacagcccctaggggcgaaagaaaaatatatttgcagcttaattaattaatacgtttaactgcaccttactgcttcagtgctgtcgaaacatgaattcggcaataataaaacggggtagcgcacgaaacctaaaagtggatggatgtggagacaaaggatttagacaggttcaggccctctcgatgagaggtaataccctactcctgtttggggatttgaatccgccgggtgtattatagatctgacgatctagttgtctcatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatcttccgaatacttttaccaaatatgaagactgtggagggctgaaaaataaagtcagatgcatcgaatagatgtacctaatagatgcaccaactgagtggttttgataattgtagtcaaccaagtgacttaatattaatatatagcatatgcggcgtgaatccctgaataacatgatccgagtgatataccgactgctttgtaaaatatgatgcgtgcaacctaaagctgactacatcattgaaagttcacatagcaaaacaactataaag

SEQ ID NO: 73393 - DNA, 5230 bp, Oryza sativa
aaccgcctcgcctccgtctcctttctgacttcgccatcgccgctcgcctcgcccacgtggtcgtcggacaggagcgaagcagcggcgagcacctgcagcatgcggtgatgcggaggaggacgacctcctcagcacccgggtgggagagggtagagaagccgctgccaccgctcggcacccaaccgccgctcgcacccgcccctgcgccgccctgcctcgccgccgccgcctcgcctcctccgcccccaccgctcgcctcgccgccgcgcctcctcccccaccgccaccacgctggcctctccgccgccgcctcgcctccttcgctcccgtcgctcgcctcgctgccgccgctgcctcgcctcctccgcccccgccgctcgcctcgccgccgccgcgctcgcctctccgccgccgcctcgcctcctccactcctgtcgctcgcctcgccgccgccgcactcgcctctccgctaccgcctcgcctcctccgctcccgtcgctcgcctcgccgccgcgcctcctccgccgccgcactgcctcgcctcgcctcgctgccgcattgcctcgacttgctgggccgtgtgaaggaggagagagagagatagtagagataagagagagagactgacaggtggggcccacctattttttactaaataaattgctgactggactgttacgtacaccaaaaacatcgcggattgggttgaggggggtaattcgtccggtttgcatagttgggggtgaagaatgtctggttttgtggttcaggggtgtaattcagacgaccgcgatacttcggggggcggggtaattcgtactttttcctatattaaatattacactatactacaagcaaaatatcacctcagtggctctgtgtcacagcattttaagtgatacttctatgacacaaagtattcttgctgttttatctatgcatggcatttataatgatcatgccaaatcgtatgaaataatttgagtttatcgattataatatggcacagatactctataagtacatacaagaactgaaagtaataaaaattcaaccagcatttgctgacttgtcatgagtcagggccaaagccaagtggtgtccatctggctccatcacgctgtccatgggccatttcttacaggtccgtgttaattatatgtataactgtttaaaaaaaattatatgtatagcaaaaattgatctcgtgacaagttgttgatgatttttttgatggatggatggttattatttttagtacaaattaaggtggcttcatctcatctgtagaaaaatatgcaatgacacacatttggccaactccactcaacatagttttgttgcgactacactaaggaagttgacaaagtgaatcaaagatatagcttgacgttacaccgagatgacctggtgaagtaggttgcaagctgcacggtatcatgcatctagggctcgcagatctcgatcatgggtgaagataagacatggacatcgagacagtttcgcctctgtacgagaacatcaccgaaacatagaagaagtttgatacaaaccactggtatgtcagacagtcccgatgcctcccaaatctaccactgcacacatgtcctaataataaacgagttctctgaactaaggagcgaataagctttgtcatcggaactttatgtatcattgttacacatgcatggggctctgaattttatataggcaggcattgtacaaacatagctaggcaatgaattgatcagctatataatgtgaataaatttcaccctcatagatagcaacatggtgagaactgacatttacaagcatatatatatattgtcagtcataaaacggtttgtactatgcgtactatacagccgcataagtttctactaaaatgagcagttgctgattattgatgtagcataccgcagttgctcatatataatgtgaataaatgagcactgcatgtggaagttacagtaccagcctaccggttaccaccaacgtgcattagttagagccaacaaatgatttccctacaatagaagtactccctctggaattttttaatgtacgacgccgttgactttttgacaaacgtttgatatttcgtcttattcaaaaaaaatatgtaattataatttattttattatgacttgatttattatcaaatgttctttaagcatgacgtaagtatttttatatttgcataaaaattttgaataagacgagtagtcaaacgttggttaaaaagtcaatggcgtcatacattaaaatacggagagagtatatatatatatatatatatacacacacacacaatttgcaaccttaaaaaaagaactttcactgaatatacatccttgtttttccccagcgagaagagtattttctaaaaaagcgtataacgcaatgtaatgatgatctggagtgtactacaacattttacatgacgtatatataactggtgctaaaaaagaagcaaaattatcgttcgtagggcgctgccaagctaaaagttacagtaacaagagcagaactacatgctgcgcagagatcatgtttgaaagagagagaaaaaaatatttggttgatcagaaaggcatttagaagatgagatgcacattgtcgttgtcatgttaataacccattctgccctgcatatttgtgatcttgacagaatgaaagaagatgcagttatttcagcaattcagctgccgcgcctccaatctctgctcatccaaaatgttagtagcagagagtttgcgagaaagctggttatgcacggtcttctccattacacgaaatgcagtcctcggtaacgtgcgaatcgcacgcattgagaggcagaagaaccatccggtcgtcgtgatggggatatctccgtgctactgcattgcttttttctctgcaagccccgaagcaaagttaaaatctcgagctacatatgtcggacaatcctgttgcctcccaatccaaattttactttggttttcgctcttgtttggatggatcttaatgtcgactcatcactcatgcatcgctcatcctcctggcctttgatatatatccatgggaactactagagaaaggctttgtagtctcgcttgggaacctcctgactacgaatccgggactaaagatgaacatttattctcaaatcacaacaacattctcatcttcaaatcatagatcgaatgaaaaaatcattctcaacaaacaatcattctcaacaaacaatcatcacaactcttctcaacaaacaatcattcacagattaacaaggaaaaaagaaaaaaaaagggaaaaacgcccgcgtgccggcccctccgcaccggctccattggccggcccctccatactggccccgctggtcgccgccgggatcgcgcggccccgccggccgctgcctaccgccgccgcctccccagcccgactgccaccaaccacggccagaggcagccgccgcatcttccgccgccaatccaacctgctctggcacgcgcagggcgccgccgccgtgcgccagcctctcgctccttgatctgcggcagaagaagataggataagaacgccgtaagggataagagagagaggggagatgagatgataagaacgatctgctgagagagggaagacgaggagtttggaggataagttttagggattatatattgtatatggatttttagtcctggttgataataataccaaccgagactaaagatccccggccccctgactaaatctgactgtaaatgaaccggaactaaatatgatctttagtcaccaaccgagactaaagatcatctaggaccgatagagttttaaacctggactatttgttttttatcgactggggaaatatggtttctccagtagtgtcggttgcagatccatatacatacatgtaccatggaagggcaaaattgaatagttttgtgtttttcagtccatagcaaatgtgtagttctatttgcatagatccccatatataaatcagtttgtactattccctccgttccagaaaaacacaacctagacaaggatatgacatatcttattacaataaatctagacaaccatttatctagattcgttgtactagaaaatgtcacatccctttctatgtttaattttttttggaacggagggagtatgtcataaacggtgagcttcctctgaaaggactgttaatttcgaattgtaacaagtattcctctgaaattgtgagctaacaaatttgttttttccctcgcacatgaagttggtttgaacataaaatttggtggtgacatattaatgcctatacctgttagcgatttttgcatgaatttagaacttggaaaaagtccaaataccccctaaactttatatggtagtccgtctagcatcctgaactttaaaaccagatatccaaccccctgaactttaccataccattcatattaccccataaggtggttttggatgatggttttgcatattttagaagcttaaacaaataatttttactaactaatataacatatttgaatatcatcagttataaatcatcaatttatttttatatagtggtgtcatactattattatattggtacttgtttgtaagtgagagctaataaggagcaaacagaaagatttaagtcaaaattttaatatatatgtctaaagcgtatgacatgtgatcaaactcatccaacttatatacaaattagataaaaaccacgatacaaaaccatcttaggggttataaaaacggtattataaagtttagagggttgaatgtccggttttaaagtttagggtgctacacggactttcatcctaagtttaggagggtaatttggactttttccttagaacttatatgtcaggttttcacttattcgatggttttcatcatctattccccgttttaacacatgcatggctcatatttttctcccgcacacgtagaattattttaaatttatatttgaaattaacgtatttgcatataatgtctattttgtcattgtcgatatattatgtatgaaataaataatatgcatccatgcatgtatcgaaaattaaaggtcagcatttgtcacttctgacaatcgtgcactttgtgcaagtaccgagtagcattattggacttatatctaaaattaatgcatattattatcacattcattttgtgcttgttgatacattatacacgcatgaaaagaaactagcaattaatgta

SEQ ID NO: 73394 - DNA, 602 bp, Oryza sativa
gaggaagggttcggagtagaggttgaggacgcaggtccggcgccacaggggacgccacctgcgtgagaggacggtggtggcggcggcgtccttggtgtgcagggaggagaggatgtgcaggagtaggtcgtcggagagttcagagatgcgatccacggcggccatggatgatgttctcggctgggcacagcgagaggctagatcgatccgttagggtttcttcgaggaaacgaggaggaatatcatatatatatatatatatatatatatatatatagccacacacactagcaaaagtgcccgtgcgttgcaccgggaagcgcacagatcaaaaaaatatgcaattaattaaaatacaaattcactgaaatatttggtatttttaaataggtatgtgtataattaaatatatttacaagtaaagcaagtgtgagaaataaaatgacattgttaaatttaattttattaaattctccatgattagttacgctctttggaattttattggaattttcagaacttaattgctaattttaataatacaaacatcatttaataattatttaattggaaaaagaaagaaaatccttccggttaggttt

SEQ ID NO: 73395 - DNA, 2872 bp, Oryza sativa
ccctggctggtcctggacagggatttaatgcacattcagcttagaaattctggtttgagaatttctgggcgtgacaagttggtatcagagccgaccttgaccgtaggacaagccaactggaaacctaagagccctctgaacccctttttcatatgcatatgcccttttgcacttggattttgtttcgggaaaattttggggtttgttcttttgatttgtgggaaaaatcttggtcgcttatttaaattggatttctcgactagggacagtctagggagttagtaaaagtttattcagaatttattcggcagtcggtcgggaattgtcgggtgatatgcattaggtcgcgtctatgttcggaggggtaagtttatgcgtatcagtatgactatgcatctatttcatgcattaagtcattgtttagtcagttgcattagcgtcttttgtctcggttcgtgaaaaatgttctatgcataaaaatcatcatgctccgcgagttacttgagtcatttgttgctttatttaatttggttttgagcatgtgttggttcctatccctctgtcctctttagatgtcagtcctatccctcgtttgcaagcgccgccccgagcttcagagtcgccgcccttagctttatcgtcttcttagtctgtttgcttgctagttttcgtgtttaggtttgttgcttgagggttagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagcagcagcagcagaacctgcaatttggtcctccgcctcctcagtccaaattgttagaatttcttcgtgtcaagccgcccactttctcaagcaccaccaacccaatcgaggcccacgactggcttcatgccattgagaagaagctgaatcttttgcaatgcaacgagcaagagaaggttgcttttgctacacaccagctgcaaggtcccgcttctgtttggtgggacaactacatggtgacccgtccaactggggcagaggttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgacgggaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcacggtggaccttccaccatgattatccggcagcaccgtccctaccacccgggtaacttcaacaagaaccaccatagtgacagtcacaacaacagtgagcagcacagcctcaaccctactctgagttcactaaagattccagctcaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaactcattccttcatttccaagcgttttgctggtgcacatgggttatctttagtgaagcttaagataccaatgcgagttcatactcctggaggtggcatgaccccaactcactactgcccatctgtgacagttgaaatacaagggttgatttttccagccaacctcattcttctagaatccaaggacatagatgtcatacttggaatggattggttgacaaggcacagagaagtgattgattgcgccagccgcaccatcaagttaaccaatgcaaaagaagaggtggtactttccagtctccagtaccgcggaagccagggattagtttaacccaggctgctggtgaagaacaagaggtagcagtggagaaaaccactaagaagctggaggatattcccatagtcagagagtatccaaaggtttttccgagatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaacccaagagaatgtgcgttgactaccgcgcactcaatgaggtcaccatcaagaacaagtatcctttgccaaggattgatgacctatttgatcagttg

SEQ ID NO: 73396 - DNA, 703 bp, Oryza sativa
tcaagcaacttatagcctacctcaaaagccatcaacctcaggtccctggcgaatcctaacaccttgatcaaatgtctcggtgaatggggcggcatctcaagaaacatagaggagaggaattaatgcatatttttttttaagttagctgcaccatttacacttaactgattcgaccaaagaggaagaaaaattgaagaaacgacacgtgctaagccattctataaatatatttttagcatttaactttttggacagagacaaataatattttttttgacaaatcactaaagtgaaactaaaatacttatgatctattattagctcggttcagtgttaccataaaaaggatgagtaggactagtgctactatgatcggatgaataccattatagatgtacagtgccgactaataaacgaaatttaatagagtgaatataagaaacattctgaaaagaacaactttttgcttttaaaagagcacaacatgaatcaaattaattttgcgcataagcatgcatgtgctgcccacttaatcaatgtatgggagaatcgaggagaaccgttgtctttttttcaaaatattttgaaggctacttaaaggttaccatctggcttatactaaaggcaaggtggctctgataccaacttgtcacgccaagaatttctatccacaaatgcaagcgcttacatgcgtggttaaccc

SEQ ID NO: 73397 - DNA, 7141 bp, Oryza sativa
ggggtctcccaggctggccggcgacagatctggccccgccgtcaccggacctacgacggcgacgtcgggaggcacgatgtggaggcgattaggcggcggaggttgttgcggcgcggggcagcgtggtggtggcggcccgcggggtggccggcggtggctggcgctcgcggcaggtcggcgtccggggcggcgcattggcctgcctacagctgcgccggctgtctccgtcagtcggtgggattgggtcctgccggggggtcgcgtcggcgactccgaccgctccagtcgctggcagccaccatgttatctccttccttccctactctttcttcctctttcaaccgtctcggcacaagcagtagggggtggccgccccccattttcttccttcttacagttgctatgttgctcaccccggtgctcctctctctgcgctggtggtgaagttggaggtggttgccacagttgttttggattgtcccacgaagcccgaagatcctcgctggaaacatggatgacaccgatgtctttgttgcccttgctgccagttctcagtttcaccttcagaccggccaggcctcctcccctccttgatgctcctcccttctcttggtcgcctgctcccagaccggccgtggagtcttttggtggttgagtttttttcgtccgtgttggtggtctagtctgttggtagtaagggcgcttgggcctcgccgatgcttcacgtgccctgtggctatgtaaacctgtagttgtgccgagtgtggagcgatgtgcttaccccctacggtgttagagtttttgtgttaaagtggagttggagctgtcatcgggttcagccgatgagctaggcaacgataacactcaacactcttgctctagcttcttagaggtcctgtacttcttgagggagtcttgggcgacagccctgcctggtcttctaggatcggtgacatcgatgcctatgggtgtcgtttcctcattggaggtgttgccttgtggactctctccacttcgggtgaaaacccagtccagttttgggcgggcgttggcagcggcttctgtcattgttcacctccttggaggctacgccttgaaggccttgctcttctctggatcacttctgtgggtctagtcgttttgtcacaggttttttgtgtcttttgtgtaaggttttgccagtttccctttagcaaactgtgcagctgtacggttttcgggccctattttccttataaacagggtcaattctcttctaatatatccggtagatctcctaccgtcttatgtttcaaaaaaaatatatatgcaaatgcatatgtatatgtacaaaatacacatatatgtattagacacgtataatttaaagcacttaacattttatgtgtgtcagggttacggataaggtataccctctatccttggatatacgtcatgtactggtatggtatacctgcgcgtatacggacgttctctgtacatgttaaggaaattcatcatggagtccacagatggaaggagtcctactcggatagaactgggtcgtcactgtatcgtgtagggtccgatgtctccgagttctacttggagaccaactgacctgcggtataagagggaccccccgggaggatctaaggcatcgaatctcaccgccaacacaaccaccacagcctacaaagtcggagccttcaggagcctagtcatcggggtgatctaatcgaaccaactcgactgcggtctcgtcggtatcatagagttctgctattccctttataatctgtggttttcactatataatctaatatcaactggattagggctattacctatcaaggggcctgaaccagtataatccttgtttcctatttgcttgatgtcgtactacgtagatcctcgtaccagcgtaccctaataccctctatatccggtctacgggtatctcccatcgacagtggcgcgccaggtagagacaaacgaccatgtaagacctggtcatgtaatagttctcgccgtgtgtattaaccaagccatgtaatcggaaattgagttttccaccttcacggctgggggctagggtcagtgcttttttcaaccaaggcaggtcaagggtccaagagccttatcctccgagaacgattctccgacgacaaggccgggggctagggagagtgtatgactcaacaaactgactgatcgaagtcggtaaaagagaagacgctcatatacaaaacattggtttgtaaatttaatttattttcagttttccatacatattataacatgtcaccctttgagcgttcactcgggggctatttctatctaatattcttttctgagtattgatttcaggaaaattctatttggcattatcgaagactccatgtctctatggttctataccaagatcggctaaggcgagtacgacaaatgttgacaaggctccgtcgcagattctgcgctttctcgatcactcgagaacggttggtgggtctcgacaaggaatacggaatgaagagatggtgtacccgccgagataaaatttcttgacttcaatccaaattctcgattacagcaagacgggagacttagttgtatgctctgtactttcttggttgacatcggagattgactcaaacaaaccctataggtgcccacatgaggctgataagggaagtctaacgttatctctgaactcaccgagaatggtcacgtgagctcgataacagttactccaaggtctgcggttgagaatatgaatttgttcatttgcattgaagtcgggggctactatcagggttttggataccacatacctaatagttgttgactaaatctcggtaggacccaccacataccatgtcctatacggaaacaacctgcggatataggaggagttccggataagggaagacaaccagagttctacatggaaacgacaaggactactcggattgtatccatattggtttccctagttctacttggacaaggggacacctatgagtataaatacaagaccccctaggaggagaggagacacggaacaacagaagccacaacatacaagccaacatacgccaagacaagacgccggatatcgacttcagagataggcacggctagtcccctacggtgcctacggataccgtcaggagagatatagcgctgtctctaatctcgccggatgcggattcgaggaggaaggctaccctgttgtcgactacgagtcagaccttcagaccgccatatcgactacagttagataggctaccccaaatattatactggtgtgattatgatgaataggagcaacgaccggctttggccaacaggatgtagggttattacttgacaattcaggggcctgaacttgtataaaaatccgcgtctccatctcttttactacaatctcgcatatatcctagtaccaacgatccccatactatgcaaataccggaatcgcgacatcaaacgtcgacaatgtgcatatatgaccaaaatatatatttacgctaaagtaaatgtgtacatatataaatatagacatgtattacaattcattacgtgctctagctacggcttcgacatcggtgttatctcagaagaagaaggaatgatcttatgaattgctgatctgtcgtagtagaattcaccctcgggatcaaggacttgttcattgatgaatcccatcagttgttcttgaacagccgcgataaattccttgtgtgttaggttgtctctcatgtgaataacctatgaatgtatgaaattaattaataaacaagaaatcgatacgtacgcaatgaaattttgaatggtttatacgtacatcgggctctcttgtggtgtagatttgggttgaaaggcagtgggcatactcgcatacgtagtagccgcacaagttagttccctggctctgctttgcacaatatacatagcaaacgacgagagatttaataaacacttatatttgaattagagattcgatataattttggagcatgtactcactggaaaattgaacctccggctaagtttttctttccaagaaccgcagaccaattgacggaactgatcctaagccctacatggagtttcaagctatgattaattactattcgagatccccatagtagcaatagcaaaattcgtaataacagtggaacagatgatatcacctgtctataagttcaaaaacttggtcaaaagtagactcatctttattcattgagtcatagacattgactctgctagcctccaagtcgaaaagtaaaaggacccggtggaatatgcaatttgcgtgagatgatatatgaaactatacatgtatgtacgggaacgaaatttgttcggaagatagtaaaaactaactctgtgttgtacggcagtagtatgaatgtcttgaaatgctgctccttcaggagatggacaagagtgtcctctgtgtttttcggatacatgatcatttcgatgttaactttccgagggtcgatgaatccagtatcgaaatccccccgccatcgggccctttgaatctcaattctacaatgagaaaatgaattattatggtgtacatatatacaaagagctaattaaggagtgtaataaatctaactcaacaatacttacaaaatccatgcgcttagaagagagatgtcgaacgggatccagagaacatcttctccttgcaggaagttggacgttctgatcctcgttccgatcacctctctaccgttggcaatcatttccatttactgttcatggaatcggtacatatgtgtcagtagggactttagctgctcaggcttgacaagcggtttaccgagttcgaactagtatttcacttccaccgttgggattgatgcgcctttaagcaactgagtcctagttagtccggtgtcagaaatgaattcttttattccaatttcttgcccggtcaccaacggctcgacctcctggtttggttgctcgccaagctgagggactggtttggacttcctataatatgccttcttaagtgttcgctcgtagtctattagctttaagacctccttgactagtttcaacattttcttgaagaagttcttgacacttgggtctacaggtatcttcttttctggactccgaggttttaattgcctcttcacttctgctgccacataagcgtctagctcctcttgtgtgcaatcatacggcggctccttgttttcggcggcatcaactttcgccttctgcgttgccgttgtgcaggcaggcggtggagcttggcgagaccttgacttggaaggtgccagaggacacggtgcacgagccaaaggagacggtgcaggagcctgaggaggagacggtgcacgaggcgaagaaggcggagaagatggcagagccgaaggagatggtgcaggagacgtcgcttgtttcccaagaaggatgatgtagcacttgcgccatagtataatggtttggcttgtgtctcgtagatgcatatcaccgtctccttcaaggtagtccaacttgaggtcctcgtacgcggcttccaccagctcaacttcgaccctcgagtatcttggtggaatcggcctgcagtgttaagtccctgaagggtccgttgggatggccattcccgacgccaccttcacgtgatgagaggttatcttctattagtaatcaacctaagtagcaacttgcggaatgtacatgtcaaaaatcataaaactatgagcataccttgattgataagttcttgaagggaatatacagctcacatggtgtccgctacgtgatttcatcaatggggcaggtggtttcgtcctgagtttgcatggcgtccatgctctgtgatcctacctgccccgttgaggcacagctactacgattgcctgaggggctgaccatgataggaggaatgtatggctggggatcctggctccgatatgcggccatgcgttcatccacctttcttgccacctcctcttgcatgctaagctcgtagttcgataccttgtactcaagatctgcaatttttgcctcagtatttctcttgctcctcatccgactcctgtacgtatggatgtcctccatgaatccaatcttccaaggaaccacgcctttccctcgtgttcgtcctggatgctcgagagtctgtagggcgagtgtcagctcatccttctctctgtcgggtcggaatgtgccctgagaagaggcttccactgcgtccgttagtcgactggcagcctcacgtatctgattgctgaacaccagggagccatcaacaggtttgagctttccaccgtgagcatagaaccataactttgatcgatcgggccatttagaagtggccagttcgatacccctctcaatcaagccggcttccatctcctcccacttcggcattgcgacgctatagccgcctgacccaggtggtgatggtacttcttcttagcggcattttctttgtttcggtccatcagcgcttgcccttgtttccctgtcttgtaagcaacaaactcatcccaatgatcccttagcttcgagaatatgttgaagttcggtgtctgcccctttaggatgtatttatggtagagatctcccttgaagctctagaactgttctgccattttgctaagagtccactgtttcactatgttctccgtacccgcagggagcgtgaatgtctcgagcattgtggtccacagcatctctttctctgaatccacgacaaagcgtcataatccctgcgtgcccttgttctgcgctagtacactttgctaataggcacgttatcccttacaacccaacagctgtgtcgtacgtaattcctggctacatctgacgtggcacttcagttatgatgtgccgactctctatcttcttcacggcacctcgttttcggcatgccctcttctgtccagcggagggttgacttccactagcctcctcctccttggtttattagagaatctgtacgagcgccaccaacggatgcccaaaaggaataagttcactttgactcccttaataattagtgtccaaatctgattcctatccctaaaccataataccatatatcacgacccctaactattgaaaccggaataatttgactctttcaacggttttggagagcggtttcgctgacatgacg

SEQ ID NO: 73398 - DNA, 4625 bp, Oryza sativa
tttgtaattctatgaatctttctacgacttgcagttgagaggttacgtgaagtcttcaatatagtctgtttagaatctcaagttcagatatttcagaatatccactacgctttttacctttatctcttggtaaattaatttcagaatgttgttgtaattcagtttagcatggattatggagatggtgtttaataacatggtagttcaggagggtttttgaagtcaggcatcgtttctatgctaatataaaaccatttgaatgaaccatcaacaatggatgacctaagaataatagtatgttgggccactaccattcaattatttttttaccatgacaaattttagatatgcataatgattttaagaaagtcaaaattcacaaacttgcactcgaggcaattggaaaacacaaggggaagtgtgtgcttgttcaagaaaattaatttcatactccatgtgtgggttctggctttttgtgccgaaaccatcatcagatggaaaaataaaaggcggaaagaagtgaagtataaactgaaatcttgaactttgactcctaactatatgaaaatatacacaataagatgataaagccagagccccaaagatatcaccgaactctggtgaaaataccatactcttctatctccatttctatcccctgaaaatctgcaatgcatggtccttctattcatcttcatatatatatatatatctgagtttagaaatagctccatatcaaatccatatgttaaatttctttcctgggagaacaaattagtgtatgccatctggtgggaaatcttctctcccctcttagaactcacttttgacaaggtcaaattatagacttgagtgtttgtcaatgatgaatcgtaaatttttttaaagagttatattttttccgttgcaacacacgggcacctaactagtcactgattaattagtgattaattatcttaattagtgattaattaaatcaggataattaatcactaattattattaattaatcattaatcattcaattttcaaaacgttctcgcacactcaccatgcgagaccgctcggtctcgcgcctctgccgcgcgacactgcgcggtctcgcgtcttcttcgtgcgagactgcccatgtcgtcagtccacgtcagtttcgcgcagcggtttagcgataccggtggtatatttgtgccaaaaaatttatatcaagactatttctaagaaaaaaaatatgaacggtatatttttaaatttaagtccagaaaaaagaagcacgagtaaagtttgattctacgcatgttctgtatttgtgttgtgttgtatagagagatcagacgaacttagtgttgcgtaccttgcagcttctacgaagattatggtggttgcataaaggaaatcttcatcgggtcggagcaccgaggggtagccgccgaggagaacgacggtagcccatgtgaaggccagcgtgccgatggcgttgcccgtcctctccaccagcgccaccacgcgaacgaagcaattcagccatttttctggagcagctaacttaccttgcccgccggagttgcctgctatcttggactcgatactcaccgccggtgatgtcccccatactgccgtataccggccgctcgcttcaacgggccggagaccttggcgcgcgttacaatataagagcaggtacagtaacagcaagcataaatgcataatacggagtagtgaactataataaataagctatatacttatatatacttatgtgaaagagagataaataaaagtgaaaagtgttaactctcatacaaaagctaactatacacaagcataaaaaatatgcattaaattcatggtgagagaaagagagagaatgaaaaaaataaacataacctggagtagctaacttattatacatgttagttttaacattaactaatagtaagtagtgagctcttactctacattgattaaacaggctctaaaattataccacatcagcctattgtatatggagtggagagaattgacgagcgagaagaaagcggacgacaaatttatcgccgggcgattgctctcctcgcaatgcgctatcgctcgactgcagcccaactcggcgattaaaaacgtcatttgtgggtggccccgcacaccacaacggatccccttccccaccgagcaagatcaatctcttccctctccaccccaaccgcgcccgctggatctccgcctgcccctcccgcgcgcgatttctgccctctttcccgtgcgccatctccctccactccgctttccacgagcgtgaaaaataatcctattttaccggtcccaaaaatccggtagattgatggttgccaccctcactatctgccttcccctcatccaccttgcttaatctctcctgcccgcagtcccgcacgctacaaaattgtactgaaaaccctagttccccaccaccaaaagccatgtcccgccggaggaagacagattgtgccacagttcctggtgttcctagttcctaccccgtgtgtttcaaaaaaaatagttcctaccccgtcggcggaggtatgtttttttttttgaacggtgggtggcttggttcgtcacaccaccgtcagcttgatttgcttctccaccgtcatcagctggatttgcttctccaccgtcgcgataataataaatattatttgtgtttcaaaaactgtgatacatgtgcccacaagttttagtacctagtttttttaggatcagtggtatttgggttgtttttttttagatcagtggtatttgagttatgtagtaactggctaggtggcccgtgcaattgcgcggctagcacccatacaaaatatcttttatctatgtatgattttacttaaaatttgttaaatagctatctcgttggcttaggactttgaaagactgagctttaatatctatgttttttttctatagttttaaaatatcacactgatcactaccccttattcctttgttgctcgatctgccatggtttttattcatcctccttgagcctttaaaaaatcaaacttgtagtttttagaattcattgtcatgttgggttttgtttttataattgttagaagtcccgtcaaacgctaccactgtactcctctacggcttgtctgctgcctactctctttattgtctttgggattttaaaaatcaaacataattatcgttgcggttcactttttactttttataagtttcgtgaaatcatcagcggcttcgccactatactcctctacggcccgccaactgcctcccctttttattttcattgggattttcaaaattgaacatgattaatattggggtttacattttactttttagaagtcccatcaaccgctgtgaccatcatgcttaatggcatgcccgtcgtcccaccttttaatcgctattacaattttatttgggctttgtttatagtttttatatgtcctatcaaatgccaccaccctaattctttaggcaattatttacggtactgttgcctctcttctatttattgtcatttgttatcgttgtgttctagataaactttttctttgaaaaatccatatttttcattccaatattttttatttgtaaattgtattcatatttgaactcttatattttttttctatttttgaaatttattttattttttattctgaattttacttaatctcgtgatgtgttctaggtggtcccttccaatagtctttatttttaatccaaattttagttatttataaattgtattcctagttgaactcttatttttctttttctaattttgaaatttattttattttttattttgaattttagttaatctcaagttatgttctatatggactattcttttaatattccttattttttatagcttgccaggttttcttttatagctattagaaattccgtaaaacgtcgccacactgctcctttacgacccatccgttgccactctttttttattgtcgttaggatttgaaacattgaaattgatcattgttggggttccttttttaagtttctagatgccccatcaactgtcgccaccccactcctttactacctgacctgccatccctcctgtttattgctattgagattttaaaaatcaaagctaattgtcattggggttctattttatattttttaaatgcctgttcaatagccgccaccttactcctttacggtcagaacattgttactcctttttattatcattgggattttaaaaattaaacctgatcattgttggttttctcttttgtatagtttttaagtttcgctagccatcatttctctactcctttgtccttcttggcttggcttcttaataattttatataatttattttatttgctattttgaattttaattagtcccgagctatgttttatatggtctcttttttttaatattcctcatttttatttagaatttcagtaattttttctaaattatatttctacttgaactctcatttttattttgctgatttcgacatttactttacttttgatttggaattttaagtaatcttctgtggtgttctagatagactattctttcgaaatatatttttatctgattaagttattttgatgaa

SEQ ID NO: 73399 - DNA, 627 bp, Oryza sativa
ttagcgccattatctaaaactaatttagtcggttagatttaactgctcctgaaaggcgagttgccagcgcgcacgcgcgcagtagcttttcgggagaaagaaccgatgaggcaaatcgttgaagcgattagaaaattcaaacaacgatttcaaaatgcaacggttctgccgtcggtggcatcgtggtagcggcaggacgaatttgaaggctgcgccccacgggcctcatcgtcatcggtaagcaaggtgggactaaaaatgtgcagtacagtggctgcacaattataacaaatagacaggttcataaatctgctcgccacagccacgagatttcaccgggaaagcgtgctcggagctggaaagggggaagtaaaggaagttggaactgagcaggagtaacacaacatgtgtaatctaagatacagaaacagcccttgcaggcacaagagatgatcaattgtgtttgtaacagaacggcaaaaaaaaaaaaatcaaaaactagcatccagctagctttttcaaaccggacacgagtgttgctggcaaatctcgacgaccaaaagctatgcttccttgggtttggtgagtggctgcgttccgttctccaacaaaaaatgaaattttgga

SEQ ID NO: 73400 - DNA, 1421 bp, Oryza sativa
aaacttgaatgggttataaattatgtagtatatgctagctggttactcctaacactaacactatgtatactactacttcacaattaagtatactaccaattcagatcctgtacagtactgcaagctgacatgtgcactgagagtctgtggggcccatatgtcagtgagtggtactacatatagaggaccctcactcgcatactactatttactatactactgctactcctaacactaagctagcctttgcatcacatggtaaattagtgctactttgtttacacaatcacttgtatatttgccattgtcaaaaccttcgaatgtttcccccgcaaaagagagacttgtttaaatgcttgatgaatgtgtggtattttagaggttcttggattgggttttgttgatctttgaggtgaacaaattcttatgatttgaaaggatttcaatattaattatcatgtgcaaaatttcttgcactttgaggtgaaaacattattatggtttggaaggattttaaaattaattatcgtgtgcaaatgatgcctgactcctgataaaatgtttttgtgatttttttttactttgtaagttttaacccatttgtgtttgtgtagaaatgtcatttggcaaattatatgctgaagagagtatactaatgctcacgccaaacagagggattatattctacacagacgctttcgccacaagcacaatttactattctgtcaaggcttgatagctgggtttgtcactctcctcaccaatcaccataaatcgatttggtttcctattaacaccagatcctcgtgaagttttgtttatttttctttcttccgaatgaaagctctacgaaagcagtttagtttatcttgcttcactaattttaagctttctgatttgattctctgtagtataattattttctcaacaaatcccctaacatacgaatacttaaaaaaaacaaatccttaaaccttataaaattcctcctgaatattgttgtcagaaaaagctcacgaataccatgaagttatataaaatccgaaacttcaaaatcgagtacgtcaaatcaaataaaaacagggtttacctacaaaacgccagcgtacaaaacgacctgaaaagtcactctctcagaagtcgtcgctgtgttcatcgatcgatcatcacttgggcgttgagtaaccgatcgtttcgtcagacgaagagaaaaaatcagaagcaaaagaaagaaaaagaaatgattttaatttgtgcagctcaaagtcgttgtgaacaaaactgtcatatacaggacacccctgacacactagtctttaattaactaataacagaggagtctgctcatgaaatattctgcaggtgtttatgttaatcttgaggggccaataatcaactgcacaagggggaagctgaagtgc

SEQ ID NO: 73401 - DNA, 753 bp, Oryza sativa
cgaatataccatgctatttcactaaatatagtgggaatagtgtcacgccccgaactagtctcgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaaggaaagcgaaagccaggactaggaccaaacatcacaggcgcgacttgggaactaggccgaaaccctaaaactcatcgtagccggcttgctcctggaagaactcctcatcagccggatccgcttcatcttcttcagcaactgggggggaaattatttatatagagcaagggtgagtacgagagtactcagcaagccaggggaaataagtgtttaatgcaggcttcaaggagaggctggtgtttttgcaatttattttatttgaactcttttctgaaacaactaagtgagtgcttctcaaacgacacggatgagacagtgcgtctcgtccggtcagagtatgtgcaatgtatcagtctttagattttgaaacaaggttggcacccggctaacagcttttcaacggccacccgggccaacaacttttcaaacggccacccgggccaacaacttttcaaacgggcacccgggcctagctgatcccatcagctacagatttttcaaacatggaaccc

SEQ ID NO: 73402 - DNA, 5204 bp, Oryza sativa
ttgatttccatccaggtgacgcacgatgatgctggagacggtggcggctgtgcccgccaccggggatggtgggcggcatatgctgctccacctctgctcgctccgcgacatcaagcacagcgacggctggatccgtgtgttgttggaggaggctgagaacgagaggatgcacctcatggccttcatggcggtgcccaagcggaggtggtacgagcggctcaccggccgctgctcctcgccttgacatgtgggtccacatgagtcgcacgctgagttagctaggttaatcatagttaacttgccgtgccaaccaaaatcggacactatattgtccaccggacggtattacaagttgaggagcgcgttatatatatatagtattgtgatttaagaatgaaattcaaactttagtttaagatgagcgactctaagtctaagtgcacttaaggcttgtttggtttacaaccataccaaactattggcgatgccaaatcatgggccaatttttttgctagtgccaatattttgacaacatttgtatgatattagtaagtattggtagcaaaccaaacattggcaaaattactgttaaaaatgccaatattttggtatggcaagttttggtttcaaaccaaatcagcccttatttcttgaaattttttatatttatatttattttttaaaaatattttaaaaaataaattaccatttcaaacatttgcaaaaatcgctctactagaggatgagaagggcctacatgtaaaatttcctgcaacacataagacgtagtatttgtacaatttgtaaaattctcatgtgatgtcagttgaagttaaagtttatatgaaaattgtagagcttgatgatatttacaactttgcagttgacaacttttccattaaaataatttatgagtcttaatacatatatttatatttatatttagccccctcccatgaggttttcactaatctgaaaattaatattgattatttgatactctaaatagttttaaatgaatgagtggccaagtacaaaattatagatctcatcgagctccacaacttcgatatagaacttgtctccatcggaggtcgtttaaaatgtaggtctgagaatttataaaaataaatctaagacattctaaggaatatttagacccataaattattctaatggaaaagttataaacaacaaagttgtagatctcgtcaagctctacaatttttgtgtaaattttaacttcatccaacatcatatgataattttacaaatcatacaaataatgtgtgttatgtgctgcagaaaattaaaattttacatttagaggacgagaaggaactaaatgcaaataatttggaaccccgtgttgccacgtcacataaatcgccctctattagggcgatttttagggagggaggagtatatttttacaaaactttgaaacggtaatttattttttaaatcttttaacaaataaatataaaaataaaaaattccttatttcctctgttctttccttcccttttcaaggcccaccaggcatcagcccatcttaattttccttttctttgcagccaaggagtcgaattattgcacgaataaaattcaacccaaaagaaagaatcagaacattcagctggaaattgtttgataacatgattttcctttgaggaatgatgcaggagtataagttaagaccacaacttgatttttggtttgagatgcatttagatttgattagagttgatttttttttatttttttcatctttatttgcaagtcattaatagcatgtagataaaaagttttacacattatttttttctaataaatcatatggataagcacaaacatgtgcaaaacgaggttttagatggtatcagctacaatacttttcgaggtctctcggtaaccaaacactataagtttcagtacctacactgtattgttttcctagtacacgctatagaacaaaattaggataaaaagaattgtagaagagaaggtagaaggcataaaacataattaagtgaaaaattatgtctagatattgtttacaaattcaaaagtatagcttgctagctttaaaaattaacacatcttctaccatcaacctaatagcccacctagttatagatatatactactccctccatctcatatttccaaatctgaaaaatctatttttgataggcaaatttcaatccaacaatctatcatcttaataactttctcggatttaatgtatgactctccattcttccacacaagattggttgcatggacatcgagaaatgtaaatattaatgaatcgcttgtttacgaggaatgactagtagcatgtttaaatagatgataagtagaatcacttattattggtctatgtgtcaagatgaaatatgactatcaaaagtagatggagggagtacatcattaactctcagacacaacttatagaggcttatgccttatggtgcagttagctataaattagtaatctgctactcttctctttcttatttcttatactctcttctccatcttagcacaaatctgatgtgacaattcttacatcccacccatatatcatctcattcttagtcgggcacctccagttgtcaccagggctcaaattttcggaatgaaatttctaaagtttcggtcttttcggaaccctcctcccccgatatgatattatttcggcctaaattttaattttttttatatatatttttgtgaattttgcaatattttgtttaaatttgactaaaatttattcaaaactttcgttatatcggtaccctccgatagaaacatccaaaccgaaatattaaatcctagttatcacttgccaccacactggtgcctcgatcgctgccccgagatcccgccgagggaagaccatgctattgggcacctcgtcatcttgccgcttgcgatgctggtcaacgctgcaatgcctcatcatggccatgcaagcgcaccatagcatcagccgcgccgctgcaccgtcgctcctacccttaccagcatgtctcatccgttttttttacaaattggtccttttcaaaaacttattttaaaactagtcccagcaaaaaaacttcaaccaaaaataagccgtggactcagcgccatggacattggcgctaagttataacgtatcagcgccaacgtcgttggcgctaaattcagcatgaattcgctgaggtccatacgatttaaatagccacgcaagcaacatatagaaccaagactgtgatggtgtggtggttgtgacttgggctgtgatccatagagtgttaggttcaaatcctggtatccctcatctcctattttcttttgtatttttgggtttttccttttctcttcctcctagcattttttagaattaatgtattttacaaaataagttttgctctcttgactactcactcttgttctttacaaaatgactgttccgtttgtaaatttgttttattttgaatttgatttgaaatttcagtttaagttctcatttgccatataatatagcactttaattttttttcaaataaaaaaagttgcatattttcttttgtatttttgggttttttccttttctcttcctcctagcattttttagaattaatgtattttacaaaataagttttgctctcttgactactcactcttattctttacaaaatgactgttccgtttgtaaatttgttttattttgaatttgatttgaaatttcagtttaagttctcatttgccatataatatagcactttaatattttttcaaataaaaaatttgcatattaaacatatattttgaagatagtattacaagacaaaaaaagaaaataaataaataaagatataaaaagaaaacgagataaaaaaagaaaaaacatattaataaagagtgagggagagaagaaaaagggaaaagtaaaaggaaaaaaaagaaaaagaaaacgagataaaaaagaaaatatatattaataaagagtgagggagagaagaaaaagggaaactagaaggaaagaaaaaaggagatgggagtcgaactctgttcctgaagtttaaagtagaacgctactaccattatgctatcaatctggcgttgctagagatgcctccgaatttatttaaatcgtctggacctcagcgccaaatagatctcataactcaacgaatccatgccacctcggataagagtttagcgccaacgacgttggcgctgatacgttatagcttagcgccaatgtctatggcgctgagtccacggcctatttttggttcaagttttttgcagggactagtttcgaaataagtttttaaaaaggatcaatttgttaaaaaacggatgttactagagctgatttttgcggcttggaccgtcgaaacaagaattcggcaataataaaaggagtagcgtacgagacctaaaagtggatggatgcagagataaggatttagacagattcaggccctctcactcaatgagaggtaataccctactcctgtttggggatttgaatccgccgggtgtagtattgatctgatgatcatatgtgctcataccccctagagggcctcctgcccattttatataggatgggggacagaattacaagataaaaaccttaaccaatacggtatcggcttcctaaatctactttataatatcatcaaaccagggactttgcgtggaggagaggggcggcgggggcagcaagaagtggccgggcttcgtccagttcttcttcgtcctctccgtggtcctctgcgtgctcctctacgccccgcggttcatcgtgcttacgcccacctacggcctcgacttcttccccagccgccgcccaacgacaccacctcgaccgcccgcgtcgtgggagatcataatgctggcgacgtggtggttcttgacaaccagctgcgctcgccgtgctcgtcgctcgccggcgacaccatctgctgcgaccgctcgaatttcaacaccgacgtctgcttcatggccagcgacgtgcggacggacccgtcgtccctgtcgctcctgctgttccccaagcagccgccgacggcgaacgccaccgtggaggagaggatacgtccgtacacgcgcaagtgggaggcgctcatcatgagcagggtcgaggaggtgcggctccggatggctcctcccggcacgacgcgccgctcctcgtcatg

SEQ ID NO: 73403 - DNA, 1361 bp, Oryza sativa
caatctgatgacagtgaaaaaaaaaaaagagccattctgaaggggaacatgcccagctacctccctaacaaaagtgtagagaaaagagtgcctatttcctctgctgataaataaactaccatcatgtatataggtgcctggagatcttgttagacattgttagacaggaggaatacaggatggtagggcaaaagaattattgagaccactgtgcataacaaaagccactgttcagcttggtatgtgcttgccaagagatttttacaatgtaattcttccacatacacgccagtatgctccagggtgaaaaagggatctttcaaacacccatatatctttcacaagcacctataagaatatttgcacacgccaaaacatcatgagtcaccatgttgaaacaattgattaggctgtcataaggtgtgaaactacaactgcttttgaatgatataaacaactgcttcttataatgtaacgagttactgatggtctagtctctccatttatttgctctacagtttcgtaatcttttcataacatgtaagatagatatacatccccatgatggatcatgcagaggaatacacaagattaaaattctatgttgtctccctgtgctcttttgtggaatttacagaacaataagaatccctgatgctcaatcactagagtccagacaataatcagctgttaaatttccagcatattgtcgcaaactagatactaacagattatttccaatgtatcattgtgaactaatatttgaagtcagttatatgcttggtgttttttttaaaaaaaaaaaagcctgaacaaaactagtcccacttgtttcattgtttgaacattagaacttcagatagtcacccatattttacttacctcttttgacttatctccagacacgacctcaccttttgtattataggcttcaaatttctacagaaatacaattaagaaactgtcatgcgatgaacatacagtactgcacaagacaataggatgcagtgctcctcagaaccactaaaccatctattcatgatcattgcacaaaataataggaaacagagaccaaccaaatacagggaataacttagtcaaggcattaaaactatctttgaaaagtagacattttgaagtttatacttcaggtgcttatgagcaatgcatattctgaacatctccaaattgtgtagacatgaaagctctaaagaaaactaagaggggcatgcccacctaatggtgcaagcagtcagaggatgaatacgagcacatgtggggactttcaagaggtagcttaatgctatccaacttaaacataatacttggtacagtattagataatagagggctgcaggaat

SEQ ID NO: 73404 - DNA, 14940 bp, Oryza sativa
gggtcgaggaggtgcggctccggatggctcctcccggcacgacgcgccgctcctcgtcatgacggcggggggctacaccggcaacctcttccacgcgttcagcgacgggttcgtgccggcgtggctgacggtgcaacacctccgccgccgcgtcgtgctcggcgtcctcttgtacaacccgtggtgggcgggcacgtacggcgagatcatctccggcctcttggactaccacgtcgtcgacctcctccacgacaagcggaagcactgcttccccggagccatcatcggcacacgcttccacggcatcctctccgtcaacccggcgaggctccgtgacaacaagaccatcgtcgacttccacgatcttctcgccgacgtgtacgagaccgcaggagacaccgtcgtcgtcgacgttccccagccggcgccgcggcggccacggctcgggatcgtgtcgtgcagggggaagcgggtgatcgagaaccaggcggcggtggcgcggctcgcgaggacggtggggttcgacgtggacatcctggagacggcggacgggttgcagctcccggcgtcgtacgcgtcggtgagcgcgtgcgacgtgctggtgggggtgcacagcgccgacctgaccaagctcctgttcctccgccccggcgcggcgctggtgtagatcgcgccgctgggcgtggcgccgatcgcgcgcgggtgctacgcggaggcgtccgcgcggatggggctgcactacgagcagtacgacgcagaggggcacgagagctcgctgagccgcaagtacggcctccgcgacgtggtggtgtccgaaattgaactataagccaggttttccggtttctccaaattctcaccaactagcttctcgtagttgtagaatctagaaattgaactaaaagacaaaagctaggttttccggtttctccaaattctcaccgactagcttctcatcagctgtttctcagaattttaagctcccaaaactggaatgtaactaatatgtgacttgtctaatcttccaaaaattgcaacagatcaagtagctagtacgcacggcttgctggagcgaggtcctcagttcgatcccctaccagcgcacaagctaatcctcaccctagtttacattttcataggcaaacatttggctccgagagacattttgaaactggggatgagttgcggccttttccgatctgtctataatccgtgctaccttggccctgtttggttccatgggctaatgtttaaccctcaccttttagcctcaaattagccctcaagaatccaaacatgtgggctaattttgagctaatgtgaattagcccccctcaaaacattagcccctccaaggggtgctaatggggctaattttgtatggggacattaaaaagcagctctctctctctctctctctcctctctttctactctctctctaacttttagccttgaattagcccatggatccaaatataccaccctaggctaatgtttagcctaccaattcatgactaaacattagctcttaaaattagccttgggctaatcttccaaacatggcccttgtactttcgcttcttaattactatggcgtaactttccctgttctcaatatatgcggcgacaaagctcctataccggtttaagaaaaacaaacatcctgaatatcatgaatggcacatggatcgagcaaccatattttgatccatgacttgcagcttggagcaccggagatatattactggaggacagtaatgaacgtgaactgatggtcaactacagatttgagttgggtactcatccacaagtggatttgtcagtcaaaactcaaaagtcagtcgctttaatccgaagattttgggttgttcacatgtgatggggctgcttaattgtactccatgtagatattttgagtccagaaccacaagctgcaatgcagcaatgtgctaggcattttatttgtcgtactggatatatagtttatatagctagtgtccgaaccttcagcgtgtcgttaaattcagtgacttcataggccaacttggcagttggcactagaaactcacgtgtatatatacctactgtgtgcttaacaccacgcttctggaaatctggataaacatttaaatttctctgactttatattagcaacagttgttaaaatgcagcggaaatctattcaactctgatcttgtttttcttcccggaattttggcccgccaatttattttagttttcacattatggaattgtgaaccctggaagaagtggttgtgcatggccgccttcaattcatctttgttcgttttaaaccctttgggccagctataagctagtaggtattaaggtgttgatcgatgatggataaaattgagtttgtaaaaaaagagatggatataactgagtttatgataattattcgagagcaccaaatgaatgaattaaataatagagcatcaaaatgatgatttaaaaagaagtacatactataagaaatgctagtgattttttttaaaaaaatcatattaattaagtttaagcccacaataattcgtcgtccattagctcagcaattctccttctcgttcgttcttcctttcttcttaagacatctcatgcatgaccttctgttgattggtccatcatattttatggaatgtgccaatgtagtcgacgcatatgcgtctataaatagctggctcgtctattgatttgtgcagtcacccggcccacaggccacagctactagcagcagcagcaagactgcaagagggggggaagaagctaggtagctagtagtacgatgcagcagccgcaggcgagcagcatgacggcggcggcgaggaggcggcagctgcagggatcggtgctcgccgggaagatggtgctcgtgcgcaaggctctcgacaccaacttgaactccggcgacgtcgtgtgccagctggtcagctccacggtcggcgaccccggtgcgtatctggaatcctctttcctctttctcttaactagcatggtggcccgcgtagattgcccggcgagcatcattatattttctctcatataatagtatatatgttttctcaatgtattattcaaatatattaaaataccaacataattttaaaattttgtattacctttacgaaactactaatgtataatatccatattgtattttataaacgtgttagttattagttatttttaatatcaaattttagttatttgtaaattatattccaatatggactctagactcatctttcaatatttatttttttaatttcgaattttcgttatctataaattgtatttctttatagactctaggcacttcttccaatattatttatttttaattctgactttttcttatttctaattgtatttctatgtggactctaaactcatcttacaatattctttaatttttaatttcgaatttcagttacttctaaattgtattcttatattgactttagattcttcttcccatatttttttaattttgaattttagttatttgtaaattgtatttttatacgaactctaaactctacttttaattctattatgtttatttcgaattttagttagttttaaattcttatatggactctatactctacatcgaatattccttatttttaattctgaatttctattatttcttaattgtatttctatacgaactatatactctacttataatattccttatttttaattccgaatttctattatttcttaattgtatttctatatggactctatactctacttctaatattccttatatttaattccaaatttctattgtttcttaattgtatttctatatggactctagtgtcctcttcaaatattccttattttttaattccgaattttctatttttttctcaattgtgtttctatatggactctagtgtcatcttccaatattccttattttttaattccaaatttcaactatttctaaattgtatttctatatggactcagtttttctttttctctaattaatatgagaatttctaggctatgggagcgaacgtggaggctcctttttctattccttaaataagttaatagatttctaaattgtatttctatatgctcagtttttctttttctccaattaatataagaatttctaggctgtgagagcgaacgtggatgctcatttttctattcctttaataagttaatagatttaatttacaagtcgaatcctgcacatttcgcgcaccaaattcacatccatacattgatacatatctgcacacagctagagaaattgaagagctagatcatacatagcgcgaatatatacattttaccaccgtacgcatccatatcgtctatgtcacgcctagaaattcactagtaatttccgaacttatttgtgcattaaatcctcatccagtaatcagccgaggtacacaaactgacaatttaatatacagattcatcaagttaactaaaacgataaatacttacataagaggcacttagtcctcacaacgaagaaaactgcagcgaaaaataaaatctagcgaagctccggctccactcccacaggcagctcaattggggtataagccaaacgtcttctccttcgcaacttttcttcaactgaggtttgattgattattgcaaggtgagcatatgacatactcagcaagccaaacagcaagtatgcaagtgtacaaggataccaaagaatggcataatatagggctcatttgcaaaagcagcatttagcagacatttgagaattgtaaaacagtagagtaattaatcatcaatattaatcaacactgaacagcacacccatgctgcacaggccgaaccatcctgaacaaccatacccggctgtacagatctatctccaaaccaggaatgtaccattccaaaccaggagctaatcaaattattaccagttataatatcatttattatggtgagaagtgtgagactaatcacgaaaggcattgttagacccgcccatgaccgcgggcacggctattcgaatagttttactctggccagaggtgtaccactgtacccacaagacacgattccacacatgttactatgccctaaagtaccaccacggcactgcaaagggggaaatcgtgacagtacccttcgcacaacacaactcaaagtagtgcactgttcctggattataatcacccccttataaaacaaggcatggactccccagcgacccccgtgggcttatctccgccacttctcagtctggtgccccgcaatgaaccatgctatacaaaagataaagccgttgcccatgctggcttatggttggcacgggttaatatttcacagccgaaactcgtgaaccggtccttaattgtcatgagcacgaccatcaaaaccatgtactcacaacccaccattatcaagttttagttggcaattaattaattcacaatcacgattgaccatcgtgagctacaattaaatatccatcattaagtaatagtgaaacattagttatctcaatagtgtgctaatgtttctaagcatgactaagcaattatatctaatacatctagctgaaccaatatataaaactcaactagtcaaattataacccgaggtaatcaagaaatagggtaatcaatgcaaattggccataacaaaggaacaggttcacgccacccggtgacattcgaaaataaatgcacagttgaaataaatagagaatttaaatataggatcaacatgctcaaaggaattgtgtttgggatctatgtgacttgtcttgcaataaagggtcttcaattaatcttcttgaatactcccgacgcactcacggaccttcgaaacgacagaaacgacaagctaacacgcaaaacgagaaaaaagactaagaaactccaaataaacagtacataaaagtaaacaaatatgtagatcatgattttagatgaattatgaaacttgaacggcctcattctgacttcatatgaattagttatgaattttacatgatttaattccaactaaacctattaaagaaaagactatttcaaattaattaaataatttacaaatgatttataactgagataaaagattaaagcaacctccggaaaatattagattatatttggtacatgacatatattagaaagaaataatatgccactgaaaagagagaacggatttatatcaattttggacggctgagattaatcttgaccgagagttgaccaagatcggatggcttagattaatctggcaagcgagcctcacgagatatcaactcaacgagtcaattctacatgacacatgatcacctaaatgatcaaccgaaaccggcgaacggaattggcggctctgaactaaaggacaactcgacacggacgaatgaacgaagcacggggaacacctcgtttgaacgaacgagcgaacgactcaacaacgtctgcggctaaaccggtgagctagacacgattcacggtaaagccccggtacggcaaacgataggttggtaggaatttagggatgcacctacggctagacaacttgactactgagcaacagctaaagcggcggttaggttaaagtggcacacagctgcgacacggcggcactagggcgacttggctcagctaggcggcggcggcgacacacagctacggcagagacacgcggctagggttaaggcgatggcacagcgacgacagatggtggctacggtagcgggacagcagcaacttggcacgcacgagcagcagcagcacggctgtagcagggagcggcacagcgacggctaggcggctagcgcagcgacgatgtacagcggctaaagagcgacgcggcggcaacaaggtgctggcggcagcggcggtgcacagggcagctgccaagtgacgcggcagcggctgcgctagggttagagcaacagcggcggcgacatgaccgagggattgaaacctaacccgaggggacacggatagaagtctcgccgaaccaaatcgatcggagagggagggtcgatgatgacgacgctagacaaacaacggattagattagattggattaaggccctagggaaaaaaatctataccggtgaacgtcataggagcggcggttgccggcgaaccacggcacaataatgcaaacgaatgcaaacgaagggcaccgggagaaagaggaggcaacagcgattcttaccaacacttacgcgacgacggacagctacggaagatggccggcgacgagatcgggacggcggtgagatactgtccacggtggcgacggtgtttcggcgaccttcggcgacaacggaggggtggacggccttcggcttggtgctgcgatgccgacgacggcctcggggtgaaccggcgacgactgcaacagcaaggaggctcggccggagatcaaaccgaggaggcaaactcggccttcacggtgacagcgacttccagcgagacttggcggaggggaaccggtagacggggtagatctcgaccttgcggagccgatggaggtggcggcgcaggagggcgacggcctaggcgacggcgcacggctgctggagtggcggccggaggcggcgaagcttggattcgagtcggcgaggtacttccagaggtcttcggcgtcggggaagtggaggccggtcttcctctccttcctgcgaacccaacggcggcagcggcaaccgaaagcgacgacagacgacgacgaacggcgcggctggagcggcgccggcgcttggagagagaaggagagcgcggggagagcgattccggcggcggcggaagacgggacttgagaggataggtagaggacgactagggggtcctttatatgggcacgggagctcgggtccgggcccaagtcgacgggaaaactcgggaaagtctagggttctcgccggaaaaaggaaagattgaaccgcgaaattggaaaggatttccatagaaacttttggggatttcttggggaaaaggaagaggagattgagaggattccattcccgcaactaatttggaaagaggagcaacggggaggtcggatttggaaggggatcggcgcggcggcacaggctcggctcgggctctgtctggaggttgaagatagagtactgtagcgccagggaagtcaaacagacttctctgcgggctgactaggaaggaagattttattgcttttccaaataaattaaccaatgagatgatctttcaattgttaaaaatacttccaatgcttaaataattctaagaaaaatctttaacatacttggacactcaaagtatttattaaaatttaaaccagctcatttcatgattaatttaatatgtgaataattactgaaatattctttgtattattaaaattaggaattgagctctgaaaaacccgagaaaatttcagagagtataattaatcatggagaacttaatacaaattaaattcatccatactttatatttaggaaattttattttctacatttaacttcacttgtaaattaataaacatttaatataaattctattaataatctattaaataatttataaatcctaaagcggaaattcaggctgtgacagtctatgtcccagggaaacatgagcactcatgtcaaatttaatactttaactcgatccgatcggtggttatgtttgatcagttaatatatatatatatatatatatatatatatatatatatatatatatatatatatatatatatatatatatatatgctcagctcatcactacaatataatcatttcttttataaaaaaacaacattctttcaactcatttttcaactctattttaaacctacaatcccttgtatatatggacgaagagagtataacgcgctagcaatggtacatacattttagacaatggcaacagggggatgttgggccaggaggcatgcgtccatatcaactcggagctacacccaactccctacgaggcctccacattcagcttcgagttcatctgggacatgaagaaacagggtgtccccggagcggtcatcgtcaagaactattgcgacgaggagttcttcgtcaacaccatcaccctcgacattgtaccgggctatggaaccatcgtcttcaccgctgagtcgtgggtttaccccgacgagatatacgaccatctcccccgtgtcttcttcagtaaccaagtaagctcgtcttgaaatattctaccggtcatgttttatgtactttgtgaattttgatcgagaattgtccgtacatcgtcactggtatacccatttttgtgattttgaaatgacaacgtcggatttggcactttaattgtttatatgatcgtgggttaagttgtttacaaacgttatatatgatgaaataatataatataaattaatgatcaaaactctatgtaacagtatacttttacaattcaatactccctccgtcctataatataagggattttgagttttcgtttgaactgtttgatcactcgtcttatttaaaaaaatttagaattattatttatttttttgtgacatactttattatctaaagtactttaagcacaacttttcgttttttatatttgcacaagttttttgaataagacgagtggttaaacagttcaaccaataactcaaaatctcttatattatgggatggagggagtatatttctataccagcagtatatagacgggcaaaattataaattttatagaaaattgaaaagggctttctagtaattttgtggttgagagagttaatcggttcaattgggacttatatataagcgtttaaaaaatatatgcaactttatactcaagttatgtagaggtaacaatatagttagatatagatgtggtgtaattacactatagtttttttctcgaacgcacaaaaggattgcacgtcaatatattaggtaattatactatagttacaatgtaatgtacattatagtgttattacatttgaaagttttttacctaaaaaattcgcgagaactttaagcaatttccaactgacatatacatgtacttgcacagccatacctgccaaaccaaatgccggcgccgctggtgccgtatagggaggaagagctccggaacctgagaggcgacgacaatccgggcccgtacaaggaccatgaccgtgtctaccgctacgacgtctacaacgacctcggcgagccagacagtggcaacccgcgccccgtgctgggtggctccgacgagcacccttaccctcgccgctgccgcaccggccggaggcggaccaacaccgaccccgactccgagagccgcaacgtcggcttccccctaaccaaccatttctacgtgccccgcgacgaggtgttcaacgaccgcaagaaggcctacttcgacaccaacaacctcaagctctatatcatgcaaaagtacgccacctttctcttgcacgccgaccagcagacccccttcgagttcgacagcttcgccgacgtgctaagcctctacgacgagggctccatcaacctgcccggatggctcaacactttcctccaaccattgctcggcataatccccttcaagttgctccagcaagtcctcacccccgatagcgagttcatcctcaagttccccatgccggcggtcatcagggaggacaagacggcatggcaaacagacgaagagtttgcgcgcgagatgctcgccggcaccaacccggtcgtcatccgccggctcggggaaaccgagttcccgcccaagagcaagctagacacaagcaagtatcacaaccagaacagcaggatcacagcggcacacgtcgagaagtgcctcgaggtcgagggcctcaccgtcgagcaggtgctagccgacggccgcctcttcatcctcgaccaccacgaccacttcatgccgtacctgctcgatgccaaccatcaacccgacactttcgtctacgcgacgaggacactgctcttccaccgcaacgatggcactctccagcctgcagcaatcgagctcagcctacctcgctttgaggccggcagcacactcatctcgtccgtcggcgaggtctacacgccggcgtcagacggcgtggagggccacatctggcagcttgccaaggcctacgtcaccgtcaatgactactcgtggcaccagctcgtcagccactggctcaacacgcacgcggtgatggagccgttcgccattgccacgcaccggcagctcagcgtggcgcaccctatccacaagctcctccacccgcactatcgtgacaacttgtttatcaacgccctcggccgccagagtctgatcaacgccggtggtagctccgagaacaccgtcttcctcggcaagtatgggctctccatgacatcggaggtgtacaggaactggaacttcaccgagcaggcgctcccggaggacttcatcaagaggggcgtcgccaagcgccgctccaatggcgagctggagctgctgatcaaggactacccgtacgccgtcgatgggctcgccatctggtcggcaatcgagacttgggtccgcgactattgtgccatctactacgcggacgatgcggcggtccagggcgacgccgagctgcagtcgtggtggaaagatgtgcgcgaggaaggacacggagacctcaaggaccacaaatggtggccggagatgaagacggtggccgagcttgtccagtcatgcgccaccatcatctggatcgcctcggcgctgcacgcggccgtcaacttcggccagtacatgtacgccggctacgtcccgaaccggccgtcggtgagtcggcggccgatgccgaagccgggcaccgacttgtacagggagctggagctccacccggagaaggaattccttctcaccatcactaagcaggacctgtccatagctggcattgccctcgtcgagctcctatctagccattccgatgacgaggtctacctcgggcagcgcgactcgccgaactggacgtccgacctggatgccatgaacgcgttcgaccgcttccgtgaacggctcttggaggtggagaagaacatcgtggccaagaacgacaagggcagtggattcaagaacaggacagggccggtcaacatcccctacaatttgctcttcccttatgcctccggcgacgcggaggccaacaccggggtcaccggcaagggcatccccaacagcgcttccatctgatcaagcactatactatacaacaagggcaagcaaggggacacatactccttaattagcaacatttctcttctcgtgtaatgtgataattcagtatgggtcataagtttgtttatgcaataaattaaaataaaatcggactacctataaaactgtcaaaagaaaatttctctaaaatatttcaaatgtaattatagtgtaactatattataattcaggtgtaaccgaaatgtaacttgtctaatcttatagaaagatcaagtggctagcatgcatggtttgcgggagcgaggtctagcaaatctgaaataaaataattcagtaaatttcggtgaacaccatgcccaccatgaaaggccggaacattaattatttgccacccaccagacccatatgttattgacacgtgaagatccacatgtcattggcacatggatgacaaaataattaaacactaaatctaagagggcaaatagttaaaaaccgtccctaaaacactatcatggaagcttacttctttcacatgaaggtgaacctaggcctgaggcaacctacgggacgaaatgcccattatatatacatttcaagttttcactatactagtataaatttaacctagactagaatatgatggtttgggccttggtttatactcgtatttagataagaaaattgcatcgataccccgctataatattaatgaaaatttcaagaatttctctgtgcagagactcacatgactataaaaagtggaggatcttgaccccacctaatgttatccctctatcttctcccttctcaccctcttcccatgttctcgtggctggtgaggacgtggcaccaacaagctgcgccatcgctggtaacctcgcgagaaaggcatctggtgagcgctggacggggttgaaaaatgcgcagcaaaatgtcacaaggagaattggaccgaaaaaaaaaatcagatgcattgaaattgtacaacagaaatgcgatatctatccacataaggatagccaaatgcataaatcaatcacacaattagaaggaaaacggatcaaacacaaataaaaaacaaaggctcatctactgtaacacgggggcagctagccgttgactctaagtgtttcttttaataatgggaaaattgactctatgcgctgaccgcaagagcgggctaagaaattcaagtgtgtgtattcaaaatgtgaaaggataaaaaagatcctttcgacgaaatttaagagtgtgtattcaaaatgttaaggggtaaaaataattctttcgacagcttaaaaacctaatattgatatgtataatagcacatagtactcatggtataatatatttaatactaactcttggcaatggccggtatggtctcttttttaattttttatacacatatgcattatttcctgtgtattatctaaattatttttatcaaaattcctggtattcatcgaaataccaatgaattaattaagctgggcccgcccataattacgtatctatgaatggctgcatgttgtctcgatagagtttagaatttttcaaaaaatatcagcaaacaactggtctgttttacttacgtcatccacgaaccatcaaatttgaccaagcagtggtgctacttttgttcaggtcgttttgctttcaatactattaagaaagaaaccatcaatattgaccaaacgatcggaccaaagcgaaagatatactccctccgtctcaaaaaaaaaaaagacaaaccctgggtttccgtgtccaactttaactgttcgccttatatgaattttttttataattcgtatttttattgttgttagatgataaacatgattaatattttatgcgtgacttgtctttttaatttttttcataattttttcaaataagacggacggtcaaacattgggcacggaatctagggtttgtctttttttggacggagggagtatgcccttaggctgcatttaagagttgaacaaagagaaggtcacgcgcaagtttctcgaactgctaaacggtttgttttttgaaaaaaaaagtttctatagaaaagttgctttaaaaatcatattaatcccttttcaagtttaaaagtaattaatacttaattaattaccatagcttacatcgttttgtaagctcttcaccatgcattgccatgtcatcgtacctcttacctcattctcatgtggtgtatcataagtgaaaactgaaaaagatagtataaaacagatgtgacgaacaagatgatatacgggataagaattaagaaaaacattctgtcaataaaatattaagtttaagggcaataaaaaggatgacaaaagaaaaaaaaagaacagtttgtgttattacctcgtcctttcccggacatctaccgtggttgatccttctactagcagtctaacacagcctacaatccttcaaggatgataaaccgtagacatcctcttcactgatcaaatcagacaaagacaaccaatccaatcagcttaataaccccaaaattcccctcgcgcgttcggcgttccccctctccaaaaaactcaaaattcaaactcacacctcaatcaccctcttccaaaaatttgaaccgtacatatgtacccaaacaacgacgtctcaataaaaaaaaaaacacatcacatcgcgccccacgcccccccttcgttacccccgtccgtccaatttccaaccaacggttggccccacccaaccccacc

SEQ ID NO: 73405 - DNA, 4950 bp, Oryza sativa
aatagcatcagatgttgctatatcttgattggcaggagatatagcaagtatgatgcagtttggctacaaaagaaaatacaaaaatgtcactgcataaggtacacacaaatgcacacttcatagtctcctgcaatgttgttaagatatggtcatcttggagctttagtttgcagtataacttaatgcaacatacaaaataaagcactagtgaatataggaattaatttcaacaaaggaaaggcacaatataatcagcaccacatatgtacttccgttggatgtagaggctgggtttaatccattttctaaaaaaatagccccatattggagtacttttgtctaaccctggaaaaaatattatagccaactagcccacttggaaaagaatggctgtaagaaatatgctataaacgggcagatccaaggaacttgcttacattttttaaaatactttgtagaaggcatccaagcaaacaatattaaatgctaatgagaccgtgagacatgcaaagggtacttaaatctatcagtcagcattaactgctaatgagactgtgaaatataggtgtgggagaccaatcaagctagaattgtataagtgaatattgatacgaggaaatattgcacccttattttaacaccccagagatgtaataagtcaagtggcactgaatttatttttaaggcgcatcgaataattcataaaatgaaaaaaatacccagtggtagtactttaataagaatgtgtaggcctatattctatactgaagtaatataccttgtcaacatatgagcgcaccatattttcaatatcctggacaatgctttcaggctgtccttctgaaaggcaatgtagtaagtgaaaattctctggttaacattgcttaagtccaagtaagttcaagcatgaaaatcggtacacatttccatacctactgcaactttagttagacccggcagatcaatcaatgtcaagttgaccactgcaatagttcattgaatagagttatgttaagttaagaattctggagttacatgaagctgcgatgtactgcatataagtaaagtctatgcctgtgtgagaaaaaaaggaaattaaaggttgcacaagtattgttgccaaacagaaaacacagtcttatttatataagatgaaaccggaaaaataaaatttgacaagtaaaagcagctgtgatccttcattaaaaaaaaaaaagaagcagcataagtcaagcaaagggtgtgagtaccatgtggtgagtaaatgctgagatgaattggaacaggtgatatttgtttagtcttccctgtcagcctatcagtttcatcttgaatttccttccgcacaagagctgcagaaaacaaatatcaccattcaccagcatgtttgtaagaactatctgttcaacttcagtcatttccaaggtaacaagacgctgaaaccacacagaattcattacaagcaaatgtatcctctatatattttgcaaccatttgcattagttaaataaagtaattttaatatgtctacagccctagtaatgacaacagattgcttctccagttctgcttctctcgtgacaatttattgatcgtttaagtgaaagtaaatttattgatcgtgacaattttatggagcattacctaggcagtgttatacctgtatagctgaaaaattactgccgaattttgacattaaacaagaggatacatatgtagtagcagtgtagaaaccgaacaatacagcatctgctgctagcaactgctaattgcagggttaattacactaaacatggccaattgtgcatttcattaaagcaatttgcctacggccactaagtaaaccagttcaaagcataaacccataaaaccccccaaacaactgcaagacactgaaaatgtctgagcgcgcgcgcccatgcgtatagagagagtgagtgagagcactcaccaaaatcgttgaaccggcgcttgggcatatgcaagaactcagcgtactcctgcaccccgtcctccgtcttgtgcagctgcaaaaccagcggccttctcgtcacgatacctgtaatcgaagacacaaacctcgtggccgtaaaaatcacagcacgggtactcgaaaattcggacacaggcgcagaattcccgatcaaacctgagcccctaggcaggaagtcgcggcccacgatgctctccagcaccgatgacttgccggaactctgcacgcatgcaaccggcgcaaataaaatcgagcgttcacctccgaaattgagcaacgacgcgaaaccctaggtgggggagcagaggcggtatagggcgggggggcgcacctggccaccgacgacggcgacggaagggagcgcctcccacagcgtggggagggaggcggtgccgtcgccgccgccgtggtccccgaggacggtgcaggctcgctggatgcggttcacgagcacgatcacgttctccatcgtcgccatctccggcgaggcggagggaggcggcacctccttgcccggacgaggagcgggagtggaaggttctagaaggaggcggaaggttcgagagggagaaagcactgtgtctctgtgggcgaagcgaagggagcagagaggcgtcactgtcgcgacggcatcggatagggacgaaagcgtgcaactgctcccattttacggttttgccccttgcggcaaattccaatttccaagtggcccggcgggaacaagttccccgaaattcgaaattcaaatattcgttttacttttcggatgaattgaaatttcaaaaggattttcagtatacctttttactcttgaatttcgtaagagatccaaagcaaatgcaagcaaattatttcagcaacttgcagcagacaaggtttggagtaaggggcagtttgggaatcagagggtggataagggaggtgggccagaatggacaggacagaatggttggttcaaatgtctttcaaaattcctcgcccggatttcaaattctctggaatggtgggccccggatgatgcgcgcacgcgcatattccttcgttgtatgccgttgggctatggcccatgaaaaatggaccggaaacattgaggcccacttaggaaatgaaattgggattaatttaggccattgtaggttggaataagatcactttgactccctcaactgagcaccgaatctaaatcgtatccctcaaccacaataccaaaaatcttgacccccgaacttacaaaaccggtgcaatttgactcccttggtggttttggaggacagtttcgctgacgtggcgcacacgtggcagtgttgacttggtatttgtcccacgtggtattgacgtggtgcttgtgtcattaaaataaaaatatatatgtgggacccatttgtcattcacacaaaaaaatgtgggatccacatgccatcttctctctcactacccttcttcctcctctcccttatttctctctctctctctctccccttcatatgagccggcggcaagcgggggctaggtggcggcagcagcggcgatggcgcccgggtgggtgccggagcggtggcgccggtgggcggtggacctcgggcgacgggcgcgggagcagctccgctgcaaccacatcaggccgccgccgccgcccagcagctcgttcgtcgggtgaaggagtccgaccagtgccgtctccagcaccggcacggcgaagttgatgtcggggaagatccgtcggtcggtgatgaacaggatgagctggtagttgtttccctgaaagtccaccgcctctctgctggccaagaactgctccggccagaactcctccgacgagttccatgccgcggggtatctccccattgcccacacgttgatgaacaacgacgtcttggccaggatctcttagccttgtacgaccgccgtcgccgtcgactggcgcgggacaaggatcggggcgggacgggcttcccgtcggccgctcgactgatctcgtcctgcagcttcgccatcacccgcgtgttcgccgtgagctccgccatgatccattccagcgtctctgtccatcgcccgccgccgccgccgccgatctggacgccgctccccacgcacgaagaaagagagggagagacagcgaagggaggagagggaggaggaagaggatgacacatgggacccacatgtcagtgggtcccataatttttttttgtgtgaatgacaaatgggtctcgcatatattttttttattttaatgccacataaacgccacgtcaatgccacgtgggacaaagactatgtcaacactgccacgtgtgcgacacgtcagcgaatccgccctccaaaaccactaagggagtcaaattgcaccggttttgtaagttcggggagtcaagatttctggtattgcggttgagggatactatttagattcggtgatcagttgagggagtcaaagtgatcttattccttgtaggttcactgaggcccaggatacttgcagcctcggccgacaatatgggtctgtctaatgggcgtcgaagtgttgtacaggcccaagcaccaaattagtctgattacttgcattctaaccattttactgttgatctcatcaccatcatcgtggaaaacattaggatatccggcgcgttgctgcggcgaatggtaaaaacattaaaggttaaaggcatcctcaatgtctaagatgcatagaggttataaggtgagactcaccattatatggtctttggctaatagcatatgctacaatgtttatagtttttttatcgactttacggttggacccactcgaaaaaattttgtttcacccttttacatgcaggattcaaagacccacatcatgctacaaaggtataaccatagcaacattctcttcttttatcttctcccaatgcataaagcaataacaaacatattactttattccttaatatcatatttgcatgcacattgtggat

SEQ ID NO: 73406 - DNA, 27317 bp, Oryza sativa
aatacatacgttacatgcatgcacttagtaaactcggttcgatcggctgggtcatggtcaaactgtccgagaccggtgaaccagaagggtgactgggtcatctacggtccggttttttccactatggttaagttgcatccggtaaggaaaaaaaaggtgggactcatcttctcccttcacacctccacctctcctctcctctcctctccctatccccccgctctctctctctctctctctcggacgggcactatggctcgtttgtgggcatgtgggcatgctttagcgtaacactatggttcattggctaggttggggtctctgcgacccatcgaccaaaggcgtaaggtggagagtgaggaatgaggaaggaggagggacatgtttagattgtagccaaaataaacgttaccaagttttggcagtgccaaaatattggcaagatgacaatattgctacaattttagcaggatttgtgatcaaatttggcaacaaactaaacatagacatattttttggcaactttaccaaaaatggtatgatattaaagtgaacagacccgagattataacatctgggaccaatgattttttttaaatcagacatgtggatcctattcttcatatgtttttttgtttttttccgctgattgtaattacatgtaagtgacttatcaggtgaagactaggtcaatattttttccacatatgatacaactgccgtctaaaccaccgcgggactcgatatacaatgttttgatagtaggggacgctctatacccattacttgaggtatctaatgtgaactcttttctttttgtggctacctgcactgtttgtacgtatgggccatgatgcagcccagtgcactaaagcccaaccaggactgccttgccggcctcctgcgcttggtgctcttcgatcgtgtgtcctcctccgtggcctagccctagccgcccgttccaatccaacggttcgcgacggccagaaggggttcgtccgggtgaataaaaatccgaaccccttcacgagatcgacgccttggacgcctctctgcttttcgagttcgacgaaatcgggtttcgtcctacccaaattcaaagcattttgtttcatcattatgacttggagaacgtgttccagtaccacgccttttttttcagcaaaattacacgtcacaaacagaagaaggggaaacaacagggtcgagacaaatgagccattcataattcattcattaggcatacgaaaagtagagagtacaggggaaagcaagatgagttgcatcagatttctgaatcatatggcccctcctcctgcacttacatcacccactgtttcatctcatagcaatcactggctcgcaaaaggacacacactgacacaaactcgaggacggacggacaccattgactgccatactccgatcgatcgaacgaacgaacacggtcttatttcggtagcagatcgatcaaattattagctagagtagaagcagagcagacgcgacgacgatggcaatgcaatgcagctccccctccccggaatctctgcagatgcaaagaagcagcaatccaagtgtcagaatctctgatttcttcagaggatccgaaggaaattaatcgatcagcgatggcattgtgcattgttagcggtggaacttacaccaggggaggatcttccagcgctggttgtcaccctcgcaccacttccacagcacgatctcggtgccatcgtggatgccgccgtgatccttgtcgccatggaaggcgtcgaagttgaggtagatgttgttcaccatgcggatgcagcggaagcccttgcccacatccttgctctccgtccacagcacagactcgtcctggtactctgggttgtagggaaccagcttcacctgcatgcgcagagaaaatcgttcgttgtgattcagagattcgttgcatatgtaagaaaatatttattttgtaagaaaagatttgctcaccgggtggccctgtccggtggagtgcttgatggcttcgccggtgaccttgttgaccagcgcgaacgccgggtagccttcctcgtccctgatcttgttgctgtgcctcatgtccttgatccagtgctacaaaccacaaccacaaatctctcaaggtttttctctatctgaatagtagtatataattaagaggagaatacgtacctggtagtcgtccctggggttcttgggggcgaggcaggcggtgccgttgcggacggtgaggcagtagtcctcgcctgcggcggagaagacgcggacggtgtggacggggacgccgccgatggtgcaggcggtggcggcgccgggggaggaggagtgagcctcggggccccaggggaggatcttccagctctggttgtcgcccttgcaccactcccagagcacgacggtggtgccgtcgcggacgccgccgtggtccttgtcgccgtggaaggcgtccaagttgaggcgggtgttgttgaccatgcggatgcagcggaagcccttgccgacgtccttgctctccgtccacagcaccgacgcgtcctcgtactccgggttgaacggcacaagcttcacctgcacacccatcacccgccatgagtccatgacatcgaagtcaacgttcttcgatcttccatggcagcacgcacaaagctagcagcaaaatagaaatatagtattacggggtgggactggccgagggagtgcttgacggcgagtccggtggccttgttgacgagggcgaacgccggcatgccctccccgtccttcaccttggtgctgaacctcatgtccttgaaccagtgctgcatttcaattcattccatttcagtatacatcaaaatccgatcgaatatagaaacaaaagaaaaggcatatataagaagggggacctgacctggtgctcgtccttggggttgacgggggcgaggacgacggcgctgtcgcggacggtgaggcagtagttctcgttggcgcggcagaagatcttgaagatctggttcgggtccgacggcgccgccggtgcctggttgtggtggtgcccgaacccaaacatcttcgacccttaattcgatcggtgcaactcgcgactcgcgagagaaatgtttttgtgctgcgactgcgagcgatgatgcgaggaggagcgagaggtgccacgttttatagaaggccaaggccggccactctcaccctcacccactgatcgatcggctcggctcgatgacgcgctctcctgtgccaactcccacgttcgctgacagctgggcccaccggtggtcctcgactggctcaaacgcgtgacatgcgtgcgtgtatgttttgcattctagccgtttgatttgaatatttgatatgatatgatatatctttggtgtttaatgtactctcagattcggttccatgaacttgacttggatgctagtaccagtaattcattgtgctgagatttgcattactaaatgtgcgagtaaatgcaaagatttgattactggtgcacagttaattgctctacttactcagtggaagactagagcagtacaccaacttcattgagtatttttggagcagcctgatttcttacaaccggataacataatatcactaccattaccgtgacaggtatgtgggtcatatactcctattgttccacacgtcagtgcttgtaatggtagtgctgccattatgatagagaatgtggatcccttccaacttgtaaaacaacactttctttttcagaaaagcataaactctttcacccgaaataaaaattaaggggaaaaaaacaatctttgcttaagaaaagaacaaagagagatgctgcttgctcgctttccattgtccgggaatttcgaccattgttttccccaaaatcgaaaggtatgtcgccacgaaggacgaggtgatcgaaatgcatgccgtggcccaggattgaagcgtgcacctgacgcaaatccataaaacaagctaagagatgtgattccagctagagatgacccttgtgacggtcgttttgtacgtttgcatccctgtgctacacaagaaacaaaggcagttttacttttctgaatcaccatggatcgcccatggatggatggttcgatcatccctgtccgtttccaatgagcacatctaatctgacctgaatgatgcatgatgcatgaaaggtggtaaaaaagttgttaactgataagagaataatctttttacccggcaagctgctctatatcacggccacgcagcgcctgtatggccaagaacgttccagatttcaacacctaattaatcgacgcgtcgcctgccttttgcaatgcttttacaggcttaagctttgttgttgtgcttaacaacaatgcagcaggcagaaaacgggttagctacatgcatctccctttgatttttgttgtcacgtactactctctcaacttgtcaggatgaaaagtttcgactctttaactttctcaaacgaaaacaagtcaagttttcgcgaacatttggagtgctgtgcagatagcaacgcgttgctggtttgtagtagtatagtaccgttgtttcaaccgttctacccttatagctcccgcaatggtaaaataaggtactctctataaaacatatacatctcagcaatagactcgattaatagtaaaccaccttaatagtatgtctacatttgtatctatagctctctcatgcattgcctcgtttttctctatagattatctctaagttagtagatagctttactctctctcttcatttaataccttctaagtaggaaaatatactgacatagatcttttgtagagagcttataaataaccagtgataactttagaggagtaggtgaagcctgtccttaaactcaccttacaattaggagtagtaattgctatgtgtaggttgtcctgtggagtttgtggacgttggagcagatgatgttgcatttgctaaattggtaatggtgaatttattattgtcttggtgtgattaggtgaacacttttgtcctgtctagctagtatagtactccacaaaccaaccttgacgatttcaacagaaaataaaaaggctaatctaatctgttagctaagcttggctgggtttatctggactggatggatcatgggtgtgtgggtttagctcaggtaggcacacgttttgccaccctgctcgtatactccctccacccttaaaaaaaactcaacctactgatctcttctagttcagatttattgtcttaggatgtaacctcttctaggttaagttttttagacgagaaaagtattactctatgatatctccctcgtcataatcgaaaacaagggtgcttatctcatgaagtgccatgtggatgtggatcaacaatccctagctcaaaagcattttagcaggggctcggtttaagaaaaaatgttgttttcgcaaagggttactaatatatattactccctccttcccatattgtttatcatataataaaatttaaaatttcttaaattaatcatcatataaccgtgcgcatggacacgaatttcatcggaatacaactaatgtagcaagagagaatgtgtgcatgctaaaaatgtaattggcatggtattttaatcgatgcatgtattgtgaaagaatatgtgtatggtgtctttattgatgcgatttaaattattcttgttcttggtgtataaacatactatttatggttaatctatttgggatgaagggagtactatttatggttaattatttttaaaattagaacggaaatggataccttgacctttccattcgcatggcaccgtgttgccttgtgttttaaagttttgaactcaattacatactaccttcttttcaaaatgtatagcgcctttgatttttttataacatttaatcttattaaaaaataatatgtaaaagtataaggtaagattatattttatttgatgataaaacaaatcacaataaacaataatatttatataatcattttgaataagatgaacgatcaaatgttatgaaaagtcaacgacgtcatacattataaatggaggaagtactacttatagtgtagtcacagtataactaggctgtaattacacccgagttacatcgatagtttttttgtttaaaatcgatcgatagcgctacaggtagactctttttttttttttgtagacgacgtattcatcaacaaggagaccgtgagtgcttttttatattggcacaatctttgggtgtgctttatattggcacagtctgtaaaggtaggatgtttgtgggtgcacggaggctgtgagcatgtgtttagcaaagaaaaaaaaagcagcttcaatgatgccttcattttctcttgaggaaggatgttttgggctggtgaaattcacgtactgaatgtttggatcatcgtcgtcatgtacagctaataggtgggccattcatattacgaagtggaggtccaataacaaaacttgggccatatttgttcggaaaaaatggatgtatttaggggtaagcaagaaaaaactgaaaccaaagaccaagctaaactgaccataccaagaccgagaatttcggtatctatactgaactaaccaaattttgttcggtcatgggcttcggttgaccgaatcaaccgaaataccttctaagccctataagcccactaagcccgatagagaaactctaattttccacccctccaagtcccaacaaaccccacatccacaccacccaccctgccaccccggccttttggttgttgcgtcgccgtcacccgcttcttcttgccttcgcgtgttgaccaagccagcgcccccctccccctccgcccaacaagaatcgcctcagcaccatcgcgttgtgctcgcgcctcctcctcgcaccacaccgccattgtatagcctacctccgactcccctccagtcctctactcagacctcctttcttgctcatgctggcagtggcgcctcgactccaacgatggcgacatacagctggcctcccctcaacctctctgtccactcctgcacgtaccggcggctactcctcgactccaacaaagacgatacatcaagccgtcatccccttccctctagcagttttcttgatttgggcacaaggtggagatggcggcggagcaggagggcacatgcaatagtcggtggttggttgaggggctatcgacgaagattgcaacctggcctccccagcccccatccactctgattttttttattttggataattttcttgtgattttcttaatttatctcctgattattttaatcatgatcaagatcgagaccaaatttggtggtcttgataaatttctactattgtccagtctcttttcaataaccgaactaaccgaaaaaagacaggatatcaagatatcaagatcaaaattttcaatctgaccaaatgcccaccccttgatacatatgggccctattacacttttcactaattttggcccgtttggaaccttgcttcttgtctccgtctatactctagtactagtctactcttccaaagagaagatgcagattgttcgtctgtacttgatacatcagcttctcaatccaaactgtttgcttagtttggacggtttttggtgcacatatggagataattaacgtaggtttgctcaactgctctttgactaaatctgattgtgttgcgtgtgcatctcacacccaaaagtgcattgccaatcctatatataagaggacgagcagttcatcattttttttcttcatgtttagctgttcggccttgttgaaaaaacagcactacattgttaatttcgtccgtgatgtaagacttggacgcttgggagttaagagttagaccaatctgcatttttccaagataagaattgaattggacccatcggcatgcgaacaaacggtagtgtacctgcagagtactgacgatgggctgacttgatggcaacctagaagtctctagtccttaggagtagtagttcttaacaacaacattagactcggacttttgcaagcccttaatctgaaatctcgattctgttataaaaatttagttagctgattttacgatttttacaatttttatgtatatatacaattttatgattatggccttacacggaaatttttttgcgaacgcgcaaaaggattgcacgtcagtatattagcaggaaaagagtttttgttacacaaaacaatcagccagactggcttatgcctaaaaggggggggggacttgaagctaggaactactacgacggttaaaaacacaactccaaacagcgggagggggcagagccacgctacatttccaagaaaaccccaaaaaaagtaacactagctaaagaccacagctggccctccgagcggatggactccagaaccactgcaaccgaagcgagcacagagtcgaaaaccctggagtttcgttccttccacagctgccaggagactaggagtaccaaggagtcgaagccgctgcggaggtgctcaggtaaatataccctggaggatgaccaccaatcctggagccaactgccacgagggggagagagggcagcccagccaggaggggacaacacacggagccagacctgccgagcgaacacgcaatcaatgaggatgtggttcgctgtctcaagctcctgagcacaaaaggggcaagcagagtggctatcgataccacgcttttggagaagatcggcagtccaacagcgctgctgaaatgcaaaccaaaggaagaacttgcatttagcagggcccttcgcgtgccagagtaagtcggcacaggcaaaagagtgttggccaaggaagaacgcctgatacgccgatcgcgctgagtagcactggtcacccgtccaacgccagacgaggtgatcctcaacacccggcgagagctgggtaggaagcaccgcgtcccagactaacaggaactgagagatgactgggacagtgagggcgccacgtatgtcaccaacccaggagttgtcggtaacccagcagtaactgtgcgcgatccccggaagcgtggaggcacggcgtggaggaggtcaggagctatagaagctatcgagcgaccatcgatccaccgatcagtccagaagagcgtggactgaccatctcccaggatagagaaggtggatgctgcgaacatgtcggagacactccactcaataggggccttcagatcagaccagtaggggtgtcccgagcgctgaagccagagccagcgaactctcaaggcaaagccagccaccctgagatccggaatgcccagtccaccgagatccctaggacgacaaaccctcgtccaggacacccggcactgtcccccattggccgagtctgtacccatccacaagaaggcgcgacgcttcttgtcaatggctttgataacccagcttggcaagccgatcgccatagaaacggagaaccgactagactagaaccgagcgacccgccagagtggttagacggcccttccagggggggagccgatgggagactttatccacaagcagttgcagggccgcttttggcagcttgcgaactgacagtggaatgccgaggtaggtgcagggaaactccgagatcgagcaaggaaaagaggactgaaccagctccaggtcaagaaccgagcagcggatcggagtaaccgagcacttggtgaagttggtccgaagcccggaagcggcaccgaagacagagaggatgccttggatgaactcaaggtcttgccgaacgggggaaaggaagagaactagatcatcggcgtagagggatgcacgatgtcgaatagcacggtcattgaggggaagaaaaccacccgaatcagaggctttgcggagcatcgcattgagcacatccatgactagaatgaaaagcatgggggaaagaggatctccttggcaaagacctctccgatgggggaaccatggacctggcaccccattaaccagtacccgggaagaggaggcactgagaatgagggagatccaatcacgccaacgttgactgaagccaagctgggctagcacctcaagcaagaaaggctagctgaccatgtcaaaggccttcgcgatatccaccttgagaagaagtcggggaacgcgtttggcgtggagcgcccttgcctcaatctggacatagcggaagttgtcatggagagagcggcccttgatgaaagcgctctggttaggcgccacaagctcgtccaggcgaggggagagacgagaggccaagatcttggagaacagcttcccaaagctgtgaataatgctaatcggcctgaaatccttaacatcaacagcctcgtccttcttcggcaagagggagattagggcgtcgttgagggaagcaaaaccttggccgttggtcaggaacaaggagttaagggccgccagaatttcgaccttgatcaccggccagcaagacttgtagaaacggcccgtaaaaccgtcaggactgggcgccttatcagagggcaaggacttgatcaccgcccagacctcatcctctgtgaagggacagtccagcccctcaagctgcgcagggcggaggccaagagagtggaggtctagggcgagttcacgctcgaagctcgtccccaagatggcgcaaaagtgagaggaggcaagctcttgcagcgcatcatgggagacgacaagctggtcaccatcacgaaggcgcgtgatgaagttcttccgcctacgagctctggcgtgcaggtggaagaacttggtattggcgtcaccctccttaagccagaccaaacgtgaacgttgacgcgcgatagtacgctcaagcgaggcaagaccaagacacttcaactttaaatctcgccacagccaggtctccaagggggaaagagaccgactctcctgcgcaacatcaagccggaagacaagttccttcgccatctgaagctgcagacgaacactgccaatgtgatgttcactccagctctgtaagcgcttggccgtggtagagaagcaccagggaagagcagcaagagggggtaggttggtagggggatgccaggcgtcctgcacgacttgaagaaagccgtcgaacttgggccaaaaggcctcaaaacgaaaacgatgcgctttcggggaggtgacgcaggtatgaaggagaagagcacagtgatcagaggtgatagaagaggccgcttggaggaggcaagaggggaaaagctcctcccaatccgcagagaagaggacgcggtcgagcttaacaagcgtaggcgactcgcgctcattgctccaagtgaagcgacgtccgtgaagcagcagctcctggagttccaactcgtcgacgagtcgacgaaaacgacccatcatacgacgattgagattaaggttgtttttatcccgagcttcgagaatgaggttgaaatcgcctacgacggcccacggccccgtgcgagaggagcgcagcgaacgaagctcatctaagaaacgaagtttgtaaggctcctcctgtggcccatagacgatggagagccaccagggggcgacatcagaagagtgtcgaaccaacgcggtaagagagaaatccgcaaggtgaacatctgagacagaccagacagtcgtccgccaggcaagcaacaccccccactccgaccgaccgcagacaagaaggaataatcaaagtcgaggcctagcatttccagaatagtacgagaggggattacatccataatagtctcctgaagacagagaagagagacatgctcatcacggactacatcacgcacagcatccgggcgggcacgcgagttcagacctcgcacgttccacaccaaaacgttctcattgcatgatcccattgagggggaccacaccgagagtagaagagaagaaaccgatcagccgcacacgaccaacgcctccgcagccttgcccgggggcaaggagccggagaagagcgaggagagcgcgatgatgtgctcctgggaaagtggcttggagaagagggcgttgtaagccgcgatcgcctcggccgtgaccgggcccctctccggaactaggccgagcttccgcatcaggttgcgctgggcgcgcgacactgcgtggatcggcccctcaagcgcctcaagtgccatcttagcagcgatacgctcactgcacttcggcacaacctccaccgccttggcggcgagaggcggcagcggcaaaggcggcgggaggagcgcaggagggagtggcctggagcagctggtgaggaaggcgcgaagagcggcgttgttacacggaaattttgatttaattttatgatcacaacgatcttaacaaacctgctctgtgcaataatatgacaataatcttcagtgttgacttaattactcacggccttttatagctagcggaattaatcgcgggtattaggtgtggtgtcattgggattaaccatttgtcataattgagtcgtcgaagcagatgtaccaaacatagatcaaccgcatagtactgtagtagagtatcaaaccggagcagtactcatctcgccagaagcaaactgggcagagtagacaggcatctcatgacatgaactagtagaacttcgtacaaaagatgcgcatatacgcatggatccacaccaaatagcagggagggggtcatctgatctctgctgacagcgagaccctgatttattctgcagtgacataaacacaggacacgcaacagtaacacgacatgcatgcatggtcgaactcgaacagtgccaaatgcaagcacaggtgacggatcgatcgatgcttttgttgacggtctctcgatttctgcgtcagaaggaacaaaaccaaacaatgtcagttgaaagattctgactaattaagctatatatcggtgataattacttacaccaggggaggatcttccagcgctggttgtcgcccttacaccactcccagagcacgacggtggtgccgtcgtggacgccgccgtggtccttgtcgccatggaaggcgtcaaagttgaggtagatgttgttcaccatgcggacgcagcggaagccatggccgacgtccttgctctccgtccacagcaccgactcgtccaggtactccgggttgtatggcaccagcctaacctgcgtgcagacgaacgtgtcagatcatcaactactagtgtagtagtggttttgcgacaaattcacatcatgtgacgccattccagaaatcgtaagcgttgattgctactactacgacgctccaaccactacgttgactgattttttgacatatatgaaacagactgaattaattatctaatgaagaagatgtatgtatgtatgtatgtacatacagggtggctctgtccgagggagtgcttgatggcttccccggtggccttgttcaccagcgcgaacgccgggtagccttcctcgtccttgatgctcgtgctgtgcctcatgtccttcacccagtgctgcaaatcggatttgaacatgattagaatagttagacaagatcacgatggagttgatctatcggtgttaagaatttgagatggaattgtatgcaacggaaataacctggaagtcatccctgggattggttggtgcaaggcagacggcgccgttcctgacggtgaggctgtacgcctcgtcggccctgcacaggatgcgcacggtgggctccgacgccagcgcgcggggcagccggttgccgtaccctgcaccgggtggtccgaccggcggtggacggtagccgtagcccggctcatcgtggctcggtggcggctgcggcgggtagaacgcaggtgcggggtggtagccgtggccaggttcacggttgggcggcggcggcgggtatgcctggtgcccgtatgctggcggcggcggcggcgcgtacgcctcggggccccaggggaggatcttccagcactggttgtcgcccttgcaccactcccagagcacgacggtggtgccgtcgtgcacgccgccgtgggacttgtcgccgtggaaggcgtccaagttgaggtagatgttgttgaccatgcggatgcagcggaagccatggccgacgtccttgctctcggtccacagcaccgactcgtcctggtactctgggttgtacggcaccagcttcacctgcatcaggacaggagcgtcgatcgatcatgcatgtaaaacagttaagatggcgcgcgaagactgcatgcgtggatgaactaatggtgattgacatacggggtgggattggccgagcgagtgcttgacggcgaggccggtggcgcgattgacgagcgcgaacgccgggtggccctcctcgtccttcaccctcgtgctgtgccgcatgtccttgtaccagtgctgcatgccatggtccggattagagagaagctagtaattaagagatgagcacagagccacatagcatagcagaagaagaaaatattatggtggtggtgcctggcagtcgtcgcgggggttggttggcgcgaggacgacggcgtcgtggcggacggtaaggcagtacccctcgtcggcgcggcagaagatcttgaacgtcggctcgtgctggggaccagtcgccggaggctggtattggccgtggccgtgcccatggtggctgaacatgctagctagcttccaagggccggcgtctggttgtctcgctggtattcgatcgttgcaaatggcacctcccgggttatatagaacaaattaagctggaggccggccggcgagacgttcgttcgttgagaccgaggccgcgtacgtggtgccgatcgatgagaccacacccaccgtgtcgtgtcatgtcatcttctggagtacatagggcctgtttagttcgcgaaaagaaattttttagtgttacatcggatgtttgaccgaataacggaagggttttttggatacgaatgaaaaaactaatttcataactcgcctggaaaccgcgagacgaatcttttgagcctaattaacccgtcattaacttatgtgggttactgtagcacttatggctaatcatggactaattagacttaaaagatttgtctcgcgatttcctctctaactgtgcaattagtttttttatttatctatatttaatacttcatacatatgtctaaatattcaatgtgatattttttaggaaagaaaatttgagaaacttgtcgtttccgcagccaagtccccgttgcccccacggggtcaccgggtgggtagtctcttctctgtcaaggcaccggttaaatgatccacgacagacacctggcgtcacacctttcaactttcaactattacatgaccacaaaggatgttgattttgattcgtgaggggataaccctcgttgtcttgtctttatgtcagtcaaatggttataaaaaaatttgaaaagatatattaacatgtgatatatcactccgtaagttcaaatttaacttctatatcttgtaacggaaaaaacaaatttaattgtaaatatacgttaacaagctgcggtttaatttgttttttcgttatgagatatagatatgaatttgaacttgtaagcttgtggagtgttatatcacatattgatatatcttctcaaattttttcataacagttaagtaacatgcaaataggatatcccatgcagtgatcaaagatagtttccctgaccacaaattcattcgctccggcatcaaggaattctttgggtttgggcctgcacgcacacaagaggagagagacggggcccaggcaggtggtatttgggccattccccgtggtggtgtctcatccttgaataagttcactttaggtccctcaatttgttgtcgtgtctaaaattcatccctgaaacacaaaacgggtacaacgcatccctcaacctataaaaccgtgcaaacaaggtctctcagcagtattgtccttggttttggcctacgtggcttctttgactaggttttcatcccacatgacattgacgtggcgcttatgtggcaattcatctagaaaaataataaaatatgtggggtccacatgtcagtttcacacacaaacaaattaaaaaatggtggggcccatgtggccccacatgtcatcctcactactccctcttctctctatccctctcctctcttctctgtatcgtctctctctccagccggcggcgaccggagcggcgactcccggagcaagctggtagagcagggcgggcagcggccggaacgggtgattggtggggcggagcggcgacggacggagcaaaggggcaaagcggggcgggtggagcagagggcaaaggggccgcgggtggagcggcggggcagagcagggcgggagaagcggcagcgaacagcggagtggagcggattgtcgtcgtcatgtaactggcctaccaatgtgcccacaccgacgccagcggcatcatcctgctcctctaggatgacatttcaatgtctccgcaagagatgaaaaaatcccatctcatgaggacgtggagacgattaatttggcggcgacgagctcccgggcgagctcgtggacacaacactggtaccctcgcacgagctccacggcctccacctccgcctccccgagttgcacgcacagcgccacagccgcttcagctcggcgcgccaccgctcggactctagctccgaccacaacgccaccacctccgctctagctcggcgctccgccactacaggaccttcacctccccctcctccttcgcgcgccttcttccctctggcgacggcggcgatgctgacgaaaatggctagtgccatatatgaatcaatcgagcagcagctatgtcgagatggcataaaaaattggccacagcaaatcaaacttgctctgcttctgcttggtgattgattgcgggtagctgtatttaaggacgagttcgtggctgggaaggcgaccagttcagtgcacctgggacatgagcggttgcagccctgctcgtgcagcaccaccgccgtcgcccactgccgctccgcctactccagcagcgccaccttcccaccccgtgctcccacgtcgctgccggagcaacgcgtggagtggtctccttcgacgacgccggaaaatggatggtgctcgccggcgaccgctcgagctcctcctccggccacctcgaggaggcgaggggggtggctgctctcgctctagccggctgctggaggcgaccgctcagcgacatggccggatgggcgatggccccaccctcttttattattttgtgtgtaattgatatgtgggtcccacagtttttaaaattattttttatccgattgccacgtaagcgccacctgggacgagacctagtcataccaaccatgtaggcgccacgtcatctcaaaccgggcacaatactaccaacggacctcgtctgcacagttttggtaagttgggggatgcgatgtatctggttttgtagacggaggatgaaaatcagactgggcgacgaattaagagacctaaagtgaacttattcctctcatcctccatccccgctgcttccggcggctgccgccattccatctcccacttccccgtccattgccatcaatcctcacgccaagctagctatagctacgatggaacgcccttccactcccgactccggttgggtcatcctcagcaccatcgccgtcgccggccgccgccacagcaataatggtagcaccgccattaattggcaccaccaggaacggaaacaccatcgatcgaggtatgtatccctctagatctctcgcccacccaccaccaaatccctccatcgtcttcgtgcacagctccgacatgaaccccgccctgttcccgaccatcgtctgcgaggccggcgacgccctcctcccctctgtcaacgtgcggtccgaaccctactgtcgctccgacgaccgcgcgactacttcgtataccgcatgccgacgcggcgacgcctgcccgtaggaagcctgatcgtctattgggcctagaacctacaactccgtattgggcctatgcttgacaactccctattaggccctcctacgcataacccgagcccatctaagggctcatttagacttttagagcccaacacaagcatcggacgtgacaatggaataagttcacttagtgaccctcaaaagtgatcgaaatctaatccatgaccctaaaccacaaaaccggatatctcgaccccccaaatcttaaaaccggtgcaatttgactcccttagcggttttagagggtggttttgctgacgtggcgcctatgtggcggtattgaccgggtctcctttacacgtggcgttgaggtggcatttacaattaaaaaatatgtgtgggacccatttgtcattgacagaaaagaaattgtgggacccacgtgtcccatctctctctcccctccctcctcgccgctccctctctcccgcggcgggcagagatggcaacgatcggcggacgcgcgggcgtggcgcggcggcctgcgagcggcggagacgcgtgagtggcagcgccaggcactggaacggcaacggcggtggcaatttccctcttggtttgggccctcctctccctaggaggcccagacttgaattgaacacaagtttagcagcaccaacacttgtacggaataaactcctctcatcctcagcaacaatacgggaatctaaattactttcgcagtataattctcgtattgctcttttgattactgtcgaagcacggcccaggagtgaacacctccagcgcagagccccgtagccatcgagattgcagtaactaacagtgctactttgcctttgctgaaactgacagggacagtttaactcttctgtccgtccaatggtaaaaactagagagagatacgtgaggtaaaactctactgcctgggtatgataagtacattgagaggtaaagtgccgtgcgaatttaaccgacctggacccgaatatactgccctgaaagcctgaacctgcagtgaaatggttggtctttgaccattccaacggggtcctatcttcagaagtcacccgtaacattggtgatcgacaatcaacttttagtattttcgtcatcggtgacgtggtggttgctgctgacgaaagcttttacttttgataagtatgatgagtacagtaaataagcaagcttaacaaaaacgctgactgttaataagttgaaaatcttcagacttgagtttcagtctctcagactgcatctttgcctcttcctgaaaaagtatgtttccagtaaatctattcctcctttatatgtgctctatccataatccatccaatccgtccttttcaatctacagccgcctagcctagattatactagattatagtacttggaaacaacttctttgctaatttaagaacagaagatgaaagtttgccgttagactgcatgcatgctccattgatattacacctacttcagccaagaagtaacacatccatgcaatttccatttcccagatcagagccagaatctattgcatttgatatcttctacaatcctgtatactagtagtatatcaattggctacagtaaagtattattgttctgtatatctagtaatctttaattgtacaacattccctctctacggtgtaaagtactatcaaggctccagcttgcttttgcactgtgcctgaaatgaatacgtaggagaaaaaatcgcatacaaatgcctaattgttcaatactacaataattctataccgtaccccaatcatcatcgtcgtccatgcttccatccgatcttaatatcgtcggcaagattgttcatgccagtacgtagcatccgtaaattcgatcgactgcgtttgatcgatttccatggccattaattaagctagttaagaatatattcagaatagctgaggaggaagcatctggtggttgagtccggcgaggactgacgacggcgtcgcttgcaagccgcccaccacggactgcggcgccacgtcgaagcatgagccgttgagcctcttcgccggcgtgtggccgccgccggcgtagtctccggccgggctcgccttgcgcttgccgccggcaacggtggccgtggacgccgtcgacgggtagcactccgcgaggaagttgtcgccgacgccgaggagctggttcagggaggggtggacggcgagggcatgctgatggtggtcggccggcgggtcggcggcggcgtcgaagatctgggcgagcgcgtgctcgtcgaagagctcggagatggaggggatcttggggagcttggggatgagcgtggtgctgatcatcggcggcgcgtagaagctgtaggcgtcgtcaaggactccggacggctcgtcgtggtcgtagtcggcggcgagcggcggcatcatcggcgacgcctggccggacttcttgtagatccggcagagcacccagtcgtccagctgcacgtaattaagcagatggatcgatgagcacaaaaatgtcatgcctatcattgtcaaaagctacatactttaaatcgataataaccacacatgcatgcatggcgccaggacaaggctaatggatatctctattcttctctcggtataattattatactctgaaattaaattaaattaacagcaagtgaaaagagaaaggagtatctctcttggtacgtaccatccacggtttcatgatgtggtactaacagtagcgagtgaattaatgattgagtgatgctagtagttcattaaaaaaaagttaataagcgtacgtcagtccaatcatctgattaaattacaatatcctagaagaagagtacagtagttcaattagtagtggtgcaacaggatgagagcacgcaagtggcatgaggagatggatggatatgcagttagtagttaagctcagagatggtggtcatggcgaattggcgatggcgtatgagtaggtacataccctcatggagacgttgcggaatcgggaggaggaggagggcttgtaggtgtttgcggcggcggcgagagggtcggcggcgaggcggtactcgtgcatgatccagctggtcttggtgcccttgggagggcggccgcggtagaagacgagggccttcttgacgccgacgctctcgccggtggcgctgtcgtggatgggcttgtcggttcccgtcgccttccagtaccccgacccggcggcgcggttcggccggattccgttggggtacttgcggtctcgcgggctgaagaaataccactcactctccccgtacaccgccttcgctgcaattaattaaccagtagcaattgaccgaacgaccaactcaatcgatccatcgatatgatcgaggaagaaggcttacatggcaggtcccatggatcgaacttgtagatgtcgacgtcggcgatgatggggacggggcactgcccggcggtggcgcggctgcggaggtagtgcaggatcagctcctcgtccgtcgggtggaaccggaaccccggcggcagcgacgtcgccgccgacgacatcgtcatctccatcgacgatctaatacggttactgctttaattagcttgtaattggctacctatagctcgatcaatcgattgatcgaatcaaagcgagtgctcatcgatcgatcgatcctccggagcagcggagggaagggccacttatatgcacgagcgaccttgtcagttagcgtgacgtggcgcggagtggcaaatgtttgtaattcttcggggtcaccaggggtagaatcggaaggccaatcgggtgattcgttattcctcgcgtccggcatgactcggcatgggctcgtgcgtggtcgtctatggcgtcagcaatgttgcaacgcatatgctcatgctcatccgtctccagctgcaactaactatatctatctatctatatctaactagttaagctaagctaagctatctctagccgtcctcactgctcatcaatctcatgtgatatctcgcatacagtttcatcgatcgttatcagctacagggaatcgatcgatcatatatagggcagatatacactcctatcatatcatatacttcatctgtcccataaatataggacagatatacactactatcatatcatatactccatccgtcccataaaatacaaactaaaactaaacgtgacacatcctagtataacgaaatctgaacataagtatatctagattcgtatgactagaatgtattacatatactacatccaatactagattggtcttttataagactggagaaatatgtagatagatactcctatgtagctttttaatatataatagcattgactttttaaagatacatttaatcattcattttatttgttttaaaaaattatgaacttattatttatttattttatcgcgacttgatttatcgttatatgttcgttaagcataacttatttttttatatatttacaaaaaaaataaataagatgaatagacaaacgcttatcaaaaagtgaacggtgtcatatattaaaaaatgatgtagtagatgatacgcgtgattatgtcaaaggtaagaaacagaattttactaatctgctcttttttttggaaaaaaaaggaaaacattattcgtgtgtaagtatataatatccgtgtgcattacaatttaaatctcataggtgaattgcacacggatattgataaatcatgaatccacaatatgagatttaatcgtaccaccggtacttttcggtaaataattcatcatttcaataaatatcagtgccaattaaagcatattcttgggtgctctctaaagaaacttattgtttatttaaataggagcatgagaagaccaattatttgtggagtacgtcacatcctgcacgtggagctatttagctgcagtggccggcgctagctagttgtagacgatgaattggatcagtcggctcacatggctagtcattatcgatcgaaaggccagaaatctctgaatagtactgaagtagacattcacacatccattgattattcccagagaaattacaactgtttggctctttgctacaatactctctccgttttctaaatatttaacaccgttgactttttaacacatgttcgatcattcgttttattcaaaaacttttgtgaaatatgtaaaactatatgtatatatataagtatatttaacaataaatcaaatgataggaaaagaattaataattacttaaattttttgaataagatgaatgagtaaatatattttaaaaagtcagcggcgtcaaatatttagaaacggaaggagtactatattgtgtgtggggctccatttcaactataattgaaccatacacagtttcggtgtacgttattattggatcatcatatctaacagattaacatccattattcatgcaccgaaactgcaatctttgtctcttcaagaggtttgcctcggcggtacaccgaagcaagctagctatatatataaaatcaggattatcctcgctcaattatgccttggaaaaactcagaaatgacactacagtaagtatgttaattgggatgatttccacttcacctgtttaactggaatggccaccaatgcacatgtttggagcatacttttatgatcggagaaaatttaattaataccatcgctaatatgtgtgagttgtaaatcaccgcaaaggatactattagctacacaagtcataggagagccactgtagaaggaaaaaaatatgatgagaaactaattccttttttttaagataattgtcgcgccccgaactagtcccgaccggaactagtccgtgacgctccaaattaacctgttaatcgataccagtcctaggaaacagtgctggtatcacagggagacagaatatcacagcaacagaggtctctttattatagagtagatgtacagtcatgctgggctgcggacagatcccgagctcacaactgcattacaaaaggaaagcggaagccaggacttggaccaatcaacacaggcgcgacttgggaactaggccgaaaccctaaaactcatcatagccggcttgctcctggaagaactcctcatcagcaggatccgcttcatcttcttcagcaactgggggggattatttatatagagcaagggtgagtacgggagtactcagcaagccatgggaaataagtgtttaatgcaggcttcaaggaaaggctggtgtttttgcaattaattttaattgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgtagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgtcgacgagaggggtcccagaccaacaacaggttaggtcccagaccatactgtgccaggaagcccaggggtcctccccgacaccaccccggcaaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtattttgtaaaactccagttttacccaagttgttactcagattttaagtttgagggcaaccgtcgatactggcacagggtgcacgaatatcgaggcgcaactggatggttacaaggggacatggtatagcaattaacaatggaagaatcaaatgcaacaagttaggtaggtctaccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgaactctaagcgtgccattagatagatctcgagatttgagaaattttggaatttgaacggagtcaaacggatttacggttgggaagatattgaatttctaagattattggatttttggtctaaaggaaaaggatttaattaaatcccttttttttggaaaagaaaaagaaaagaaaaggggagagggagggaatatagacttccctcgggcggctagggcgcggcccgagaaaaagggcggctcggccgagcttaacgggctggccggcccaagaaggcggcccacagcggcccaagacgcgcgcgcgggggagggaggagagagagccggtggaccgggctcaccatgcgcggtcccgggtgggacccgcttgtcagcggctcggctcaccgtgcggagggagtacgcggctcatgcgcgcgggcgggggagggacgcggtgcacgcgcgcggttcgcggtggacgcggatgcagcgggcccacgcgcagcctcacggctcgcggtggaacgcgcgcacggggagggactgaccggggttggctcgacccggtctaggctgagctggcgccgacgtggcgcctacgtggctgccacgcgggccggcgggaggtagacgaagacccggccacgaatggacggcgggcggcagcggcgagcggcggagcgaaccacggcgatacgggcaaaagctagcacaccgggcggttgctcgtgatgaggggagacgagccaacggctcggatttgccggaggaagcttgacggcggcgaatcacggcggcgacaaccggcggggagggaagagggaaacggcggcgaggccacgaggggtcgattcccggcggtgagagcatctacgcggtttcgggaactcgatgctagcgtcggattggacggagctacaccgagcgaggctggcgacgtgcgggtgctacggagctcgagcggtgacggcggcgagcacgcggcgagcgacggcaacggtcggggcggcgccggctaactacggggagtctactcgagctactaccgaaagctagggggaggagatggagcgaggaggaagaacggagggaggcactaccatgcgggtcggggcgctgtgacaagaggccgacggcgcgggagtaatctctccggcctcgggccggggaagaggaaggagagggcgcggccgaagtcctcttccgcgtccttgctcgtgccggctcctccgacacgcgcaacaacgaacggcgacggcgaacagagcacgggggcggcggcaatggcgcggagacgaaagggagaggaaaggaagggagggaggctggggtttaaatgggcggcaatgtcggtttgggaaccgacttgcgcggtcaagggcgcgagctagcgctcggcggtcgcggccaaagcggcgacaggtaggatgacgccggcgggggaaaaggggaaaaaggagagggagaaaggggcttgcccttttgccgattcgggaaaaaggaggaggggagcgggggcgacgcggcagagggaggagggacgctgcctccgtcccttggcggcttgcgcgcggagtggcgggggccgggcggtgacgacggcgatgacggcgggcggtttggagctgcgcgacgacacgggcgacagacgcggcagggcagcggggccggacggcaaccacgcggacggcgcagacgaccacgcgggcgcgcgcgcgaaccacggcgcgcgggggctggctttgcgagcgggaagctcgccagggatggggagaaggggagcgaggggagggggcgctcggcgcgggcgactcccgtgcacgcgcgcgcggcgcgcgggcggaacggagggagagggggagagggagcgcaccggggaggggagagggcgagagagagagaaagagatagagagagagagagagagagagagagagagagagagagagagagagagagcgcccgggagagggagggccgggggagagggggagatg

SEQ ID NO: 73407 - DNA, 7005 bp, Oryza sativa
cccccagggggagatgggccgggaggaaatcggcccatcgacccccgggggaggcaaaatagacttttgcggaggaatttgatttggaaggattggattcggaattggactcgacgatagatcggggattgagatcttgagatggcacgaacactagacaacaagcaaagaaacaaatttcgcaattagggtttttaagagataatttttccgctaggcgccacgacggaacgggcgctacaataatagaataaaacatcccggcctttgctcatcagagctatagccaattattataaaagtaacacccaaacactgagtgtagttcaaatgaattaaacacacccaacgaaataaaagatcaaactaagataaggagagcacatttattcaagtctatctgtgaatcttcatccatagtttgcaaggagttgcatgaccgttgtctcaagcctacgacatgcaaccttcataagctctcgatcatcttcacacatttgcagctgtgcccaaaatcggagccaatatgttgccctgaaaatcacctgcatatatgagatagatggtgatttgtcaaaaaccatatcattcctagtcaaccgcagagaccaacatatggcagaagctcctacaagtatgagtttactcttcttcttgtctacccccaagagccaaccatcaaacatattagatatggtagtaggaaggtataaaccaagagagaactgtactgctctccaaacaaattttgcataatgacactctataaaaagatgttgcatagtctcatttttcatacaaaaacaaaatcttaaattgccattccaatttcgtcttgccaaattatccttggttagcacaacccctttaaacaagtaccacataaaaatcttaatcttaagtggcatcttaagcttccaaataatcttgtttatctcaatataaccattattagttaaagctagatacatcgacctaatagaaaatattccattctgatgataattctatctaaagctatcagaggattgattcaattgaatatgtacaatataagcacacaattcatgccaatatgcaagattctgaccaactaatgatctcctaaaggaaacattgagtggaacagatctcataacattagcaatagtagaacttttccttcggacaatagagtataaagatggatatttgtctttaaaagccaagtttcctagccatttatctttccagaaccttatttgtttcccattatttataatccaagaacccatatctaggtatctttgaccttcatgagacctgacaaaaatgagaatcgccttgtttcttattaacttgggtcatagactaataaattattccgatattacaaagttactaaagtataagcttgttgttcttcttcctcctcccataaagttcttaacatggaagaacgtagaagtcaaagacaaacatctaagtcatatacaagactttaaatccgtggcatctcactatatcatattttttttaccaccaacaaccaccgccgggtcatcacaacttatccttcacttcacctatccaactattgttgtcgatgttcgtcctaccaatgatttgttgttagttcttaggattgcttagctcatagttttgtgtgggaacagagcacatcatccactaagacaatagtgaaaatgctgatgctcttgtggcaccagtggcaggagaagaggctttagggaagcggccatggccacaatggttattgaggttgtcatataactttatggaaaaactgtcatccataactgactttcctctattacttaaataatgaagttgttctccttcctgttctcccaccatccatgagcggttggatcttgattcgaactcccaacctatcatcagccacatatgagcccatacaacacgcccaaaccaatcgtgcgtgcttattggtatgcaagatatgttactagtcaaaataaaaggcgaaacatcctatttagatcatctttttcgatgtccctccttactctactattttgttcccctagtaggttaggcctacatgttagttactacttacccatgttttgggtttggacctaggacaattatagactttattgagcttggttgaaattaagaagggttaatttgttaagttcgaataattatatatcaaattttgaagaaaacttgtacgaatttgaacctctctcatcgccatgacaccgagaaaataaatatgattttttttcttcgtctaaatgtaaactttcagatggaagtgtgtgaaataagtgtgcatgcactcatttcaaaacagctctggtttggaacggagtggtatatactccactaactgtttgaagttaggttgccatccattttattgagggaatattaattgtcatcaagcggtactacgtgtgaacttaatcggaacgtggtcgtggtctgaccaaaattagctgagatttaagtcaagcagacacgtgcactgcagtttgagatcagctgcgtcttcagaacaccaaacacgcgtacgtgacaattggcaaccctttcgttcatattcatcgatctttcaaagactcaaacgtaggattataagccaaccaattaacgatcaatatatggtactccctccgttctaaatatgctactttgaccaacagtattcaaaaaagatgttttaaataaaaagagttgaatattatgatagtttatttaataataaatctagtaaaaaatgttaaaaaaatgttagacttgtcactattctaaaaatacttatattttgtgacggagggagtaagatctatttgattcagcacacgaaaccccgaaatgcagcgattaattaattagttgacaaaaaagataaagattaaaagaagatgaaacaagtcacggaggtgatttgaaaacaagggcatagtagtactattgtgtgtgtgtgtatagtaatagcgggtgttcacaaaacgagtgaaacataattaattaatccaagtaagtacacaaaagaccatggatcgatatgatgtagattgcatcaacgaggaacaacctgtactttggccatagataagatagaaacggcgcgaactgaactaactaattcagcatgcatcaagttaacagcgacacactaagctatagctagctagctcgtcatcgatccgtccggccggggcggcgagaatctctgataggtcgtcggatcagccaggtgcatgcacgaacgcaatggccgtcgccgtcgcgaagaagcccttgcgcgcattggctggggttttaaacttttggcgcggcgtgcagtggttaaattagtcgtagcacgcctcgccttgtccctctcgtcgccacacgcgtcgccgtgcgcgcgccgccacctgtagctgtagctctgtacatatgcatctcatccatcgcttaattacatcgacctgcaactactggcacacatgtgtacagctctcgctcatgtcatgcctcctctcgacgacgacgacggagacggcgatctctctaggtaattaagctagctaagctcatcctttatttggagtacggagtactccactatctactagcttgccaaaacctgacaccgatgtggatgacggcaattactaattgtgatcatcagcaaaagctagctaagctcaagtggatcaaagcagcaactgtggccttatctgatccattattgatatatatcaagtgctggagtatgtgagttgcatgccttttttttcctagccttttattcctttcaaacgtcatccatttatatatgtatttgtatacagagatgctgtgcatatatcgatcggaataataataagaagaagaggataacaaaaataacttcactttttcagtcaattaggtagaagcccatgctgctgattgccgcgccatacatatatatatgatgggacgagagagctagctaggcaaaagaaaatggatacatagatacatatatatataatcgatgctagctgctactgctgagatggatgagaataaattaaaggggtcattcgatgtggatatatggcggcgcagatgtatatattactccgcatattacatgatctagaaaaccggtcgaattaatgacttaatgtgacgacgacgacgaccacacaatctcctgcatactggtagctgatagtagctagctaacctagtgctagcatctcttgaccattaattccgattttctttaatttgctggtttcatcagctagcagccacacgaattggtgaaataaaaaaataattatcgatgattaatttgtctcgattgattactgaattcaacaacatgacctggcgtatcagctagaacctagcttgaaaatgattggaccggatcgagatctacagtatacagataacagatactgcaaaactgaatcacaagtacactagccattagtactaatgatgagaagtacctacgtacttcggccagtttgtcttgcatgcgtggagcggatctatagtataaggaccgatgactctcgataaaatctagtggcggagccagaaattatataacactggtagagaaaggggctttactcccggttagaaacccccctatagtcccggttatacaaccgggagtacgaatccgggactaaagatacccatctttagtcccgggtgaaataaccgggactaaaaatccatctttattcccggttggtattaccaaccgggactaaaaatggtggagcagtcccggttgattctttttttttttttgttgttgtttcattgctcaatcgatttgctccctaaatatcccaaatcatccacaagcatcacagatttgggaagaaatacatcacatattgcaaagaaatgcatcacagatcacaaatacatcacatcaccaaatctcaaacgaaaaatacatcacaaatcctaaaagaaatgcatcacaactcaaatacatcccagatcagatccaatatcacatacatcacagatcaaatccaatgaaacacaaaatcaaaaaaaaaaatcggcagcagatgggagggcgccgccggcctcccggtccccgtcctctcggcgtctgcgccagctcggccgccacgcccgcccgccgccgcggctcctgccgggcgccgctgctaccgcccggcttgccgccaggcccgcccgcccggccgccgccacggctcccgcccggcttgccgccgcgcccgcccgcccggccaccgccgccgctcgcgtcgggcgccgccgctcctgcctggtgccgccgctaccgcccggccggccgccgctccagatcgaggggaaggggaggaacggcaggggaagtggagaggaaggggatgaaggggagaggaagagggggtgaaggagatattaatgagaggggaggagatcgagaggagatcgcgcgcggctctcgggatagtctttgctcccggttggtataaacaaccgggactaaagatctatttttagtcccggttatttataccaaccgggagtaaaaataatggggatctgtctggaacccgacaactttttgaaccgggactaaaaatgatctttagtcccggttggtaacacaccaaccgggattaaagataaaaaagtacacctcaacttttcaaccgggactaaagatgctttttagtcccggtttttattagaactgggactattgtggaatttggccaaccgaccaaagatggtttctccaccagtgtaagactagagctaagttagggctcgattaatggagtattagttttctaaaaaaattacatggtgaatcaacaaaatttaagcaagtttttggaggcaggcctagggctcaagccctagctgcactaggcctgcctccgcccctgataaaatctatagcaaaattgtttatctatatattataacatcataatctaagtataattaacatattataacaacgatagacacactttaacaccaacaaatcgattttctgaatcggccatgcgtcgtccttaattgggtcgttgagtttggaaggaataagtgaccacgcatgaatacgcatacagtacctaccaactactagtagctaactttcactctccatgtacatatttcttcttttcggccactgaatattgaagctgtagtacgcagcatctgtacacacgcgcccgtgcatgcagaaatcgacttgcattgggtcaaaggaagtaagtaaggttggagccggccaatggtgtaagctagcttggagaaagagagaagctgcataacgactgcaattcgattgatcaggacaattaagcagttagctaattaagctaccagcagtacgtagctaattcgatcgaagaagaaggagacatgcatatataggagatgcagattaaggaggagcacacgtacgtacgggcccctgcttaattaattgtatgtgtgattatacattactacattaattatattcgtgcgtacgtgcgtacgcgcgtgtggtacgtacgtggccttcttctccccacgtgcaagcaagtccggtacatgcatgcttcctaccctcctatcgatctctccttgccccttatcgtacggctcctccctgctcgatcgaatatactctgaagaaatgcatagcgactagcgatcgagagtttatgtaggacgatcgacctgtttggttgtctgaagaaatagggaaaatattttaaactttcgaagaaatgtcctctctcattgtttgtatgtcactcgaatagttatgaaaaactttgagagaaaatattaacaatattgatcgatcaaaaaggaaattcagaaccatcgatcaatcagctgatgagagaaattaatattgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 73408 - DNA, 10877 bp, Oryza sativa
gggctgacaatggggcccacttgccagttgacggaatagaaaagcagctagaaagaaaagtggtgttttgttttgtgaaattaaatgcctctgaaccagtagtttaccattaaaactaaaaatattactatctccgttttttaatagatgacgccttgactttttcttacatgtttgacctttcgtcttattcaaaaattttatgcaaatgtataagatataaatcacacttaaagtaatatgagtgataaaacaacccataacaaaataaattataattacgtaaattttttgaataagacgaacggtcaacagccttatcggatggcctaataagccaaagaaaaagccaaatttaaaattttcaagcttaattttaagattgattttaacatattttcaacgtagttttttttcaacgttggcttttaagtcacaaataacacatttataaaagttttatccataaattcatttttattttctaataagccattttgccttattaggaaataagccaaacgatggggacccaaacatgtgagaaaaagttaacggcgtcatctattaaaaaatggagggagtacgtagtataacttaccaaaagtttatctcctggagtaacttttatgcataagagattacattgctggcatgaacatcacttgcacgttggaactaatctccaatacacataaaacagagtagctcattagcatacaattaattaactattaggtattttttaaaaaaaataaattaatatgattttttaaagcaactttcctataatttttttaaaaaaaatacaccgcttagccgtttgaacagtgtgcacgcgtaaaaagaaagaggtgagttgggaacctcaacttagccttaattatattgggagtacatatattggcatttaataaagtaggaatattctaatgtttttgttttttattggaatgtgtgcggtggatttaaaaataaacttattttgtgatagaggtagtaggccttttctttatgctggaatggatatatataataaacattacatgcacaatgtacgggatgtttaatccactggaaatcatggtggacaacatgtcttaactcaagacatcaagatgtcatgtactacccacttttcagaatagtttgataatgaatgtacaggtaacaaataaaatgtttttttctacagtttgtacgtgtttagcttataaatagccagaaatgaaaagcaagtttgaagaatatatactaacgtgagcctctcatgccgtgtgataagattcaagtagagtactacaaacaaacttatccatctcaagaaaaaaatatatcattcatgttatagctttggatggcatcatgttttcatgtgatgatcaattttccttatcaacacagttctgacaactacccagggcttgggaggcatatgggatctacatacaaccctgatccgaaatactcggggcacatagttatagctcggttacgatgacgcgattgaatgttatgagatgtttagaacaccgctggaataatctttctgtacagctccaagcattggcaccgattctacaatttatgatgcttccaacgtacttttctccagtgttttatttgatgtgccaaatttgagctgatgtaggattacaatgtccgcctttcaccaaataaggtagttttgcatcgtctctatagcctgttagggcatcggttaccgcaagggacatgatgcatagttgcggatgcagagaacactgcaaaggctgtgttcggtggtgggtgttagaaacccatcatccacgcacgaaaaaggagcggtccattagcacgtgattaattaagtattagctaattttttttcaaaaatagatcaatatgatttttttaaacaactttcgtatataaactttttgcaaaaacacaccgtttaaaagtttgaaaagcgtgcgtgcgaaaaatgagagggggagatgggggaaatttaactatttgccactcttgtgacctggcaattaataatttgccacatcctgtcaatgacatgtgggccctcatgtgtctatgatatgtgggcctagtggcaaatcgttaagcaacatccgtaagagtggcaaatagttaaaatccccagagttgggaactcccggtaccgaacacagccaaaatgtgcacaataacaaactacaatgttgctttgaatctgtgtgataaccttttctttaacactagcgaaacacctgtacgttgcaacaaggtataatgatattagatgatctaattaagactaaaccatcactcttggactctaattaactaagagtgaattaaaataaataaatagattattcggtaagtgtgttctacatgaaacaaattgagattccaacatagtactaccaccgcatggccactgccatattggtcaacaagaggtgactgatctatggtccccatttatctacgtccatcaccattgcctttttttttaagattgtatagatatagattagtagaacgtattggcatcagtcgacgctgagagttaaaacaacaaaatttgggcatgaatttgccatggttatccgtatggcaaaacctagttactttcatgaaaaacaatcatggcttagataatactggcaggatttcaaagtacaggctattttggtttgatgccaaaatgtgccctgttaaattgatggcattttgaatagtagtttggctagtgcttagtttgctaccaaaatatgccaataaaacacataagttgccaaaacatttggcactaccaaaatttacctatggtttagcattgataatattttagcatggtagcaaaccaaacaagctctacatgttgcaacatgcaaagtatggtgcaccaatgagacataaaatgcacatctcgcaataaagtacatggatttatgatatattctagtagaagcacttatacagcacttataaagtcaataacacatggcccatttattcaagcacagggacctcaggcattcctgctcactcgtgatccaaagttggtgtgaaactgtcctgggtgattgtattatttacagctgataagttgaagatgtaaagattgaatatttcagatataggacccggtgttaaatgtgtcacggtttattcatctttaagagaaatcaggggtatgtggaagaaccatatacatatgacttgtgaacatgtctatctctgtatgaggctgcacagatagagacagagataagttgccattcatgcatctttagcaagcacgccaggttgcttcatttgtcaaatttcaagcaagaagtttgctcaaagttttaggattgacaggcgtcagtaatagcggtaatcagcttagtttggtcggccactatattttctggacgaatctgggggaaaatcgattcatctgaactcatccccctataccctggttttgtatggggagaagacatcctaggatcatccgataatcacagaagactagtatagtagccaatttcaccatggctgagaaacattgctgcaaaggaaggttttcttggtccataaaaatttgatcaggactttgaaatgtaagacattcagaaccaaaatgggcaaaactttctacagtatctagacaatatatacttggcaatgaatgcataagcaaacaaaccagtattgggcgcaaggataccatagtattcgagcaatcggaagcaatcgggtaccttattcttaataaggtaggcaatttggctaagggaggttcgcccaataacctgagcgtttggatttgctacgatggtgttcccgaaacgagtttacattggtgacctgcactctgatggtatctctgtgcaattgcctgactatccatccagctttccttctagtacactgttgacaagagcaagttgatggagacatcgatcattttagtgccacaaaatatctgaaaagaacaaacactatcattttagtgccacaagtccacaatacatgaaaagaaccgacacaatcgttttagtgccataaaacatctcaaaagaaccaagaacaaagtaaggaaaacaagattggcatgctgatgaataccttctcaatatttggattaaaacaaactgtaattagagtgtggatatacgggtataggaagacttctctaaaatatgtataaaccagcaaagcaaggtaacaatgaattgttataggtcatggttccattgttgcttcacaaacatcctcctaaactctttcagctcacaagaaaatgtgctgcaattcaatttgcaaaatacattacatgaaactgtcccaccattcaacgcaatggcctttaatgtaggaagtagttatatggactggtttagatgcctgaatcagtacttttggtagctccaagaacatatgttgcaactcgcaatgcaattagcaaacacgtgatcagaatatctgatataccacaagtacctcaggaattccacattcctatgtcctttatgtacaatactgtgtggatttcatgtccaactgtaagcttgttctaatctgcactcaacatgcaatggatgtgcatgcgttgcaggaatttaaaaagggtttgtttacttctgtcatattgtattgtaacacagtgatctgttcatcatctacatggctgaaccaaaactatctcccttcacatgttattacgattttgttctagtttataagggaagaaaaggattttacacaaagaaacatggcataagaaaacagaggtacttgcatattacccaaaataactcattatacatgctcagcggaaaatgtttctgaagaatctgaattaagcagcctttctgcttcgtcattagcctcagcttgtatacgccattgctaaataagtattagaagcaactgttagtccttacgaaacattttctgttgaatgtaagctgatgaacataggatatacttgcctcttcaagactatcaatctccattagttgctgtatttgttctgatatcctttcctggaatcaggacactgattattagtaatcatacttcatccacatgatgcataaataggatagctaaataacttgaacttactgcactacttgctgcttcagcaacaataacatctgagtccatctcaacttcaatttcaatcatagaacacaactgcagtggcatatccaacatttcactatttagctataataaacgtgagttatacataccatatataaaatttgctctattacttttgcataactttccatcagctcaatctttgccaggagtgtactttccaagctttcaagtaccctcttcactctacctcgacgagcactggaaataagtttgatcaaaacttcattattttcaaaaagaaaaaaactctgtagtagaacaagttctaacaaacaaccatgttatataagtatatttgtgaatagataaagttaaactagaacaataaaataaactgttggaactgtatgaaattaccgatatgatggttcacctactgctaatatcttgttctctagttgagacattcttgccagcatccacacctttgaaaataaatttaggagtttaggagttcatgattttcaggactttacttttagcagaaaataaactaattagagattacagattttaacctccttttcggaaagttgtttcagatcctttagacgagtctgaagcatgtcgtactgagataaaagttgctgccgaacagcaattatatctactgtcttttgtggaagctgaaaataacatcgaatttaggtcagagagaatataatggacaacgtagcttctaaccaaaaactactaataagataataagatattgtctaaaatatgaatatttggatatataaaaaattgagtaaacatgtgaaaaaaatacttttataaaatgcacaatgataaaattttgtggtcaaagtgcatcttgttggctttgcaaatttgaaaatagcatgtccttttaactatggaagtataaggcactaggtttctctaaaaaagtactgataaaaaaatatttttgaaattatagtccctcttatccaatatataagacattttagatttctcaactcttaccaaaaatattttttaggaacctttgtctcttttcttcctgatttgccattgctatataaatgctagtactctcatcaatattttttgtagataatggatagaaatccagcctctatatccacaattggatatacacagccaagtctttccattgggagtatgattgaagagaaacaaagtaaattagatactctagctatgtaatggcatgccatagggtaagcttgatcgaacaaggaagcaaaacagagcaggctatagacagttgcttgcatgatctattgttggtacaagactccagcaccatacgttggtattacatgaccctattagcattccgactacctgcccatagttttcaagtttcctcctagtgaagaatgctaatccttgagtttacttacctttcgaatctctggcaggatcacttgatttagtgctgttccaacagcagctgatgcaaaagcagttgctgtaataaatctagggaggcttgggtcgatgaatgcagaagcagcatctccagaggcaagaagagcaagagcaccgaccaacaaatatggattaaagacgaatggtccctcgttctttgatggagctcttagcaatcttgagacttgtctgttgatgtgattggtgagagacatgggttctcctggtctaaacccttgtgagcgtgcagaaatcttaaggggacccatttcacgataaacatttgatggggcagccaaggaaatggtcactctttctccttcttgagcaggcagttctacagtctgcgtagcaaatctatgggtacgggctgttcctgaaggtgtgcgaatctgcaaaataaataacttacaatttacatgaatatggctcatgttctgaacaacattgtcaacagattataagaactgtgtgatatcacaaaaaatagattcagctgaatttcgtcgtggaatgttttgttggagcactctagaggaaaatttggatagccaatccctggcccaactatcttaaggggggagtgagaaatgacagagaaatgttggtgatcaaatttagcattaatggattgaacgatatttggaaagaaacacatgaagaattctcgatgactgtttggtcctaagtcaacagttgccaaatattcaaactaaaatgtgaatgtgttgacctcagttagcaagtgttcgacttgttcccagaattttggcaaaatactatacatgctgctaatgtggggccaaggttcaaaccaaacatgtgataacgcttggtcatttttggagttttccacagattttgtgaaaatatatcatgtttactttcaaaaaacttctatgaaaaaacacttctgcctcacatggtgcatggggaagcatcttcttggttgccaagacctgaagcatcatactcttaaactctgggaaatttggaaaaagtacaacaaaagatttttttaaggaaggcagctgtaatcacatatggatacactgcttggcgtgatggcatctggtagtgcaagaataacctctaagatgataaacatgtccatgtgtgtaattcccttctaccattgatgaacaagcagttatcctacttgtcataaagaggaacatttttttacctcaattgttgaacagaaaacagggagagttttacctttcagttctattatatggagtacatctagtttaatgtgaggcatcttcatatcttgatatccatcaagagcaacgatgatttattcaaaaatttgaaaagtaaagatctttgaaataaatgatggcacagttaagatctattgtgcggtttttgaaagggaaactaccacaatagagtgcacagcagctggaagaccgtcttttatcacatttataaatcgcaatgccttgtccaaagctgaaatgtccatgctgcgttcggcaggaggagatccttagagaagtaatattagaagcagtgtcatatatggaaccattgagaaagtaatagaggtgtgcaaaaatatcttctgatataacagatgaaaacaatatcaatcaagttacttcagataaactacaaaatagtacaaagttgcataatcattggaatgtaataaaccatttctgtgagagagttatacagaaggacaatgtgtacctatcaaacactaaaataaattatgtataaatctttttgacatcacagaaacccaataatctgcagagtaatacctaagcactcaggataagcagttcatagacctatataatagccaatcgtaccactggatctaaaggaaacattagaaagtataagtcgaacgatgagatcacagacatggctaattagtcaaagctaactgatatatcaattattttaattgttctaatgtttactttttagatgtcactccctccatcccattttaagtgcagttatggatttccatgtccaacgtttgattgtttgtcttatctgaaattttttttatgattagtatttttgttgttattagatgataaaatatgaatagtactttatgcgtgacttatttttattttttttataagacgggctgtcaaatgttggacacggaaactcacaactgcacttaaaatggaacggagggagtatcttctaagttctaacaaaataagttagtactggagtccctccacagttaatggcaggacacctgttttagaagaacattgctccaaaagttactagaaacaacaccataatccatagctacaaatataaccgaaaaaagaataagatcatggcatagcattgacagtttacaactccaagcaactgctccaagaactaacctaacttcttcagactcgatgctcatgatatctccagaaaatagttcgtactgatatcggcattttgaacaagaaacagtctgtaaagtaataaaataatgctaagatttccattacagcattaaaaataatctatattttcctaagatgtcatctctaaaaatttgctcaaactgtaaaattttgtttcataaatcgcatcatgcgagctaagtgagtagcttaaacaattagattagaggtacaagatacttgtacagcatcaaacctgagttccatgctggggctgtgcaactgcgactgctaccatgcagcttggacagcgaataatcatcccaaatgggacctgtaacaagtaaaatctatcatttagaagtgtagtgacattcattcactgtgttttcctttagaagtgtctcaagttttctctacatcaaatatacttccattcaacaagacactcttatgtaaatttttaaaattaaagtatgatgcaccagaattatcaatactttgagacaggatcagaaccataaggattgttgccaggcttgtggatattaatgggactagattattcaaagttatatgttacatcaaaccaaaagggagtttcgttggaggggcactgatattgctatggcaagactatccttgttgggaccttttgcactaattgttttgataataaataggatttccgtagatgaactgattgtacttacctatctccagaaatctacgtttagtactattcctctgcaaattcggttctagttagaattaagcttgaattgccttggacaaatgaaaccagtaattggacaaatgatgaggtaccggtaggtgacaaatcatgtttgcagatcaaggttttaaagcaagaataaaaagcttccatcatttgtcaaatgccactaaaacatccaaacatcatgcatgcaaaccaaacagcaaagcaccatacacatcgtcagacatgctagtctgcgacgccaaagctcacctcctctgccgaagaaatgcctgcgcgagatacataatcgattatcctaagagcatcagaaacacgcagagcagctgccaatcgctggacaagcaatgcgtacgtccgcacgtctggcctcgcccacctccaggccccagctgcaagccggcactccacaccacagggactcagtacgctcaatccaaaacataattcactacatttcgtgataaaagaaaaaacgtaaggagtgatacgatgccctcacctcgtgcaaagccggatcgcatcgcctcgaacaccgagagcgctagctccacgttgccccggtcaagcgccgccgcgacgatcgcgttacagtcggacgcgtccagaccgcccgtgcctcccgccgactccgcgacgatgtccagcgcctcgccggcgtccgcggcgccggcgacacgcctgagcaagtcggcgtcgagggaggtggcccccgacgcttctggctcgcttgcgccgcccgcggagctggccctccgcaaggagcaagagccggaggacggaggggaggagcagagggggaagaaggaggaaccgatgctggtggccgaggcggcgcgcccgagcggcggggagctgatggggcgcggcagacggtgggcactcgctgatgagggggagaggagggcgagcgccatggccgacgcgcgtcgtctcacgggcaaaccgtcgaacacatgtcgggcacctggtgtggattaggcgcgggtggcggggagcgtgggaggcggacgtttagccgacctggcggccacctgtggactgtggtctgccgtctgcgtctgagagcaagtgagcaactttaggctgtgtttagttcagcgcctagtttggattttggttgaaattagaaatgatgtgactgaaaagttgtgtgtatatgacaggttgatgtgatggaaaaggac

SEQ ID NO: 73409 - DNA, 8998 bp, Oryza sativa
aataaatagcatgcctccaaaagtttgtctaacatccactcacagtaaggtgaaaacttaccgaatgcattctctctgtcaatattttacggagagatgatgtgtctccatgtgccatcagtgtgttaacctgaatgagaaagaagggtctcattgtttgccctatggcttataagccgttgccaaattttgaattttaaaacttgtttttgaagttgattttgatgctttttcaacatttgcttttaagccacaaataacacatatataaaaggtttacccataaatctttttttaatcactaatcagccgtgagtaaccgatggggaaaatatgtagtagttggcacttaaatttgcatttgacatatagacagtattctttataaggagaacacaatcaaaattctatgttacatacaaattgcaaggtcgcactacaagtcatgtatgctatgcactgaagaactcggagatcaattcaagccagaagataactcaggaaaagaaaaaaagaatgctgctcagtgactattgctatttctcaagaaaaggaaaagaggtagaaaattcaccagcctgttactactccctctgtccagaaatataagggagtctagagtttgaaatttgtccataatataaggacatccccacctacttacttataccaaccaatcaaagctatccctcacctcaacttaatctctccaaaaaaaaaaactccagatgtgcttatattctttgatggagggagtatgtcaacctttagtagcaacaaagtggcataaccataaagatcgcaaatcagtaatttggaccatttatctactgaacacttatgaaaactatactagttattggtctaggcctgtgcctaggaaacacgattgtcaagagaggtatgccaaaccttcactggtaacagtatacctgataacaccattaaaaatgatattatcttgtaataatattgaacactacaaaattctacaattaaaatcaccaaacgaatataggtactgagaaaacattaaataaatcagtcggtactaggtacagctcttatcttccattatcagatcatgatatctgcatggaaacctgaaacctatgtaagtgtaatcaaaatgcttagattattctacttgtatatttggtttcctaagagataaaggaaatgtacctccttgtatatcttgaatgcttgatcatagaattcctttttggtatagcctgttttctttctcaatcttgacacagcatatgcattcttcatctgtcagtataacaaccaactaatcagctcacaattcgtgaaaataaaaatatcacaaaggaaaattgcagggtatctcagatcaaatacattaaggtattgcagcggtagcaaataaattccaaaagttatcgttgaatgttgataggatagaaagtaagaaaataaataatgcaaataaaagacagtactccaaaatgtgtactcatatatgcagcattgcactgttataacatggcaactcaagaacagcaataataaagaaactctgttgccaagcatcatgaacctaaataaaaaggaaaacataaaaaaaactacagtaggtttctgttaaatatctcagtttgtgtcatttcatgtaaacaatcattgttctagctggtaaataatcatgtacaaccaggtatgaccagattggttgtgtcaatggtggcacacaggtgcctatggataaggatcgaaaaaaagtaatgtgtgatcaaggaaaaagagggaggccttttaaatttctaatctagaattcaattgactaatcaaagaagtagtcacaggttgtaagaaggaaataagagatgaaaagcagttttctagacaaaagagtcagtacctccagaataacgtcctcctttgttcttctccagccacttggtgtaaaccatctaattcacaataagccaaggttatgatgatgaagaccttttatcatgcgataggacagttttatttaaaggatatttattcctctagcacacatataagttttgatatcaatgcgccacttaacagtatttaacttttgtaggatcagatagagagaatcagcataaccaaacatgagaaataaaatgcttgaaatgtctctgcatcattcagctcatctaagtttgtttagccaaggcagcagatattagggtagcagacggtgaaagcatatctcatgattttgcattctcaaggggctccatcacttatttattagttagttagctccacacttaagtgtgctcttggtgaacttagttttctgtcttaactgaaaatatatgattttccccatccattttcagaaactaaaatggcaatgccacagccgtgctgtaggaaaaaaaatacagtaaggaagaaagaaaaaggttacacttctcagtagtaagtttatcgtccatgaaggggaatggcaaaaacactgcactgaactgtaatgttcattcccaagtgctgcactctggaatagcatgtcatttgtaccttttagtgttgagcttaaagctactcactctaacaattctgtcctggaaactagcagatgggtcagtgtttggaaagggaagagaactgattaccatgtacagattgatttacgtacgtattgattcacgtgacaaagcataaaggtcaaaatatagaatgtaatttcaccttttccagaaggggattggttcccgaatgctgtatggctcatatacaaaaccagggctcatcatgacaaccttcataccgacctatacagagaaaaaaaaacaagataaaaagaacacaacttcaacaattatatgaaatcccttaagctaaccaaatcacaccagaaaaccagattcgtcctcgcaccttgcgggcaccaagtggcaccttcgatgatgtttgcgacggtgtcggtgccttcgataatgatggcggctctgcctgtgctgctgtcgacattgatcttgtatgatttatttggaatagtagctccagaacctgcagcacatgcaaatttacagcacaaaatcacataacaccttattggcagcaaattgtacatcatccccaactcgataatgactcaaaccttcacagtatagacaggcgaccgccccctgtaaccaatcacgccaccggcattgtacggcgagcttgcaaaacctaatggcacgaaaaatgattgaaatggagcccaaattaaaccgggaaagaaaaacaagcgctgggttgctcacctcttgcgcgtgtattcgcgtggatcagcgcgaacgagtgggcaaccgaggcatggtgatccctgaaacggaaacagcaaagaggaagtaagagaatatccgattcgagccgcggggaacgagatctattccgaagtgggagcattacgtaagcggcggcggaggaggatggaggaggtggagagggcggcggaggcgtccggtgacagcgtgcccgaggcgagccagagccatcgccggcggatcgtctcggcgccggcgacgacgggagaagaagcggcgcgccggcgtggaagtggaactaaccaaggcggcggcggcggcggcggcgacgagggttttagggagagactcaatccaagccgttgatagaaaaggagcggctgttcttgctttgatcttctcctccgagttcttttgttagagggcctgttaatctatttagaatggcaaatggtaaaatttttggtggtaaaagatttggtatagagttggtgcttagatgtatcattttatcattttagcactagagagagcgcatggtccccaaacactttttggcaaaaattactaccctagactagcaaataacaaatactaaattaaaaacttttgctactagtgtttagatccaaaatagcaaaacttttactattttagaggatctaaacagacccatagttgccaagagcttcgtcggagcctaataaaccaaactaaaagtcgaaatttgattttttgcaaataaaaaacttaaaaaaatttacgttgtttttgcttggatcttcacctcggagttctaacaatgttagagttgcctattcaacttcctcgatttcgagaaaattaccataatcggagttaggtttcgtcaatatgctatcctgaaattaggattcactataataccactctcaaattgtgacagtatgttagaatgtattttctctcatttcttccaaattaaatgaactctaccctgatttccttggtgagctgaccaagatacccttgctcaatcccgtgttgtctcaccgctgccacgagtcatggctggtgctatggtgcataactgcatccgtgtccatcgccggcagttgcgctaattccattcgaaaattacatcacctgacacacctagcatcattacatcagcgctctcaacacaacatctatagaacaaaaaaacacaatcaaattgattagcttgttcatgtgactgcgacaaagatgtttcggtggctggtgggacagtggcagtgccaggaatggaccagcgagcctacctctacactcatgctcaccgccgctgttcctcctcatgtttgtgtacgcatcattgctgattcgtcgtcgaccaccgaatgaaccagcatgacctcagcggggaaaagcaccacgacctgcacgtcgccctgcttcattgcatctaatgacgacgacgatgccgcagccacaagcaccacctaacgctagcatggtggtgcagcccgttgtcctcctatgtagatctaacgagcgtatggagttggggatggccatggctgccctactgcgtcatccctagcttgtcgaggtggaccagctgacaacgacagggcgtaccagtggtaaggtcgacgacaacggtcgtaggagagcgccacaaaggaggctgcggctttggcagcacgccggtcgatgagatcgttagtgacaattatgtaactttggcatgagaaaaagaacatacggaactaagggcattttagtcccttcaatgtgtagaaagtgcaaaaaaataagtaaatgagagaaaatgtactctagcatattgtcattatttgagagtggtgttatagcgaatcccaatttaaaaatagcaatttagcggagcccatctccgagaatggcataatgtcaattttctcatataacttgtttgaattacgttagatacaaaatcgcacgtgcggttacaaggcaaggaatccattcccaagccgaccgatgcaagcgtgtgcaactcaatcaatccaaaacacgtcccttgtcattcttcctcgcaccgcaacacaagcccaccaacaccaagcaaaccaacgcaccaccttcccctcctcctcctcctccgatccgatccgatccaaatcgccatggatttcttcaagtccatcctcgccgagcccgagcccggcccgtcctccccgccgccgccgccggagacggagacggagcaggagcacgccggatccacgtcgaccccacccactgacgacgacgtcggcggcggcgggggtgggggtgggggcgggggatggggcttcggcgggctgctcaagacgctcacctcccagtcggagaccgtgctcgaggcctaccgccgcgacctcgccgagttcggcaccggcctgcgccgcgagaccgaggcgctccgcgacgccgcggcccgcgccgcgcgggacctcccggcgcacgcccacgcgctcgacggcctcgccgacatcgtcgcgcagggcaaggacgccatcgcgcaggtcgccgccgccgccgccgcagcccccgccaccgggcactcggacggcggcggcggcgaatccgagcccagctccgcctcggggcaggtccggtacagccgcttcgaagcgcagctccgcgcgctccagtcggatccggccacgttcacctccgatcctgaggactccgatgacttcgcggcgtggagggtagggtttagcgtggatgagaggagtggggagatcgaggcgttgtgctacgagagcgatgcgttggaagggatggtggagaagctcgtgccgggcacggtggagagcgaggtgttctgggcgaggtacttctaccgtgttcataggttgaagcagcaggaggatgctagagcaaagctcgtgaagcgggttttcgcggcggaggaggacgaggaggatttgagctgggaggtggatgatgaggatgaggaagaacaacaaagagcggaagcgaatgaggaaggatcaaagcaagaaccgatcgaagaagatgtcgaacgtgtagcgggggataaggaaagcgagaggattgtggaagaaaaggaagttgaggcagtggaagaatcacgcggtttggagaaggaacagcagaatgccgatgcaccgcaaccggaggttttcggcagctctatggtggtggtggacaagagggagaaggaagaggcatccgtttcgaacattgaagaatcaagtgacaagaaagctgtcactgaagaaccacgttcaagcacaggagatgatgcggtgaaagacggagcaaagcatgagacaagcgactcaagcaaggatagtgactactccatggtgtctaggcagcgaacaacgaccgaggaagaggatcttgagtgggatgagattgaggatcttggggagcatgaagagaagagagggagcaataatgactcaagctctgctttaaaggaggaattgcggaagaggctcagtgttgctgaagatgatgaggatttgagctgggatatcgaggatgattgatgatgataaggctgaaaaaacaacgtgccaacctggtatgaagtgttgattgtatctctatacttttttgccaattacttgtgcaagatactgaaatgtggccaataaaattggtttagctgtgctgattatgttatggatacgtttgtaaactaaacttggtgttatcaaatggcaattggctatgcgtcaattcgttgatgtctttatatcactgtaaatatttttgttttatttgactatgtgttgttcagttaaaatacgtaggctgcactagaatttggaatagcatttggacgatttgttcccacacaacctttgaatcaggacatactgaataaagttatgactgcaaaatcgacatcacccctcagtgatgtaggtttcattcattagtgatcaagctctcaccaagattccaatagtagcagatagtggacataggatacaaggctgatatttatagtccattttttactcttttggatatgtgcattttgccatttctgcacatggggacgctggtgccagtgggcaccaaaaacacatttgttctgaattctgtgttcttgcttctttcacaacttagactggtacaatgcgaccattatatgtaaattgtaagttttacagttctctatgtaagatatttctatatcaattttacttgctagttgtatgatacactaaaaaactatatcaagtagagaatagtcatctgttactgctattacgttttccaacagttgtccattattcagtgccttgtaacagggtaatattcattcagcacatgccttatacatgtcatggcaaaacgctgatgaagcttatgcatcatactagcatataaagcagtatgagttctttctgtattgaatttggaatgtagggaagcaaaatgtacagaaatttgcctgtcattcctgtatgatacaatatcggcatatggctgtttccagacccaagatgtatgtaactacagagcaaacaaaatttcaattaccatggtttttaccaacaaaatggcttagctccagttattgtgcctgtttgcctagctccggtttgggtatcaacagcagcctttttctttagaactttttctcttttttttttggagaactttcatttgggaagatgctggtacagctatgctgcccttctgattcgctgaatttctgtcaacctcaaatcttctgaatcctaacctgcttaattcataatctgttcattgttcaagctgcctcacaagttataatggtcttgtttggggggagctttttctaaaatctccagttccctaaacagttcaaatcttctcacctagattcttatattctaagaatctgtagttatataatctaggacatgaattagaaaccagaagccgagaaacatagtttttttttatactactcagaattttaaaactctcccaaacaaaaccaatatatgatcatgtggcagcaagcagctgcacactttatcctgggtcgaacaaggcaagagcaatatcctgggccaaaatttacccaatataacggcccatttacgacattcccagcccagtccggcccgcccgagagcgtccacaaaagccgctgccgggtcgcctccttcccttcctcctccgtcaggtcaaccatctcttcgcagatccacctgctccgccgccgccgccgccgccggcctcctccgacccgcgcgtctcagccgtcgaggtacgcgtcgtcccctcctctccctctgcgcgcctctctcggttgttctcggaatccgtggctcgggtagatgggatggaaggattcgtgtcccttggtggccatgttgacttggggggagggattcgtccgtatcgcgctcgattgttcgcgggattcgtggctcggtggatgggaggattcatgccgtgttgcgacgttgggcgagggattcgtccttatggctaggatccagctgatgcgggatgcgcccaagtttcgtgtcttgacgtgaactctttgctcggccgcgctttagggatgatatggtatgcttggtgtctaggtgatttccgttgtttgattaaaatttgctagatgtggggttttatatggcttggtatatcttggaatttggtatccctgagtgaattcacatgcatttcatggtttattgggtctgcttcggtgtgatgaatacatgcttaattgaacatgaaatagcgctctcattgat

SEQ ID NO: 73410 - DNA, 14506 bp, Oryza sativa
atatatataaatgtgggcaatgctaaaaagtcttataacctgaaatggaggaagtacaaaacagcaaatagggaagggcttatatgtgccggaaactctatagtcggcacatatgagacgtttttcaccttttaatacaataaaattaagaagcggcacctataaccacttattggtaccggttcataaaaaaaccagcaataatagttccccaagtcacaagtgccagttcttcttataaagcggcacgtaccgacattatataggcgacggttcttataataaatttgcacccactagtgtggcgcaaaatgtgctggtttttactgtgaactggcaactatggacttcacatatctggtttactatataaaccaacatctatgagtccttaggtacccgttgacaattaaaaccggcacctataatgacgctacttatatatatatacatatatatatatatacttatatatatatacatatatgtatatacatatatacatgtatatacatatatacatgtatatacatatatacatgtatatatatatatatatatatatatgtatatatatatatatatatgtatatatatatatatatatatatgtatatatacatatatatatatatatgtatgtatgtatgtatgtatgtatgtatgatttttacctaactttctcatatgaagttggataaatataaagtttgtatcaaatttgtagaggtcgacgagatatacaactttgtgtagttgatgacattttgatttgtggttgtcaggatgtctaaaaatgtactataagttctcaaacctatttggaaaagtggatatttaaaatttctaaacaatctccaaaggagagaaaatctatatgaaagttatagatctatatgagatctttgtaattgacaaaattttcatttgagcacgtctatggtgttaaatatggattataagttttggatgagagtagcctcaaaattatttgcttctaagacatgtgtttttaggtgagatcgtaaggaggcttccggaggagagggaggtcataggtttgaacccttcttaccccgtgcgtatggaaatagtgttaaaatcttgggacttgtgggacttgagggaggtcgcacgtttttttttattatgtttgctcccactaggggtaaataatgagctagctcggcttgttaaggcttggctattttgagtcgttaggctcgttaaagagatctattcattttctctactattataaaattaaagatgtttccactagaattttggtacgtcaaacttgtttgaatcggttttaattttatgtttttgtcaaatccttttcttttttcttgcgccagagtgtcactcttatctgagacgcacacgaattaattgggcccgcaccttttcatgcgccccttgccacacgcagcaaccgggcccacatctgagtccattttccacatgtccctttgctcgctgccgccattgggcccacaacggcatcgtgcacgtgatttttcatatgcccgattgggcccgcgatgtcctcgcgcgcgcaatttgcccttgccgcatgtttgatttgggagtgcgtcaccctcacccacgatttaaaaattatagatgttttgtggtatatcatccgcatccgatttccgtcacacgtaacattcattgtgaagtcacggctcacgagcaaactacaaaagagagtttgtgtgatgtggatagcaagcgaatgaaactcgcagagtccacgcagatatcacgtatgccgttgcccagttcatcaaatgctattcctttcatacggcacgattcatgggacatgttagcatgatttcaattcagtctccacaatgctcgtacgtactaccaggcatgccattacaataatccataagaatcggttttactttcgaaaagaacatgccaaccaaaaataaaagatgatcgaagatgctgattttgtctattatcaatacctacctgacttgagataaagctggacgaaaaatcaagcttgtgtttaaagacctcgttgtttggcttatgcttattcctataagccaaatattaaattttagaacataattttgaatttaacttttggttttttaacttactttattttaccatatttgcttttgagtcgctaagaacatgtatataaaaaatctgcatataaatagtcttttatttggtaataagcgattcggataagcacgtgaaaaaacgaaacaatagtatgtgattatttatctaccgacaaatatgtacaaattaaattggttttacccgttgcaacacacggatatttttttctagtcatattaataattttaaattaccattttatcataaattaacataataatggacactaaataatgaaaaaaatcacaaaatacaaatagttttgatataactaaaagagtactccttccgtcccgaaataactcaacctaggatgggtaacgaatctggacgattgacccatcctaggttgagttattttgggacggagggaatacacactaatgagcttcatggtttttgtctacccctagtttccaaaactaaaaaaacgggtgctcccctacatgtgccgattctaaattggaactggcaccaatggtcgttaacagtgttgcctgaacagtcattggttgtgaattcgacaccaaggactgattccgaaccgaaatcaaagtgcttttctgtagcagtatgcttcaacgtgatcgaccacactgaaatggagctttgggtggttgccagcttaccgggtagcttcagccttcagctgtgcctttctggacaaataatttcagacccaagtcatccgaatgccgagtgagaacgcacgctgacatatcttagggacaaattcgagttgggttcagacatattattagccaactacctaccataatatacaacttcacacaagtagtcaaaattgtaagactcttggagactaggagttacggggaccgatgatactagattacgtactgttgcaaaaggttgtcaagtcagacatgcctcgtgtcgattcagaccatgatggatcgttttttttggaggtcagggatgaaattaaggtcgtttttagatggggaaaatttttaatgtttggttgttatatgagatatacggacacacatttaaaatattaaacgtagtttaataataaaataaattatagatcctctcgaaaatctgcgagataaatttattaagcctaattaatccatcattagcaaatatttattgtagcaccatattatcaaatcatgacgcaattaggcttaaaagattcgtctctcaatttagacgcaaactgtgtaattgtttttttttcatatttaataatttatgcatatgccaaatatttgatgtgatgggtgaaaattttttgttttggaaactaaatagggcctaagtgtgtgttgagagggaaaatcccaggcgacaatcttttctcccccaagaagtcttctacttctacctgatgcacatcgtcttctctcccttgattgctctctatctttgactgaaactctgaaagaacgttaggtggacaatgatggaagaagaaaccagcgaggcaatctaacaaaccaataattaacgttaccaatatctatagcaaattgcgcattcaaaagtaatttgaaaggagataccgagttaggcaggtatcagcttatacctttcccttgtataaatgctgcgtgtctcactagctagagcaggcaacataggagtattagacaagaagcacacaacatgtgtgacagacaaagaagacctgtgcctcctttgggaactctccgatcctcgtggctcctaatcttggttgtccactcctgtctttcgagctttgcagtacaccctgctgctgctgctgcttcttcttcttctccatccaacaccgatttccaaaccctcctttgcctgaagctccatctctccaacgaccccggtggcttcctaggctcatggaagcagaacgattccatcggtttctgccgctggcccggtgtcacttgcagcaagacgaacacatctcgtgtcgttgcgctagacctcggatcatctggcctcaatggccaaataccaccatgcatcaccaacctcactctcctcgcaaggatccacttccctgacaaccagctcagtggccagattccacctgaacttgggcagctgagcaggttgggctaccttaacctcagttccaacagccttagtggttcgatcccaaacacgctgtcttccacttaccttgaggtgattgatctcgagagcaacaagctcactggaggtatccctggagagctcgggatgctccgcaatctttcggttctgaatcttgccggtaacagtttgacaggcaacattcccatttcgctcggaagcagcacgtcccttgtttctgtagtcctcgcaaacaatacactcacagggcctattccatccgtgcttgccaactgttcatcgcttcaggtgttgaacttggtatcaaacaacctcggtggaggcattcctccagccctgttcaacagcacatcgcttcgaagattaaatcttgggtggaacaactttactgggtccataccagatgtttcaaatgtcgactcgccattgcagtatcttaccttgtcggtgaatggtctgacaggcaccataccttcatctctgggcaacttttcttcccttcgcttgctgtatcttgcagctaaccatttccagggcagcatcccagtaagtataagtaaattgccaaacttgcaagagcttgatatatcttacaactatttgccaggtactgtcccaccctccatattcaacatttcttcactcacttaccttagtttagcagtcaatgatttcactaacacccttccatttggcatcgggtacacccttccaaacatccaaacattgattttgcagcaaggcaactttcaaggcaaaatccctgcttctctagccaacgcaaccaatcttgagtccattaacctgggggctaatgcattcaatggtattatcccttcttttgggtccctttataaattaaaacaactaattctggctagtaatcagctggaagctggagattggtctttcatgtcctcattggcaaattgcacacggttggaggtattgtcgttggcaacaaataaattgcaggggagtttgccgagttcaattggtagtcttgcaaacaccctaggggctttgtggctgcacgcaaatgagatatctggtcccataccaccagagacagggagtctcacaaaccttgtgtggcttagaatggagcagaattatattgttggaaatgtcccgggcacaataggtaatcttgcaaacctgaattccctagacttatcacgaaacaaactttcaggacagattccacattcaataggcaaactcggtcaactgaacgagctctttttgcaagacaataatttcagtggacccattcctagtgcattaggtgattgcaaaaaattagtcaatctcaacctttcatgtaacaccttgaatgggagcataccaaaagagcttttctcgctttattccctaacaacaggtttggatttgtcccacaaccagctgtctgcacagattccacaggaggttggtagcttgatcaatataggcctactaaatttttccaacaaccatatttctgggaaaattccaactactctaggtgcttgtgtccgcttagagtcccttcacctcgagggtaactttcttgatggcacaattcctgactctttcgtcaatttgaaaggtatttctgagattgatctctcccgaaacaacttgagtggggaaattccaaacttttttcaatccttcaattctttgaagcttctcaacttgtccttcaacaacctagaaggtcaaatgccagaaggggggatatttcaaaattctagtgaggtatttgtccaagggaacattatgttatgctctagctccccaatgttgcaattgccactttgcttagcatcatctagacaccggcacacttcccgcaatctaaagataattgggattagtgtggctcttgttttggtctctttgtcatgtgtagcatttattatcttgaagaggagtaagagatctaaacaatcagatcgccattcattcacggagatgaagaacttctcatatgctgacttagtcaaagcaacaaatggtttctcttcagacaacttgcttggctcagggacatatgggtcagtatataagggtatacttgactctgaagcaaatggaattgttgctatcaaagttttcaaccttgatgaacttggagcaccgaaaagctttgttgctgagtgcgaggcctttagaaacactcgtcatcgtaatcttgtgagggtgatttccgcatgctcgacatgggacaataaagggaatgatttcaaagctcttattattgaatatatggctaatggcaccctagagagctggatttattccgaaatgagagaaccgttgagtttagactccagagtaacaatagcagtggacatagctgcagcattggattatttacataaccgctgcatgccccctatagtccactgcgatttgaagcctagcaatgtgcttctagacaatgccatgggtgcccgtctcagtgactttgggttagcgaagttccttcccactcacaattccacaagtattactagctctacaagcttagggggaccaagaggctcaattggatatattgcaccaggtaaccacattttacatgatttgtctctcctcttgaacaggaaattattattttaataggtgcggtgtccaccagcaaattttcaacttttgggagtgttttccctccaaaagtcacttcgtgccgtgtcctaccgcaaaaaccgcgaagtcacagagtcttgtagcaaaatttaccctttttttttctttcatcctaagggctgtaatttttttctctactatatttaatgaaatagcacaatcttgtacggatttatttttaaaaaaaacttctgttatgtgcatagatgagctggtttttatcaagtctatggacttctcttgaaggggcatatatagtcaatggaaattccttcatttttgttgtcatctacaactgatgttcatttatcttcttataattgtttaaaatataagcacatatagacttaatttatttcataaataaagaaccacctcatacgatctagacatctatactagaaagttacatatcaaacatgattgagatgtcatgatggttctggttctcttgcataagggagagcagcatgcatcgcacttacgacacatggtaccagatgttgatgacaatatatagcatcaaaatatagatgaaggtgagccatggtggacaaacagtaaccagtcacacggagcactcccaaataccttatcaccctctcccagtggaggacttcgaggattatagttctggagacttgctctccgggtagccgatgcatactaacaggaaggataaagtagactactagcaactgtgtagcacagaggaggaggcaaaccctaggagagctaaggcccatactaaccagattttttgccatccatactaccacataatcgaaccgaataagttgtgcataacttatttgaaatttctgccaccctcacaatggagaatccaatgagtttgcaaacactgcattatgtagggaaacaaaactacaaaaaggaagctgtgtcggtgcaaatctccaagctaaacttgctcaaaacttgaacaatagactatgccttgaattgtaagttttctgcaagcaagtttcacgcaaagatttgactgatactaggccatcaatagcctacttctcagttagagcatataatttgtactccttggatttttaatgaatttcctatgggcttcactcaaaatttccatagattacgacaaacggttaagctcacataggtgtgttctttaaacaatgctctgtaggacaacatcttcgccaattaaagccagcaaaacccattatggcgtagccaacctaccttgcaactcatgagagtacatgcatattgatttagagaatatttaaaaagctactcttctcaagttaactaatgacttgttcttgccaagtcctaattcacaggatttatgatcacctaggttgggtttccaccatatatagtacaactcatatggcttttatacccatatcctttggtgtattgtcacattccgtgatagtccctttttgaagggatctaccattttctaatatttggatcttatcaaacattataactttggagtttctcaatgtcctaacagacttcaatcatctcttcatatatctagacaatttcatgttatccttgaaacgcttcaccttgtcaatgatagtatgattgtcataatttatgaggatagtcaacacaagttttttaaccacaagcggatccatcattagatcatgttgccagcctgcttccatagctaacctcgtcaaagtggtctgtttgcaagacctcaacaaaacagcatgcaccaccacctatatccactagtggcatttatctcatgaccattggagatccaattagaatcactatatccctccagtaccactgggtactggtacaatgaatccttgtgcgaaaatatatccactagtgagcacacggatgtgtttccctggttctctccacccctcattgctcaagtagctaaaagagcactcatcctttaaaggaggtttctctatcctagaagtagtaagatgatactaaaggtttacatgcatcccttcacttgagattgggtcttttatcattttttaggaattatttttcatatgggctaaggcttatactacaattccgacagttactgctagagtatatatcaaatttaagaaaagcgtaatcgtctgttttacttgctatatcggggaaagtattttcatctcccaaggatatcccctatttcttgtataccacctaaatagtttgtaacactgtgaaaatctagtgaagaaaaatcagtaaaattctgaactttttaaaacttttgcatcatgttgtgatctttgctaagttgtgtggaaactcacttttaaacaaaactatgcataattgaatcacgaaatccaccaagagacattataatttaattagagaacttaaaacaaagaatttggaaaaagataacacaaatttagagaaattaaataccaatttaatttctaatccaattatactacaaaagtgtgaccaagagcttaatctggcaacaaaaggtcatgaattaaagtacctatttaattctctattcctaatatactaatacaatacactcgagcaatatattaagaatacaaatatttatgaaaggtaagttaaaagtatttccaagtgcaacaaatatcatgcaattacaatgcaagaattatatttcactgtaatcagcatggaaggaggaccgggacttgtactattcttgactagacttacaacttttaatttaacttgggggttggggcatggatgggaatggataatgaatgatagaaccacataggatgacggtatgatccagtgacagaaatatggataaatgtgcctggaggtaaactgttccaagtgagacttggagaggtggccacaaccatcagtaaatggttaaacaagagaacataatgtagtgtttatttaaaagggctaggttataactttgtgaaaatatttataaaaaccggcttcgtccaaaaagaaccttgacctttcgtcaaccctatgtgcattaatcatattatagtgggggcttatgagtactctagtactcaccattgttattttcccctctttttagacataaaagcgtgagaagaggaaactctactggcatgattctgtacttaattagcacatgatcagaaggctgatcgagaactaggttgtgaccctagccatctgcctgtaggcatgtgagttggacctactactatttggtttcagctgttgtttgtctaataggacaagatcctatttgtcctagtaaaggtattaaactcctttggcttaaattcatctctatatatgttttgtattggttatcaatttgtatcagctgcttatctaggattggtacaagaaaacacatgaggttcccgatatccaaaatcgggagctgacatagtgatccaaaaattttaaaatagttgacaagatagattaatattacatacatcactatacaaactcaatttttaattttacaagttgtaacaaaaaaccaaatataactgtgaatttacattaactattttcagtttagtttgtattttattataacatgtagaagtgatatactccctctattacaaatagaagttgaaattgatgttatatgtgtgtgaactgatattactcagtatataatactgagttttaatctatctggtaaattctttaaaaaatgataaatatttttttagtaggcaaatatattaactggctttagaaaaaagcctagagaacaaagaagtgtcttacacagaaaaatgaaagtaaaaaaaaaagaaaggaaaacaacacagcaagtatcactacaagcacaggagggaccggccggaaagcctagcccccacacaaagggtacgtttaaagcgatgtgtaaagaatctgaaataatcgggagtcccggaccactataacccgtgtgcattgtatcagcagcagaagcctttgaaaaatcagccccatgcatgtgacggcagtgttggatggaatcttggcgcatgcacggcgtcggatggaaagagataacggtgggaaaaacaagaaaatgctagatgcacgcgcacaatgcaccaagaaatcctacccttccatcgatggccttgcccacggttacagccgaaatttatttatttttatttgagtacgattgacggaaattagtgaacaaacgagcaagagcatagtagtgaaaccaatattataaataactggggatagttttggttcgataaagcaaacacataaatagtactcccaccgttttagattataagacgttttgactttactcaaagtcaaactacttttaagtttaactaattttgtagaaaaaagtattaaaatggcaccacatgaagcattatatggaagaaaatgtaggtcactagtgtgttggtatgaaactggtgaaaataaattggtaggacctgaatttgttagaacaaaacaaagcactattgatataatcagagaaagactaaaaattgctcaaagtcgacagaagagctatgctgacgagcgaaggcgagaattggagtttaatgttggtgaattagtatatctgaaggtttcaccaaatcgtatgacaaaaagatttggaatacaaggaaaattaagtcctagatatattggacctttcaagattattggtagaaaaggagctgtggcttattagttgaaactgccagcaacactatctacagttcacaatatttttcatgtgtctcaacttcgtaaatgtctaaaagaacctgaagagaaaattaagcaggatcaagtgtagctgaaatctgatttgtcctatgatgagaggccaagtaaaattttagcagaagattggaaacaacttcgtaatagaactatcaaattctgtaaggtcaaatggaaaaatcattcagaaagagaggccacatgggagaaagaagagttgacgaagaattacccttatcttttcaggtataaatttcgtggtcgaaatttttttaaggggggtaggatgtaacgaccctaaaattttaatttgcttcgccgcactgttggcaacctagttatagtaaactcactgtgttgagctgaacgactagttgtgtcatgcgattggcttggatttttgcgttagaggatcgattcatatgcatatatcacagtagaaaacacaaattagacacataagtaaattctttatttcttcacatatacattatacagtgttgttgcatacatcaaacgcatctcatacattattcatctaaaatagaaataatgaaaattaaataaaaatgttggtgtgatctgtgaccacaccttattgctttaggagattttaaatataagatttaggcaaaagagaaaatttagagttgcttgatgtcacatattttgcaatcaaaccattttggggcacaaaattagtaacattagccatctcttagtagcttccaaaactatttatttcttaggtaaactgtgagtttttgggcaattgaaaatcagtccctaaactcaaagtaatctccatatttttaaagtctatggtactataatgcaaaagttacaaatatcatacttttcactagatttttatttaattgcaaatctgtgaaaaattatgctgagcctccaccgaataaaccatgcttaggtgtcaaacagggagaccaccagtaaaaccttagtaggtgagtcacctagtagtcaaccatgtccctgtgacaaaaaccatatcagtgtgaactccatcctgaccgagcctcgttttcctcgtagagaccaaaaccagtagcaagaagaaccaccataaccagagagttagagaagaaaagaaaaatacaagagggcaaaatcacccaacaacaggtggagcaggggctccagctccattaggaacaggtaccccagctgaaggaggagacgctgattcagtagaatcaaccaaccaatagaagctgcagtagaagcaaaagaggagttcaaccatatattttcacaaccactgaataatcaacaaagaagtaaactagtttaagatttaggaaagagtaaataatgtatatattatatttcctgatcacacgcattagcaatttcagatttttattcatgcaagcatcatccatggcatataatcatgattgaaatcagattatttacaaatcaagaatttagagaccatatcatttgcattacaaggttacagtggcacacatccaaccaatacttttattgtgagacattatgagaaatagaacagaaaaatagaagggggaaaagggatatggagttactggtgagggttgtggctgccgcagttgccattgaggtattggccgtctccacggcgaccaccacaggagttgagtaccaatagtcatgaaggacagcaatgctcagattacttgagagaggagaggtggtagtagaggatggaggtaaagcaggatatgagctcgtgggaactagggagaacaaatcactgcaggggcagctgctagggagatcgccggagtggggagtggcagccggcctgagggagagcgttggtgttgacggcactgtttggggatggcggcacaggagagaaggcgtgagggagagaaggagataacgagagaagaagatgagaagaaagaaagtgggctggttgggctttggttttgtgggctggactaaattgatcatatatagtctccaggaaattagatttagatttagaatagaatgtgagcaagtttatatagcatacaaattgatgattctaaatttttggcattagtgctaaaataaaatctgagcagagaaaaataaatttatataacagcacctgatcattatatttgccattcataatacacaattcatatgcattgcatgcggtaaattaagcgttcggaatatgtccttattcggacttcagtattttttttccgaagttcaagttcctgaggaatcattcatttcgactgaatctgagggtattcatggtgttttctatccaggcaagtccatctcttgatcatattgcttagttatttcaaatatttgcaacctatatatctctccccattgcatagaaaaccagaaatttatttttgaatgttaatattgtacatgtgaatctgtggatcagttctttggtgatcttgataattggcagtctgaacttagttgttgtgtggttcagctgtatatgcttaacatcataaggttaattaacaactgctgtaaggtatgcaagcgccgtagcgatcatgtcgaccatatgacctggaatgggacaggctggtttagtagttctttcttaatggctttatcctgcgggcttaaggacttccgcgaatcccgtgagcgtgggctagcgatgagggttgccgttgttgcggaatctgattagatgatgtggatcgccgttgttgcggaatccgatgattcgccgttgttgcagaaatcacccgcagagattattgccaaatggattgatgaaaagcttgtgaccttatccttgccggcatacaccatgaagtgtgcttaggcgctggcgtggtggctgtgtagcgcgggcgttaaaaggtttaaggcgtctatgggtatagcgacacacctctgcagagtgtatgaattgtgatatgtcactccctgtttcgggtagcaactgcgggctgcagga

SEQ ID NO: 73411 - DNA, 11734 bp, Oryza sativa
cagatcagtacgggagtttaaatccaattatgatgtttatggctagcaaattcaatagttcaatgattatataaaattgttcatggagattaatattctctctgaggaagtgaggatttgcttgagtgaaattattgtgttgatatgatcaagttgtcttagctccttgtgtcataatgcaggatgacagaggcaccatttgtgccacgtgagaagctgtttaagcaacagcaatattttcagaatttaaccaagcacacctacctgaaggggcgttacgatgtgatcacatctgttgccattccccttgcgctggctggcaccagcttgttcatgattgtaagttgaaagtttcaatttgttgcctatgctactctgttcttgttcctgtagtcttgttcagtcaataacttatttgctgttttataaacagggccgtggagtttacaacatgtcccacggtattgggaaaaaagagtaggcggttcagtatctcaacttggcatggaagtggtaccatccaggctacattgtctttggttgcaaaataatactgtcaatctgagcacattttggttcgctttgttgttatttgtttatatctgatgtcagcaaattgatgctaacttatcagaaatgtgagaacattggcatcgttgcatttccccatttaattgcatgttcctgctttgtgttttcttttgattggtgatggctacatgtactcgttgcttcactatggtgacatggtgttttctgatttcaccattcgcatggcgtacaaatggtgagaactgagaagccttaagatcctgaatggttgcgagtattatttttgcgataccatgatggttgtgagagttggcatcttgctgagattttcttgcgtggagatatactttgacacaccgtagcaataaactcctgacgcgtatgttccaatctggttggtttcttgggcatcttaatttcggttcggatgttattggttagttcgctaacaaacgaaacgatgcggcttggtttccgaagttaaatcttgcaacgcgaaacatctcagaatgtagaacggtttgacatgcattttggtgggttagtgatttgtactcattacgggtaggccatactagcttaaagggcatgttattgatacggaatgcacatgagcggaacgaaaggaatgagccaacgaggaatcatgttcccaggaatatttgcatcattaaaaatgagaaccctaaacacccgttaatagcccgcagaataaaagatttcgttagccaaatgtagatggataagtccaattaacaacgctaaactatactccctccgtcccataatataagagattttgagtttttacttgcaacgtttgattactcgtcttattcatttttttttttgcaaatataaaaaacgaaaagttgtgcttaaagtactgtagataatacataatttcaaaaaaattgaataagagagtgatcaaacgttgtaaacaaaaactgaaaatcccttatattatgggacggagggagtactgaattcccttatattatgggacggagggagtacttaattagtatttgaagatcttcactttctccaatattgcttcagctagggataaaaatggttcggatagtttccgttcgtccggaccatttttcggattcggataatttcggtcggaactatccgaaaattctcggattcggaaacgaattcgaatttttttctcggaaacgaaaatgaatacagtaagggtactatccgtcggaatcggaaaacggtcggaaactatctggaatttttgcatacattgataaaattttagaaaaaacacgtatatatacataactttttcatacggaatcagatgaagataaactttatatcaacattgtagagctcgatgagatctacaactttcttattgactattttattatttgagatcatttaagggtctaaatatttattataatataccatattaatttttataaaatctcagatctacaattcaaacgacatctgatggagatgtgttctatatcaaagttgtagagctcaacgggatctaccactttgtagtttataacatttgtatttgaaagcatttaaagcataaaacaaatattgcaagtttcgaagatgtgaagtaaaataaataacatctccaatttatacaatggcaagtaagttatacatctagtaaaaggtcttgagaatagaaaatgataatcatatttgcatatggatctcttagaggaacaaccatgaaaatcgattttcacatacggttgtgagacagtctacaaaattgacgatataaatgttagagatgttgaactaaaataataagtgatatctcttccttgatcaagaaactcaatttgaggggttttttatataccggtaaatattcgctaccgtattcgttccgtctcgtattcgctccgtatctgtattcgataatattcgatttcatttccgtatccgagttttcgattccgattccgaaaaaaatatgaaaacgaatatgttaaagctagtttccgtccgtttccgatccgtttcaatccctagcttcagctaataccggagagattgcccacctggaacaaaaagagaaggtgaaatgcgacactggattagcatcattttgacaaagaaaaatactgcagctcaactcaaaacaaataactgaaactacaaattatcaagggacagtatttccgtattatgctagatatcactctaggggcaagaaatgccaaaaggagcaagagtttaatctaaaattctcaaagacaagatcatagtcaagttatcgatgaaaaacagtcaactttattagtaattggtaatggggacatggtggttctgatctctatttatatgctttaattaccctcaattactaacttagcaagtactcatgggtggctagcagcctaacatgctagtgcacatatactatttaagactaagtatagcatgaaaatcttaagataagttatccaagagtagtgaagtagaaaggttagtatttgcatcaaatgctttcctttactgtcccaccccctcatcattcttagaatgaagtgagctgcaatcatgaaatttatgagggatttgtggatcgcgtaacataccgttgagcatttggactatgtagtccctcttatagatttctgggagtgctaaaaacatctccatttggtttggttcctttgcgaaaatacttgctgcgaagaccacctcgcttccagtaaggccaagcttttgaatttcagctatagctgtcactttggccttttgttggggttcctcgcacatcttcttctcttgtgtatgatcggtaccacattccatcactgctgctaccatgcttccatggtgagtgatattctgaaaacgatcatgtgcgtctttgaaccgttcgatggctgatgctgcgctgctgacactctgcacagcaccctggaagtgatcatgtgcatccctgaacatctccattgccgtggccatcgcattggcatgctgaacaacattttggaagtgattgtgcacatccttgaacaactccattgctgtcaccatggtgctgacatgttgaatggaactctgaaagtggctatgcacatccttaagcatccttggagaaggaaagtttgattcagtcctactccttttcgtgccattactatgtttcttttgcctcttacagcttgatgccacatccaaggagcgaccagatggccctgcggattccctatccttgtccccatcctcatctccgacctcgtctgtgttttcattctccatgtcagcaaccacttcatcggacaattcctcctcctctctgcctgttctgtccttgccatatattacatcaaatgtatcaaaatatggaaatgggataccatacaaactcttggctctaggatgatcctgcagaaaataaacaagtcgtaacaaaaacacattatgataaaaacaaatgtacaaaaatacttagaatggcttactttgcaatgagcatcatataactctttttcacactgaatcatcttccgcatgccgtcccacgagaacctgggcaacgctaacatatctttgatcgcataatacttcctcttcagcacttttaaccgagaatcgacatgaggactggatctaataccacggcctggcagcctttgcgcaagaatgttctctatcccttgagaataacagttcttgaatccccctccttcgaccttaaatctaggatcaagagaaacctcgcacaatgctttgacaagctcctcatcttcatcggctgtccatttccttttgttcctgcctctgccacgcacaactttggagcactgagtttgactcatccctagaacaaaatcataatcagcttagggtgcatataaaaaggagttgcttattaacatataataattaatattatctgaaaagaattgaaaaatagattaacatgattttttttaataaacacattatttagtagttcgggaagtttgcgcgcgaaaaacaagcgaacagaggttggtaactttgaacattagaacacagccttacatgtacagaacagttcatacaagctagggttttacaacaacgtagtatatcactccattatccatgtccataggaggagttcgacggctagccgatgagagaagaagtcatcgaggcggcggcagtactggaggcgtgttcgtcggagagggcgaggcgaacggcgggggagatgtcaaagccagccgctgcggccatcggcgaggggagaggaggaggaggaggaagggaataatacctcacgtcacgagaggcagcggcggcggcggcggcggccggagagaggcggctccgggacggacggcgggagcaaaagcggcggaggggagatgggattgggatttgggaatggtaggaaccggattagggatttagggttgctggttggtgtgggtgtaggagtgggactgggactgggatgggagggaggcaggccggtaattggattcctcatctcgttgggctttgtcgcttggacatctgtgatccaataccactggattcgggttagggtctttaggactaggatttcctaagcattttccatcagaagggaaacgatgggcacatcccggtaatcactatcgagataatcgttttttatctgtattatcatagtatcgaatactatgatcggaatactatcagattttataaaatacatatttttatataaaatatatatttcctcattccctaaatgtttgacgccgttgatttttcaaaacatgtttgaccgttcgtcttattcaaaaaatttatgaaatgtgtaaaactatatgtatacataaaagtatatttaacaataaatcaaatgataggaaaagaattaataattacttaaattttttaataagacgaacggtcaaacatttttaaaaaagtcaacggcgtcaaacttttgggatggagggagtaatatactgtattatatatattaaaacatataatattgattttgatatatttaattggtttttaatgtaaacatgagcatatttattcatattattttcaatccatcttattttaaataatattttgtaggatagtagagatcgtagaattgggatactacctaagattttatatagaatcgtgtgaaaatgaataataagatcgagatgctatgaaaaataagatactatgtgtgattttggcttgatagtatcgtagcattataagatactagggcatggatcgggataattacaatcttgctctagactctagagattgtttggcaatcacaatagaaatttaaattttgaaactttattttaagttggttttggagtatttttattgtagtttattctgtagcattggtttttagaccgtgatcaataatttaaaagttttacactaattattttttttgttgctttgttcatttatctacggtttaccagcgatagctcgaccgatcagacattggcctcttccaagacaaaagttttagggtaattctatggaaagttgactattattaaaattccataaaatcctacacttgtaagagcaagtttaatagtatagccaactactaactccaaatcatttatagccaattcatataatagttaattactacactattaatatctggtcccacatgtcattcacgtattatgtctccgagtccgtgctgtatctggctacagatctataacccgctgctcttctctctcttcttttatccttttaaaatatgtttatagttggcttatagtatgctattgtagctgctctaatattgtagatcaagtaaaggatagcttataattaatctcttgcaaacctgaaaacacactacgccatgtcacagaattgcccacagatgtgtgtgggtaaaaatagagaatcaacatctaaccatctgtcggtaaaggtttgtgacataccatctgtaggcagttctacggtacaggacagatcgggaactctacggatttttggggacaaactatatgtcgctgattgttaatctcgtgtcaaactatctgtcggcatagactcatctgttggatcacaatcaaacaacccataatcattctcgcaataaatatataaatgttcatcacctagaccctagatcaagtcggtaagggccttttccgatagataagatgacgtggaaggtgacctctgccgacagatgttctgtggggggtggtgttctgtgggggtgggggagggttaggacatggtgtagtgataaattggcacttgtatttaacttcttttttttttgaaaaataaatatgatagttgaggtaactataggttggttcgccatcataccttcttcaaataactgaagtacacatgatggagtgactgaaggcatcacagtttttgtttcacatgaaagcaggcctcacaaaataggcttgtttgaaacgcacagagcactatcatcgaaatttttaaataaacaattaaagttccctgggaacaggaaattaatgttttccaagcatgggaaagtagagagaagaaagaaagataaaagtaagagaggagaagaaagaggagaggacattgacatgtggggctcacacactaactcagtcggttggactatgtcaacgagccacgcttagggaaaaccatcctcaaaatagccgaagcagtcatttacaccggttttacggttgaggggtcgatataccctgtttgcaattgagttgagggataaaaatcagattgaacacataatttcgagggagtcgaattggactttttccaacggctgaccactgtgcctcttcgagtgaagaatcctgaaaagcagcccatgggctcatgagaaaacagagcctacggacagcccatggggattcctctaaaatatcctgtcctccagaccttgaatccatcaatccctaagttccgcgccgccaaccccattctccagcgcacctcaggtaatcaattaataattgacctttcctatctgttgtatacattttactaacatactgtagagtataatgccttgtttgtttttgaagctgacaatcgaatcaacgatgggcctctcgcgtcggttcctgaatctaatcgtggacaaccgcttcccaggcgctgtatcgctgctctcgatcgacttgaggcgccacaagctgttcaacacaacaacacctgctgatctgccattgatcaacagatctgtatctgaatcagaacggccgccatgtgtagccaatgctaacaatcatcagaagaagaggaagaagaagacagtaaagatgaggatgcttcatcttcccgcgccaaccatcgaccttgaagcctcatctaggggctatagctggaacatcaagtgctcaccgctcacagatcgcaagctgctctgcacggacaactatggccgccatgtcctcttcaactccgaggcgcgccaagtggaggacttgcccttcctcaacgagcccaagaattcgaccttctccatcttcatccctggtgcggctactgacaccaatggctgtgacgacaatggtggtggcggcagcagcatctacatcatggagcgttgtcccagccatgaacaagaacagcggttgctgagcggtcaatttgaggcatttgtccatggaaggcacaacacctggtacaaccaactactgccttcaccgccattcatctacgaccccaagtacaagcgacccaagatcagctcatatgcagtgcttgttgacgactgtggcagatcacacatctgcatttcagtggatcatgttggcacctaatgcttggacacagtgaaacacacctggatcagagttggggattggacactacccttcacaggcaaggttgagcatgtgccagagctgaagttgtggtttggcatttgcaccaatgactggaaattgggagctattgacctctccactattatctccacagccaccatggaggacttccagccacagctagtaggcacttggaaggagcttgaggcacctcaacactggagtgagatgcgttgtcctcagcttgccaacctgggctcaggcaggttctgcatcgcaaggttcttccacacttggactactcccatggaaccgaactcatttggttatgattcaattaaggtgcactctttttctgattttgattctgattctgattcaattgagtttgaggagcactcttttactgtcttgaccggtacggatgtagtgccgtgcgtccatgatggcaatgggactggcaatggcaattacgccaatggcagcaatgggaaagtggaactccgaatgatcaagcacaactcgaaaagccacatatcttatggcatagatggtacaattaggctagtgttctgaataacgtactttggtttgcttccagacccatgtattatcttattatccatcattgtcgtctgaatagttaggggactttgttctatatgagacaatttggtggtatcactttatcctatgcattttcattacgaatttgtagtatttgtgcaactattgtatttagatcagcttgtccagttccttgtatttgtttggaaaacaaataacagtgatcacataatgctatgaattggcttagtgatctggcatgtttttttttttcaatcaagggttagttgatgaaggatccgtgaagtggtctggacataaagcttgtctagatccatcatactacggtgtacggcgtgtcagcgtgtggctgcatggcggcattcccttctcgtattattattattatatgactctcacgatctcagcctttgaggcaccccggccctctcatcttcactattcctagttcttcaaatttctttgtggttccttctcttctagttttaaatataacctctaggtttcttgaccaccatataatctgttcaacttctaattgatgaaaatacacatgatgatgggagtggctgaaggcattaccatttctttttgttccagacgaaaacatggcttcattgaaatttcacaataaacaattcaattgccctggaaactctgaaattatgtgttccaagcaggggccaaactgagtacacaagaaccattccattcataagaaaaaagaaaaaacaagttcatacccctaataggcaggatacactgggcacaaagaaatattaacatccatgttactaacaagtaagcgtgctgtgaaaaccaatgcacatttacacaagacattctggacgcgattgtacactacaggcaagaacagcaatcgacatgatggccagaaagtatatcctattatgagtttttacctgcgttgcttcggcgcaatactgcagatcaaatgtcatactccttccatcccgaaagaactcaacctaggaggggtcacatcccctcttggattctgtccagattcgttgtactaggaggggtcatcccctcggttgagtttttctggacagagggagtacgcaggtgacacacattccaagaatcaggtgacagcagtccacattccaagaatcaagtggatctgaaagatgcggtaccagattttgcatcgaagtgctgtcaatggcggaaagttctcacagcttggtcaattcttctccggcaaagtggacaattcgtcaaatgagaagagcagttcatacagcagcacatgtggccacacctgcacggtgtttgatttacatattcattcataaatttttgaggtgacagtttaatgagaacaaaagttgcataaagagatgtatcgatcacaaagatgacaatgggggtgattcagaaacaaaatcaaaattttgtaccaatcagagctcaaaatgtaatgataaggtaactactcttcaattcaaatatttgatcagattccaacaaaaaatgtaatgcatagtctatagtaatgtttaaagagttattttattattcagcaatatatagacagttctcattgctaagaggctaagagtaaagctatatgatggaatgcaaaatataagatacttacggcacaaaaacagcattatattcctgttcaaggcatatgacacatatgtccaagaccaattgatcctttttattgttagaatctacatctgatgtaccattgccccctgtacaaaataaaactgatgttataagacatgaacaagttatgataaaatagcctaaccaattgataagaaaaatgaaaaatcaccttcagcttctctagcttgtctttgtgcagcagcagcatgaaccctgtatggaaaaaataatgcattgtaacaacattttcagtatcttgcattagcaaaatcgtcaatggttacaaaacatatcctagtgtccatctgtatgctacaatgttagtttgtgattttcacccccgatataaaattactcccagggtaaaacttttttcaagacagcatctccaatgtcttccatttcagttttgtcctaatgatatatattagctgctggaagcacatgcaggttccacaatttaaaagatacagagatcacaatgctattgaacattacaagatgttccaaagcatctcattctgaccatgtctagcaaagtgagcaaaccactgaagaatgtaaatgggagtaacatgtccgtctaaatccaaataagtggttggttagcacacacctcttctgtaattcatgtcgtcgttttctttcgagaaaatgctgtagtgcacgctttgcaagaagaaagacaccaaatgctgcaaatcccatggaagcaagctggtataacctgttgtagtaaaacacactattagcctcaagaagcctaaaaagagagagaatattctactgcatcttcatacttggcccatttcccaagattcatgataagttgatcgatgcttttcggggatacataaaatggtcctttgtgtggtcgctgaattcgaatagttccaacatcatctttaatggcctattcatacaacataagaatcaaaaacgaaagcaagacttagccatgtaaaggaaaatagggcaccaacacaaggcattgcagacgaattaaagctatgaattacctcaccaacaacagtcaatgaagttccagttggaagaaccctttcagttctcttgactccaagcatctacaagcattatttcttaaacatgaataatactactacaagcattta

SEQ ID NO: 73412 - DNA, 6553 bp, Oryza sativa
gacactatagaatactcaagctttgacgatataggtatcacaaatgtctagcgtgatccatgccacttcatctaccatgagtgctgtcatgtgaaaggagatttcttcgacccagagggtgccctagcggcaagtgacgaattcaaggatcttcgggagtggaacactgctatgccataatgtaactacatggcgtatttgaagtgacaatgtaaaaaaatattttaatatatatatatatatatatatatatatatattggcaacacctttgagttatgcaatatatgtagatttctcagtaccaaatgcttgataatcttccactatatgtacataataatctacctgcaagaatttctattaaataatttaaaagtaatttacgggcaaattattattaaatttcaatattttctacctatcttcgcaggcggaagttttttttttttgctggcggtcgattcctattttcgaaggcggaccggagtagccaacgtccgcctgcgaaaactgcgaagatcggcgatcttcacagtcgttggcttacaatcggacggccgccccgcctgcgaagacccttttcggccgcttgcgataatgcttttcctagtagtgagtcggaaatgagcgaaatttcagtccgaaatttcccaccctggcagcgagttacaaacaagtggataactcacgtttgccttgtggaaacaacccaagaaataagaaaatatatatgtgtggcactttaggaggaaattgaggaagacaggaagtgcatcattaataaggccgcggacgggataacttggcattggacaccagacactgaatactcaaccacaaaagctagctgaccggatacagttcatcggataattatgctgtccgttttattatattggtaaagcaggacactgcatggacatgggaacatcaacacgaacacacgagcaccttaaaaaacatagagtagttgtttcgtgtataataataaacttgctaagctttcaaatcccgatgtgtagaaattaaatcgatcgaacgcgaattcttcccctatgcatcgtccatggatcgattagtgccctctaccaggtattggcgggcaggattgctggaaagccgctacaaatgacaaagaaggcatttaattagctagaaaagcgaaaggcgtaatttgcagtaaaaccaatcttgcgtccactggaaatagcaacaaagaaaaaaaaaagaaatatcagcagtgccagcttacggttgtttgcgcaggtgcttggtccacttcgtccgaggatgccgccgacagaaaccagtataacgaggaggacgacaagcagctgaacggaggtcgagtagttctttgccattgttactgacacgcagtatgtgctttctgtgtttggagaggcgatcgagttatgccgaagaattcgtgggtgctcgatgctccaaatgcaataccagttccagcacttataaaggcgtagccttagcctccatgcattcaaccagtaacggatccatctttaatttggctggaagttggttaggtggaaatgtgcaagaaggaacttgctggtcgactgaggtaattccttaattcacgttaattgccttctagagaaaatactggtttcaaaaagagtaaatgcacggaaggcacttaaatataccatttacgttccttaacactccaaggctgtattcgttggtgggtgttagggacccatctcacacgcacggaaaacagagcgattcattagcacgtgattaattaagtattagctgatttattttttaaaaatggatcaatatgattttttgaagcaactttcgtatataaactttttgaaaaaaaaatacaccgtttagcagtttgagaagcgtacacgtggaaaatgaggcgaaggagttggaaccacacagccaaaggctgtattcttccccctactttcctacttcctccgtcccttaggttgtattctttcccctactttctccatcccaaaatgttgctatctacccatcctaggataacaaatttggacataacatttatccagattcgctgtcttaggatgggtcaaatcccatcttagctagcaacattttgggagggaggaagtaactaacctccctctttttccgtacgcatgcttttcaaagtgttaaacggtacatttttttcaaaagttttctacaggaaagttgctttaaaaaaatcatattaatccatttttgtagtttttataggctaatacttaattaatcgcgtattaacgggcaacactatttttttgcagggaggtggagaactcagcccaaatgcgttttcagaattccgaacatgtcttgggtgtgatacaggtccaagcaggtgccagttcgctatatacacttgcgtggcatgctacagcggcgtctacgtgtcagtgacatagaatttttttaaaaacaataaatatttcttctctctaccttaattctttatatttatatatatatatatatatatatatatatatatatatatatatatatatagtctcctctacctaagaggaaaaatattttcaaaatttatcttttatataaaactgatatatgggtcccatcgaatatgtaggcaccacccaaacatgacacgttaacgtacggagcgggttggagcccgtttaaacatatatattcaagagcaccaaaatttaatttgagagtttatatatgtaactagatgacaaaaccgctcaagtttaataactacccaggtacttcactctttcgaaaaatacctcaacgacttaatttgtgaagcaaacgaccagtatccagtatctactacttgtcgataattattagtacttggtaacagagggatatttctctttaatcttccaaaccataggtggcatgtcaaatcaagcacagtcaacttacgtactcgatccggtcaccgtatcagtcagcttcaatacaagatccacaatactgaaatggaattttgggtggttttgcatggttggtgggtggcttcagctgtgccttcgtggaaaaaactgtatgtggccgacatgataaaattatcttacgtggaagtttggacacaaatcatccgattgagaacgcacgcgccttgccttgacttccacaaattaaggtttgttggcatatctgggcaaattcgagttgggtgcatacatgttattagctaactggctaaagtgtacttaccaaccataactggaaattgcccgtgcattacaacacaaatgtacaattttacaatgagtattaaaattaaaaataagaaaaaaaatgcaaatacaaaacgtggttacaacactatgtgcctattatattcatgcattccaataagttgccacaagtgcagatcgaccacagaatggcattgggagaggtaaatattagcgaagatcacccaagtcagtcatggcgaattcgtcatgaaggtgcgtcgataggccagagtagactagaggatgaggccatcaggataacatcacgccgcgacaccgccttgctctgagcatcggcaccaaagagcccgacggcctcctgcactcccacatcatccttcacattgtcgccgtcatttcacttcatcaactcactgctagatttcaacttcccctcttctccacaatctttagcgacacgagccgttggaccattgccaatgcccttgctggcacacgacatcctttgcatcggccgccaacccgatccaccaccctttctccatccccgcggctacgaaactgtcggtggcaccttgccgcccataggtaccctcctgccaccactggtcttcctcccactatgctagatctacccatctatgatagcctatctgtaacggactgaggtgccttgtcacagatgacatcatctataacgggttcaaccgaagcccgttcaagataaggctatgagacacggccagttataggtgtaagtaattgatctatatgtgcacttgatagacaataccactaatgggtacatatgtaggcccatcaaagattaaatgttatctctaacggatcttttttcaccagtcactaacagagactatcgacaataaaatcatttttaatatctctccaccctctctctctcagtctccccccctcccccttctctcgtactctcttcctctcagcacgtgaaactggtggatgacggcattggcataggcagcgggagatcggggacggagctagagtcgatgggtccgcggggtcgaaggccacgctggtgcctgcaggagcttggggttgtaggcagcactacttagaggcacagggcgagacggagagggcggcgaagggcaggaatggcacatctggccgactcatcatccctagaaagggaaatggggagggaggcgcacggggagacagatgcggctgggtggcgggacgagagctcgccatcctcatcttaactgcctccgccattgtctctatctccctagcagctgccaatctcggggtagcctccaacaaccctcaagcttagggtggcctgattaggtggctcccaagctcgtgatggtggtcggctgcttggatccgttgccccctagccagatccactccattgccccatccccctctatttctaatgaatgtgtagtgtgatgattgagatcacgacgtgttgtttctgatgaatgtgtattttggatgtttttgtgattgtgaattcgtgatgaagtttttgtgattgtgatgaatctggtgatgtttatgatctaaatattatcttcaaaatgtgattagtggggtggaacatatgcagggatgatgagcggtgaggaccgagcgcacagcgtgcaccatattttttgggttattcacacttgtgacgggtcacaaagatatttatttgattttttttttggtttatcacatcactagcaggctagaacttaggagtaatttgagagatagtttaccagtgacgggctagaacttagcgagaatgctcagtcttaggcgcccgatgtgagccaaaaatatcaggcgcccttccgcgtcgtcccattccgcgtgcgctgcatcttctcctctgtctccctcgctcgcgtcgcctcctcccccaagcttcctaccagcactgtctcctctccctcatgctctcttgcccacactaccctctcccccgttaacctcgcccacgccaccttctcttccccgggcgacctcgcacggctgctctcctgccccgtcgcgcggccctcctcttctggtccgccgtccgacggttcagggcggagtcgctgctgcttcctatcgagcgctgcagcggaggcgccggcaggacgcgagggggcggtggcagtcaccgccgtggcggtcaggggtctaggctgggccggtggatggtgcccccttccctcgtgtactccggcgtggtggctgacgcctagcgctcgacaggaaggccgtaccatataccatgtactatgtagatctaggttttcctcttgattttttatgtttcagtccatgtaccatgatgtttcatcagttagatttgaaacgttgcaatgttagttttcgattatgttccattctttttctggatgtaatatgtttcagtatattcggaaccgttgattcatacattgtagcaaaatatttcgttgtgtgatttgattgtgtttcaccactttcagcaccgaaacatttttaattcgatggtgtttcattctttttcttgatgtactcggatttgtttcatgtttcaatatattcgaaactgttatttcatatgttgtattaaaatatttcattgtatgatttgattgtgttttagctttttaaaagattaaaatattttcgatctacttggtgaaacagcgtccgatttttgacaaaaatatcaggcgtccgatttgtagacacctcgagaacttaggagccatatgagagatagataccagcgtcaatgaccagcgtagtgtccacttccaccattcctctaaagtcactctcaccacccttttatgcccttcatctgtctgttttctgccatagttcagacttcagacatacccagtcaacatggaagttattgccggcgttgctggtcagtcgtctcctgccatgtccctctgtctttctcatgcctctgcttggctggagctagaagacaacatgatggccctcagatcaattacaaattaggccgagtttagtcccaaactttttctttaaactttcaacttttctatcacatcaaaactttcctacacacacaaactttcaacttttccgtcacatcattccaatcttaaccaaacttccaattttagcgtgaactaaacacacccttaattactcgaaaagtctcagtcgactgcttattattagccaaggtgatgttagttaccttctagatcaaatacccgttccaaaaatacctcaacaacttgatctgtgcacttgtggacaatttctagtacttagaaacctactactacctttgttttaggttataagactttttagcattgcccacattca

SEQ ID NO: 73413 - DNA, 18093 bp, Oryza sativa
attatattaaagtagtattgagcatctaagaacctaatatgcaatttatgatactaaaagagctctaaatagtatgttaaaagaatcaagctcctttcctttattttcttgagaagccatttgtgctcaatattaaaaaaactcttttgctaccttaaaattgggttcatcagctttttaacaaataatctagatgatgaggtcttgtcattaggtttacatggaggagctcgatgtaggtagggttaggctatggggctgacaaacaaggtttatacacagaacaagctatatcagcaagattattacagaagtccagacatccatatgacattagatggttcatctactataaatccaagattgaataaatcagctgatatacagtcaccaagattggacacataatggcactgtttgatatcgagactaaactgaattacttgtttcaatagaaccaaagaaaattagtatataacaactacagcagttaattaccaggtaccatggaacttctttgctaacagaaagcatcacagcggaatcttgaatccatgatccagcatcgttgtgctttaggaagtgttgttctgcctaccagaggaaaatggttaagtaaaattgctaggatatgcttgccacaaaactaaaagaaaaggaaaccgtagaaatggaaccaatagataccgtttcctctactattacacctctcatgccactttgttggcagataagtggtgtatctgaaccaacccgtccagagactgccactacaagtggcaggaccttacttgcagtgtccaatatagcagctgttgaagacaatacagataggtcaaaacaaaactgacaaaaaggtagtattatgtatgtacctaattggacaaaattacaaaaacttcatttataaaaaaaaaaacagattgacacactacaataaagttataaattcttgtagtatcttaatgctggacttcaattaccacaacaactctcaggttttgaacgcgtgctacaagaacaaattgtgcttctctggagaaagtggtgacacagaggtctactgcttcatcactgaatctagatggacctgaaatattctcctaacactttatctcatgcatcactaggattgaattagctcgaagcataaaaatttccccaaaagccacgtacacggtacattaacctcaatacaataaattaacaaaaccgcagagtaatagaattactgcagaatccagctaattaagcacgtatttagcagacacccaacaaaacatcaaaccaaaccaaaccctcgctcgctcgctcacccaaatccttcgtgcttccggccctcgccaccgatcgcagcacctccgcatccctgagcaacaaatccccggtcagaaccaccaaaatccccccaaaaaatcgcccaaaaaaatgccgccctgcaaaaatcccgcacctgccgctgctcctcccgaggagatacagcgccgcggcgctgaggcagcacccgactccgccccatgggatcaacatctcgcaaggaatcgccaggcgagcaccgaatccggggggggggggagatcagtgaggaggaggacgacgaggagatgaagccgtgaaattttatttttattttcccccctttttcgcggcgagggaagaggaggaggcggcggggagggggaccgggaggcaagcaaagaacaggatacgaggagtgcaccggcctcggtgggggtgggcctcacatgtcagtgagtacattccctgacatgcgggccccgcagggatatgccacggcccctattagatactggcccagaagcgcttttagtaagacttggccctagggcctgtttgagggagcagcaggagctacaacaaagcttcccaaactatccgatttccatgtagagaatgtatatggagaattcagaaaataaactataatttaaaagctgagacttctagtttttctagtttttcgctagctgtttcttagaaccttaagctaccaaaatggagtatgaccttagttagttttggtagtcagccacagttactcttataatcaaaaacttgcttaaatatttttcttaagattctaaaaaactattgttgtgaaatccataaaataaactaaaattgaaaagttagaagattttaaaaaactactgtatctactaatcggttgtttctcgtaatcttaaccttcggcataggtagggcgagctcctctcgcttacatgtggggcctggtcaacctcggtggttcgaacgctgcaagtgggacccacctagggttttaagaggaggagattctcgtcggcggcggcggcgggcaaaggttagccatggagaaggcgaagctctcgtcggcgctcttcgccggcacgcacttcgaccgcaagcgcttcgccggcgacttcgcccggttccggcaaggcccgcctgccccagacgtggcctccgccgccgcgccgtcgccggagaagaagcggaagcgccagagcaaggccaaggcgaagaagagcaagaagaggcgggcggaaggcgccgactctgcttccggtgagttcttcttctcaagaggttgttgctttttgggagtgtaatctgactctgactactctgtcgagtgttgtacgctttgcagatgctgtggaagggttcagtgtgttcaagggattggcagcaaagaaggatgaggacgattcggagaagaaggtcgagactggtaagagtgaggactcggaggttgtaaggcggaggaaggaagtcgagagagaaatcgaggtaatggcgttttgcaaatccgttgagctagctgtgtctctctttcgcaaaattgtgcttatgtaaaatatttgaaaaaaatgtttatcatccagcaactatcttggattagaaataatggcagaaattaacatttcggtgtgttcggtttgcatgtgttggattggtttgcagagagcggcaatactacggaagaagtttgatattcacatttcaggacaaaatgttccagcaccgctagagaactttgaagaactggtttcaaggttagtatctgaataattcaaagagttcagacatactaaattctttattataggtgctgctacatattaacttcaacacatcatggtaccgtctgaggtggattttaacctacctgattttgtgcactaggtatggttgcgactcatatttggttggaaacttgtcaaaacttggatttcaagaacctacacctatccaaaggcaggccattccaattcttctatccgtaagtcattttgactctgtttggatatttttccccctagtgattgaaaattttagttttttagggtcatatatctgaaattgctttgtttcaggggagagagtgctttgcctgtgcacctacaggttctggcaagactttggctttcttgttcccaatccttatgaaaatcaaggtatttatctttgtgatattgttttatgctgtttgtatgtgttgtacttgtacattctttttaagccatgttgttatagccaggatctaaagagggtgttaaagctgtgattctttgcccaacaagggaattggcagcacaaaccacaagagagtgcaagaagttagcaaaaggaagaaagttttatattaaactaatgacaaaagatctatcaaaatctgggaatttcaaggatatgcattgtgacatcctgatctccaccccacttcgtctggaccacgctgtacaaaaaagagaccttgatttaagtaggtctgtgatcataccttcattattttgatttgcacactactacctgttagaagctaaacttgatacattatgaactctgtctaatggtttatcatgagtttcaaccttggaatcccgatttctaacatttttgttggaaagcgaatgcatgcataccaatccggataataatggtatttagtaatgaagtgatggtttacctgctagaagctacacttggtacattatgactctgtctagtggattatcatgattttcaaccttggaattccatattctaacgtttttattggaaagtgaatgcacgtatttagtcatgaatgttagctttttagtggaaggtaaaattccttcactatattaccctgaaaacaatcttaagtgtttattcatctcaaaaaatactatagagcctgtgccttgttaattcccaccaatttacttacgaaatggaaatttaattagatcaattcaaccgtcccttagtggcatcacaactatatgtctgcatgccatttataaaggaatgacaggttgcaattttcgccattgtttttctttttattcgtgggcacccagttcgatttaacagtaacatatgctgtctttcagagtggaataccttgtcttggatgaatctgataaactttttgagcttggatttgttgaagtgattgattcagttgtcaaagcctgctcgaatccttcaataattcgatctctgtttagtgccacattgcctgattcaatagaaacgcttgcacgcacgataatgcacgatgctgttcgagtcatcgtgggaagaaagtaagtattgctttcacagtgtgtactgcgaaaactattttttcagggttatttttgtcattaattcttcacatacaggaattcagcctcttcactgattaagcaaaagttgattttcgctggaactgagaaggggaagttgctagctcttcgccaaagctttgcagaagtaagccatgatccttctctgatggttttctcctagtttccatcttgctgtttccgagagctgattaaacaatttcaactgtagtctctcaatcctccagtattgatctttgttcaaagcaaagagagggcaaaagaactttacaaagaactggcatttgatgacgtaagagctgatgtaattcatgcggaccttgatgaggagcaggtatcacttaatatcatttttagttgctaataaatgtttgtggtagttttgttttcactgctacacttggctcaatttctatctcctcactgaagcgtcaagatgctgttgacaacttgagagccggaaagacttgggtactgatagctaccgaagtcattgcccggggaatggatttcaaaggtgttaactgcgttatcaactatgattttccagagtcagcttctgcctatattcaccgaataggtaagtatctggctttgacaggctacacgcacccgtctgtgcatttttgtgaatgatgtcttgtacataagcatctgcgtggaaggcctgagttctgatgggcatttgattggttggatactgattatatggtcctcttttcaaatttatattattgttattttgcctgttaggcttgtttaaatttacattccagtctgataatgtagccagatatatcatatacctctattgatcagtttagttcagtttcatgtatatgcaattttttctctcttatgaaagacctggcatcatgtttttcttccgccatctcatgattcatgaactaactagggaaaaaaaaaactcctttcttgttatataggacgatctggaagagcaggtagatcaggggaggccatcacattcttcaccgaggaggataagccattcttgcggaacatcgcaaatgtgctgatatcttcaggctgcgaggttccttcttggataaaggcattgcctaaactcaagcgcaagaagcacagggtgaaccgggatcccatctccacattaccagacgaagattgagtttccctgtaacgtttctagatgaagattgagtttccctgtaacgtttctagatggcaccttggcttcagttttcctgtttgaatgccagaaactgctgcctctattagttttgttgactgaagcctgagatgagaatacacttgccttttgttatttacagttttgactgatcaattgaatagattatttctgaatttacaattagattcatcgcatatcccaacatacaaccaatcacaggcatttaccattttcagtctgtcctgtggtcatttgttaactgtcttgcagagcctgcatgatctccatggcatcatctacaagtgaggccagagttgagctgtgcctgctcagcccaatgctgccagagaacatgttgaagctctcgagctcggacgtcgacctgacgacgctcctgagctccttctccagctccatgctcctgaagaaggggacgagctcggcgtcgcctctcatcatggcgatggcgagctcgatgacgaaccttctcatcctcggaaccttcaccctgggtgtcctgtgctctttcagaatctccactagcctccctgcaatgtctgtatctggtacacctgcctttccaaagatttccttgtgaaattcaggtgttgcaagccttgtaatctgtattgccaatcctatagacacctcaagcaagctgctcttctcaaccataattgctttgaacacctgtgaaatcatgtagcagacatcattcatcaaatcatagcaacgatgtctactgaagaatgaaataagtgatcttgttctagagaatctattctatgcccttgagtttactctagttaaatgttttttattggtttctttgatttgtttcaaaagaacatcaacacaggaattctctcatggttgcagtgacatgagtagcacttcatggttctgagttcaagtctctataggagcgaatttcagtttgggttatttgagggctaaattccctgtttgataggttaagttcccaattaaaaaggctatatatatccggttggatgtagaggctacggccttgtttagttctaaattttttcttcaaactttcaacttttccatcacatcaaaactttcctacacacataaacttccaacttttccatcacattgtttcaatttcaaccaaacttccaattttagcgtgaactaaactcagcctaggtaaaaattacccttctctaaaaaaaaagaattctcatccttttttggttggtttttgagaactttctattgggacagctaagttccctattaaaaaggctatatatatctggttagatgtagaggctaggtaaaaattacccttctaaaaaaagaattctctcatattttttggttggtttttgagaacttactattgggacagctgcagtgaggctgctgagctgcaagaagtggtcgctcctgctgtacctgcacaggttcagtaggattctggatgacgtgatctgcagcccggggtggtgcagcgtcatcaccagcctctcgacgacggcggcttcccggagtatccggtcgcagttggcggcgctctcgagggcgagcagcgccaccacctcgccggcctgcagcctgatgtgcgccgccccctgcgccgcgtaggcgaccgccggagccgactccggcgagccggcgaacatgtccagcagatgcgcgatcatgtcgcccgtgcagccgatcttctccttggcgtcgccgtcgatggcgaggtcggcgaggacgccgatcgccgtcagctgcatcttgccgtggcgctcgccgccgtgctggagcaccttgcggatgttgccgaggacgaacacgttgtcggagatctccctcctgatcgcctcgccggtgtgccccggcgtgctcgagaggttcttcaccacctgcagcgaccggagcaccgtcttcgccggcaggctcccctcgccgccggcgcagatctgcagcgccgccctgctcgtccgggtgaagtgtatgatcctggagaggacaccccttgtgctcgagatcttcgccgcgttgccgtgctcgcgcgccagcttcttcatgatgtggagccccatctcgttcatggcgaggtcgccggcggcggcgtcggtggtgggggtctcgagtaaggtggagatggactcgatggcgccggggatggtggcgacgcggatgaggttgcggcgcttgccggcgaggcggaggacgacctcggcggcgagcgacctgacgcggcgcttgctggggctcttccagctcaccatctccaccagccgctcgacggtggccgccgacgtgccgatcttgcgcaccgcccgcctcgccgagtcgcggttggcgatggagccccggaggatgtgcgcgccgatgagctgctcgtcgccggagtccgatgagaggagctcgacggcgaaggagacgaggtccatccgcgtggcgtcgaggatgccgccctcgaccgacctcgagaaggcgcggtagaagaaccgcttgatcggcaccacgccggcgtcgccgaggtcgcactcgccgctcaccgcctcgaccaggcgccgatagctgagcacccactcccagtacgcgcgctccaccaggaagatcaccgcctccgacagcgcgagcacgtagaacagcatcagcgcgtagtacgcgttcttgttgccgccgccgccattgtcgccggcgaagcggagcgtggcgaggcgcagcagcgacagcgcgacgcacgccgacgccgagaggagctggagccagtagaggacgtagctcacgttcctcgcctcgacgagccagccgccgagggggaggaggtggatgggcgaggccgccgccgccgccttgtgcggcggcggcgggtcgtcgtcgtcgtctccggcggcggcggcggcggcgtccgggaggtgcatcggctgctcctgcagatcgagctcgttgctccggctgaacaccctcgtcccctcgacgaggaggatggcggtgacgagccagaagtcccgggcgtcgaggtcggcggcgaacccgccgaggatgaccaccgtcgcccacacgaagcagacggcgccgacgtgcgacgcggccttctcgagcaccgcgacgtggagcgcgaacgccgtcaccttgcgctccggcaccacgtcgtcgacgccgccgccgtcgtcggaggcggtggcggcgtgcatggacgagacctggtgctccaccggccgccgctgcggctcgtacgacgacgccgtcgagtcgccggtgtgcgttctccggtgcctcgccgtcgccgtcgccgtcggcggcggcaacggcggcggctgcactagtatttgcatgggaatgtccacgccgccggcgccggcgccgccgccatgatcagccgtagtgtcgatggccattagccttgtattcccgagtgcgtgcacaagtgcacttggggtttaatttccatggttttttgcatggtgatgttataaggttggagctgattgggcgggaggctaatttttcatctaaattaattttgctggatcttgtgtgaaagcaatcagaagagaaagatgaaatgagattcgtgtggcttcaacgtgcaagaaacaaagtttcatcaagttcagatacacgctcgagtagattacaagttgtttattgcattcctgcgcaatgcaatggagcaaaagctgtgtttaccttgccggttttcaagttgtttaacctgcaggttacatcatcttgtgtcatgtaatgttgagacttgctgaacttctcatgttacagtgcagtagccaagacatgtttgattttgattgttggaaggattattggtgagaattatctataatcaaatatttattaataaaaataataaatagagcaaatagtccataatccatttcaataatcagtaaataaaatctttatagacaacctttcaccgtttcacgcaacagtcattttcagaggtttacataccattgccaactctataactgcttctcgtacactcagattgcatctcaatcaacttgtttttaatctccaaattaagaggatcctcttcattcaaccattctcttagactagatcacataacatttctcggattttatatatacatgttacttgatcatgggtacgtcaagcaatcctatgtctgagtcaacaggcaaaatgacttcatttgataaatccagaagccaaaacaatcatccgggttgcttatctgaacactgccgggtagctgaagacctacgggttcaggctttatacatgcagaattcagtgtattctttaagcagaaaccgtacccgtagcttcaggaatggaagagtacatttcgtgccgcgcaacgaggaaatcattctccggccgtacggtgttccacgcccggtaggccggcggcgccgccgcaaccaatgaccaatcaccaaatccaacacctctggagtttggagtttactctgcatccaaacaaacaaattcaattgaatttcagtgcatcgaattctactgagaaaccggcagcaattacaataaaaaggtaactcttgtactacacatcactcctcatggttcatggactttggcaatttagcaccacttgacaataagtaataacatgatggtatattttacctcttccgtttgttttttttctgtaatgcgtacaactcttaggtagatagagaggaagatgccatcagctgtgacattttcctagaagatgaacattggcatgtcagtcaagaaaactatgctccagctctatcgggagaataatacaaataaagggaacttcgcatgcgtagtaatcgaagttgctgctgactcatcattggattaaccggtgctctcgtgtcagctgtctcctgattgcctacaaccctgccccttcaggaggtatactttagaaagtgcatcagtattcttcgtagcatatacagaattccagatagatacatcaaagaacctgaactgattcatgagtatgtcgacacaaacagagaatgtactggtagatgtagcagagagagttgcccaacctgaggcgagctggcatagcgcgatgccagaagagcagctgaattgctttgttcaagttgttgcctccgttgagagggtgggcaacgccctcggcacactggcgttcacctgggccaccgttgtcctccttggaggatacccaactagtatcacctgtgtggactttgcgtacgccacagcattgttcttcttagaagctgcaaggtatgcatcaatgatcagtcacatgtgataatgttagtcacaaacctgtgtactcatgttatcactacacttagcattcgtaagaccatgatcagattatctagtacttagcaatttatcaagtccaaaaggattgttgttcatttggttgatatatcatcctgtttttctcggtttccatgtgatgcaccgtgcatattttcaggatgttctgccccaacagatcagagtaccaacttttcttcaggactcgcggagctttgagacctttctcatggaatagagtgattgtggtgatatgtttgaataatgttggtttattcctcccaagcaccaaaagtaaagaattgtcggtttccatattgatgcttgttgctgccaccttgcctttcccaggagttcacaaacttaaaggtggtccattacgcaatgctatatcactattgagccccttggttgtaatggtgctgttgatcccctgtctatggtgcaaagatacaacaccagcaccaaaatggcatttgctactcctagctagggccttttacacactgttactggtcatggtgttgctactaacgatcagcaaattgcagtttccaagcatcgtcagactagttcataggcttgtcatccacaaatcattatcctgccaccaagtcagtttgttttcttgcatgtaccttgcagcagtgcccttggtgttcttttctccatttttgttagtaatgatggtattcgctctgttgacagcaatgtgtggcagtttacagattccagctgcagtcatgcgcatcgttattggatcgatctgccttttgcaccaagattattatggcaaaggtggccatgcaaataattctgacaagacaaacctcaagccaacacttaggctgcgttcgttgggtggagaaagagagagagtttgtttggttttccgcgcgcacgcttcccaaactactaaacggtgcgttttttacaaaaaatttctatagaaaagttgctttaaaaaatcatattaatctatttttaaaatttaaaatagttaatactcaattaatcatgagctaatggctcacctcgttttgcgtatcttcccaatctcctcaatccccttctcctcaaacactcccttaatgtcttctatggaatggtgctcggtcaagggatactatacattgtggctcgcataatggagtttttctcattctttcctcggagatcattgccccgtcgtggtgggttcaggggtcagcagggagtcaaatctcttgatatgtactacacacatgcatttgagaaatgtatgaacgctagcatccttgctccaaagaagttgaacctcaccaattttgccatggaatccctcgaatcagactcaaggaagaagcagctgtgcggggttcgaattctgtatagccttgtgaacagagagccctatgacaaacaagtcctgtcaaaagtcacaactccatgaagacggtcaccacactgatccaaatgctgggatggactaaccaagaagacaatcaaattagattgcttgccgcgaagattacagctgagcttgctagaggtctccagattgtcacaatccctggtgcaatgaactccatatcatcacttctggacaaccagaacaaacagcagatacaggaactcataattcagaaagacagtggtggtgaggagaattgctggatactcaaactttggcatcagatgactaaaaagtggtccattctagaggaggagcagtggacagaaactgatgttttcctggtacttggccttgtaactcttgagaggctagctacatatgatattgtcaactgcatggagatcagcagatcaatggacctcatcccaaagatcacagagttcacgagtaacaacagtgagagaatatgtgtcaatgagacaagtcagaaaatactgattgatttgtcattgaaggtgctgagaagactggcaagcattggtggggaaactggtataacattgaggcacaagatatcagaagatcccttcctacttggcaaccttgctgagattttggaggatagcaagagcagtcaggaactgaggaagttgacaatagatatccttataaaacttgccatggatgagactacaaagagagagattgggagcatccaggtgattgttcagatgttgatgtttgcattcactgcgcaagatgatctgccaggtgcatattctgactgctcgatgacaatgaaagcaggacaagcattgtcaatgctaacactagaaagtgcagacaactgctcagctatcatgaaggaacctgggcatagattctttaaggatgtggcaagaatgctagtgcatgacaacaggtacatacatgttgcagcaaatgtactgcaaaacctgtgcaaacactctagagttgagctaggagattcagttttggtggaactttccagtgtcctactagaggtgagatctccacctatgtatgataatatttggcatattttttttaaaaaaaaacaatgagaagcacaggagggctttggccccattctaaactacaactttctcgtcttccgttagcacgcttcccaaattgttaaacggtgtgtcttttgtacaagatttctatataaaagtttcttaaataaattaaataaatccaattttcaagcttgcaataattaatacttgactaatcatgcgttattgacttgtctcgattcgcatgccgcaaaaaaaggttgtcccaaacatattttgtatgaagaaggggctgagaaaccaaaattttagcttcttatttaggatatctgttttcaccagatatttgattctagagtctaacttacatgatgctgcgttataccgtctacaggtgttgggacaagtaatggatgcagagggaaaagaactcgaggtccttgttggcctcagttcacaaatatgcagggttagtcctaaaagcttttcaaaagcgctagaacagggtcagaaggaggcaagattcgtggagaagctaatcaatggactaaatgcgaatatgaaacccaatccacagtttccaggaatcagaagtgtgatagttgagcagtgtatatacatgatggagctgagctctcgttatgcaacatatttcagaaatcatgaattgatggaagcattaataagggtggagaagacaccatcaagggctgaaaaatacaggcttttcttgggcaacacagggctcattgagcacagagtgaatctgtcctctcttgtggagagggcaaaacagttgatggccgtgcattcaactcaacagccttgagaatccaattagattttcgatcatatttaccactagcctttggatcatcctggtccactaggatatctttgtaattcaaaatactgattggcccagaaaacactggtgctaagctctggctaataatttatctgtacagtttaaacttgatcctttttaaaaaaggactatagagaaataaacaaaacaaacaaatgcacataaagattcttaggcgcaaaaaggaaaaaaaaatcaaaattgcatgtttatttgacatacatcgagttcaatattcaacatttgttttattccccaatcaaagtgatcatgtcaattgaactgttaagcaactatcccaaatggtgtactgataaatactctatgattcctaacctattttgttttcttggactaaatatcaaataaggcaagtttggcataaatgatcctgtaaataagtgatgaataagagaatattctgacattaacacggatgggtctgttttttctaatggtcaggccgttgccgacgttttatataaaagaagaaagtgtctcattttaagaaaaaaaaacatgacaaaaccttacaatgcacggtaaattaggggaaactgcacgaaaaccacaactcaccaccaactaacctaatcagccatggcagcgaaaataggagttacagtaccactagcaccacacagttctgatgttcgaagtaaatcctgaagtataccgtatatattcagcagaaaaactcaacagtttctgtcgcgagcatgggggacggttcttgttgactatagaagaacggatatggcttatctggtccctgcagctagtatagcaagttcaatttgagcaggagtgagtgggtctgtgagtgcttccgtcactgctcgtatgaacaagaacaacgatggaaggtgaatggctggtgcactcactctatgctccatgtgaatttgtgaaatttgggttttgctgcccgagtggctggggcctagtcgctcgcccccggcagcatctgatcccacttcctcttgtgaaaattttttatattcatcgtgaggtccaagtgtgcggcgcactaggcagcaaattaaattaatcccccaaaataatatactactccctccgtttacaatataagtcattctagcatttctcacattaatattgatgctaatgaatttagacatgtatatttatctagattcattagcatcaatatgaatgtataaaatgctaaaataacttatattctaaaacggagaaattactaatttgcaccgaactagtactagaagagagcaaaagcaccgcttaaacggttgaaccctagctaatattcgggtgcctttcacacacccccttaaacaaaatcgccaaaaatgcttttcatgatgtatgaggaaacctaagatttcgaggttgggaaaaaccaaatccgcaggagcggacggggaatcgagacctaatctcccccgcggatctaggccccaagcatttgggcgcggcgcggcaaaattaataccgaatcgaatcgaattttttttcgatcgaaaccgcgatcgagaggaaaaaaaaaaggaatgcatcggaggaacacggaagggaagcaatcgactcaccgtgctccttgcagaggccagagcgggggctctgcgacctgcgagcggtcacatcgcagagatcatggagacacagtgaaactaaaggcagcccgtctctctcacagtctcactctttagcaaattttaccaaaacgtccatgtgctctgcagaaaaaaaaatggaattttccttctctcctttttttttcaagtggtttgaaattgacctctggcaaaaattaacgagctatataaattttttttgaggaagataatgctttattgatcattttaaaagttggatacaattacgatcagcagctctctagtatataggggagcttgcatatgccacgcacgcaatgagctatataattttttttatttgttttctagcatgtcttttataaacttgtaatggtgcaatgagtatttgcacatatattcactctcctatttttttttgttttaaatatttgtcacttgtaactaattacaatactttgaacactgatgttacaatactttgaacactgataaattttaagtagttaaatcatgatatatacttaattaatggagtacttcaaattttatatgttttcttcgaaggtcaaaatgatcaaaaaatagtatatagactatttggagacagagggagaattgctttagagttttattaaagaaagaaaaatgatacttgctaacttatagaaaaacttcttcaacccttaccgttaggcacacaaacaatatgtcatgactctctgaaaggcctagttaagcaacaaaatacatcatgcgatattgatacatatagtaattgctgtcgataaaagaaaactcatgtatgctcgagaacacgagtcagctatcaaactctgtcaaaagcgtaactttttgaagctagtcctactgctgttgaagatgcagaggactaagaacatccccagcagttccggcatcccatcttccatccagaaaatggcgtatggggggagaaaatccggctccaacggatacgccatctgggcctccatagatggtacatgcgctattcttggcgtttctctctcctcacgccatcctgcaaccaccgctcccatccgttctactgccctcatccgaatcgagatcgaggcagagggtgaagcagtgaaggtagatcgaggagagaggatgaggcaaatcttcgtcggccgctcccgccgtcgaccaccttcggccgcgccgcccttctgctcccaccgccagtctgcccagccgtcggcgagccgctcgcgccgcgccctccgctccgctcccaccggcggtcggcggcggcgagccgctcgtgccacccctccgctcctccgcccttcgctcgcgtctctcgatctctctggagtgacagagagatcgtgtgaaagagaagataatgatgaaaaaagaaaaaaagaaaaataatattaattgatagtagttgaaagatactattaaaatataggaggatgtgatatagatgatgtaatatagatgatttgttagagtggagagaaatatgaaagaggaatcttttttggataaccatctatatagccatatgaaagatcaaatttggacgagctgctggggatgctataaggtgatacaaaatatgaatttccacgctgcctttgcacccctagtagtattattgaggactaagaagactacttgtgttctttagtatggattgggatcgaatcactcgcatacgaaaaacagagtgatatattatagcacataattaattaaatattagttaaaaacttatataatgaatttatatgattttaaagcaactttttatatattctttttaagaaagcacaccatttaaccctttgataaacacatacggaaaagtaagtgagtgaagattgagaaacttaactacagacacatcctatgtttaggaagaaacgtggagtagggcacatggtgtctattttcttgaaaaaaagagagggggcccatcctcaatccttaccaacgaaggggcaaatagtcaaattccccccagctaagctgcgcagcctcccttcctgcctgcgcctgcgctaccgtagtcggcctccctctgactcttttgctcccccctccctagtttaccctagtcgatctccccccccccccttccccctc

SEQ ID NO: 73414 - DNA, 82687 bp, Oryza sativa
cacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagttgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaaatatacaagagaacaaattaagttacgagacaagctaagtttgtacgtgttgattaattatcttattaacatcgatctgcctctcttttctatggagaatttcaggaattaatccaccatatttctgtatgcagtcatgcatatatagatgcatgcaagagttaaggaacgaggcggccgggtgcctttgaccaccagcagtgcagctctggtagcttcatatatactcgactcgatcgtagcttgcgaccacggcacgctagctatatactcccaagtgaagtgctgttgcactcaacggaaagagaagattttgatggcttaatttgtcgtggtcaccacgatcatgatcatccatctcacaattcatgcagctctacatgcatggaacgaccggtctagctagccatttctttttccccctttattttttccatggaataattaaacaatcctagagtctcttcatcaaagtagacgttgatataaagaccgtttctcttctccagcaataatatgcatgtatttaaatatttataattatatacgtacttattgtttatgctccaaatgattgtcttccacaccctgcaggttttgcttatcatttatgtatatgtgctgccatattgcaatcatctgccaataaaaaaaatgcaacttgctgatagcccattgcactttgcacaagacgacaattaaacaaggaaaatccacgtgtatatatgattaaccaccatatatatagttgattatgattttattatgtggcgttctagctttgatcggctgcgacgacatatatgcatgtacacggatgacttgaccaaatgactgccgtaaaaggacagactacccggccggttcgatctaaaattagacgataagaacaaaccaactgaccagtagtaatacgttgagagaggacgtacgacaaaacaattaacatgtgtttcaaataaaatatatactcccctttcctaaatatttgacgccgttgactttttaaaacatgtttaactgttcatcttattcaaaaacttttgtaaaatatgtaaaactatatgtatacataaaaggtatattatttaacaatgaatcaaataggaaaagaattaataaatacttaaatttttaaataagatgaacggtcaaacatgtttaaaaaatcaactgtgtcaaatatttagaaacggatggaatatgtatcgaatagattaacctcgagctagctactggcagacataccattgacaggtcaatttatagaactcgatctcgatcgaaagatgaaccatgcatggtggccaccttttaattatcgtgacatgcacttggaaacccttttgatctcttaggaaagctagctgcagacaaagtagtgaactagctgtacactctgaataagtagttcatctcaagaagatagacgagaataagaagaagaaaactttcatgggagataacaacgtgatgtttatcctctcctatatattgaccatatatattattttctctcattggccagctaattattagcgtacgtatatatacggctctagatcgggcgccacgtacgtgttcggattaatctctagctggtaattgatttggtaataatagtgctgagatagatagatcagctggacaccagagtccgacgttccgttgaagcatcgctaatgtcgattagtacagttatggtcttccaaggtaaaaggacgtacggttagattaattgtgctcaatgatgaatacagccattcccttactgtttgctgcgtccagtttagattgtgacatgaagaattcaaggcctgcatatatatatgcgcataatatatataatgtcgtgtagaggaagcttcaatgtacctgtaaagatccttaaaccaacttgagccaactctcccatttactgttcttattttcaatcaagaaaaataccttcatataagggcaggtgttgtgtaatttagtttactagctagggcatgcttgaaagtcattcattttgcaagcttttcatatggaacaatttgatttaatttacgagcatgatcgatgagtgtttgcatgtttacacggatctgacaaattaacttgttctggaaacggtaaacaaattaaactgaacttttctacgaattaacagctgataacgaacgcatgttctgaacctaacttttcttttaaagataactatcttttgaacctaactagagggtccaagttagatagggaagttctgtaagtgcatccatcttgagatactaaggctaagcactaagctagcaggaagcaaggtcagttaagcatcagcagctagcagtagtgtagtacaacctggcttcctaagaaaaagatggccagccagacacatggttttgaatggttggctccggtaattaccaacgtgatcgatgtaataaatcgtgttgatcacagctggtaaaaaaaagagagagagatgaagattaatttggtgagtttcttgatttgggatctaacaggtgtcgacattggcgaggagcagatcacactagttactgccgacgggacacgtgtaggctggttgtggaagagacggttaaaaaccgtaagatacgccactcttccgagtccaatacggtgagtactaaagatctacgtattcctttcgtacgtacccagctagctagcttagctactgcctattattcgattgatgtttctttcacccgtgtgtgcgcgtgtctatgtctacgtaaaaacgtgctttcttttttgtggaaaaggaccttccaatgataaattgttgataaagccaaaccactaattagcatagctgcagtgacaactgacaagggcatacttcactcagtcagatatacagcccattgggccgtaaacacttgggtctcactcccgttcagactgtttgatggcccaggtgtatctcaagcccatacgacactagcttgggccttgatgggccgatacaccataacaacttgcgctcaaagtgggaataagtgcatccaaggtctcttaacttgtcaacgaattcgattttcatcctgcaaccacaaaaccagatacaacggatccctcaattatcaaaaccggtgcaatataagtcccatggtggtttggaaggcggttttggtttacgtggcgtctacgtggctaaattgacccggtcttcatctgacgtggcaatttgatttggaaattaataaaaagagtgaccccacatgtcagctacaccaaaagaattaattaaaaatggtggagcccacgtgggctccacttgtcattcactcccctaatcttcttcctcctctctctccccatctcccctctcctctctccaggagctggcggttcggcgacgcggccggccggcggcagcggagccagagatgacctcggagacgaggacgccggggagctgcgcctggacggggacgccggcggtgattgttgttactggactcagagttggtgttgttgttgttgagctcaccgtggtaggagctgagagggggagaaggagagatggggcggccgccgtgctgcgacaaggcaaacgtgaagaaggggccatggaaggcggaggaggacgcgcgccaagctgctagcgtacacctccacccatggcaccagcaactggacctccattcctcagcgagcaggtcgtgaaaatcaacgatatcgccattgctgctaatgggatcgagcttgaggtgcatttgatcatatcagatcagattaaaatatggtgtttttgtttatctcttctttttccctttcggcgatgcggcgtcaagggaggttcggcggccaacgatgccgcggcgaccccccgtctgacctcctcgccagcgtcgagtcggtcgcctccgccacctcctgcggcatccacgtctccaagttctccgtcagctttccccgacgacgaaccggactccggcttctcgcccgacgacccggacctcctgcgcaaccgccccgtccccgaccggctcctcgtcgtctccgccggcgtcgcagccaacctcctcttcgccttcctcatcatctacacccaggcgctcgccgtcggcgtccccgtccaggcgcagctccccggcgtcctcgtctccgaggtcatccctggctccgctgccgccggcctgccgcatcaccgaaccgccagctcctggagagaggagaggggagatagggagagaggaggaagaagatgaggagagtgaatgacaagtggggcccatgtggaccacaccatttttaattaattcttttggtgtagctgacatgtggggttactctttttattaatttccaaatcaaattgccacgtcaatgccacatctatgccacgtcagatgaagaccaggtcaatttagacacgtaggtgccacgtaagccaaaaccaccatccaaaccgccatgggacctatattgcaccggttttgatagttgagggacccgttgtatctggttttgtggttaagggatgaaaattggatttgttgacaagttaagggaccttggatgaacttattccctcaaagtctcaatttgtcgccagattttcgtccttaaccaaaaatacaatccctcaacttacaaaacctatacaaataaggttcatacatagctcttttgactaggctgcttcatcctacgtggaattgacgtgacgcttacacgacaatttaatccggagaacaacaaaaggagctgacatggcagcagagacaaagtgtgggacccacatatcagctgagtcatgctggcatgtgggatcaccacatggacacatggtcaatcttcttctctactgtactgcccctaacagaggtacagaactggagtagtatagatcaagaaaagaatgacaggctcgtcttactttcaatggtacaaaaaaaaaatgtatataccccttgcatgcaagtatgcaactatgcaagctggcgggtccttgtgtatcactcattatcaggctactgtatagaagcaggttaaatcaatcgatttcagtaacaaaatggtcacttggggcgtgcgcagcgccgagcaagcgaacaccctccagatccaaaactttacggcgatgacgccctctgatcgtagctcccttgctgaactttctgctgtctgtctatcaagatgcaacctcaatggcacttcccagtggccatgctgcttccacaaacgcgttgctgtaagggactttctttaccaaggtcatctcttggtgagaaccaacacctgcgagagtgcaagagcaaaacaaattagtgataaatttgtgcaaaatctgtaatgcggtcttgattatatttagttttaacgagacataccaaatccatccacaagtaaggtgtactggtaaacgagatccatgcagatatatggaatgttatccttttggacaccagggtaggcagcttcggcgtccttcaagtttaacttacatgcacgcttggcagccttttcaaaatctgaaggtttaaccttagccacaggtgccttgggattcacaaatccagcctgagcagagaccagaaaattgtttactggtgtatcatcatggcaacaaaagcaaacatcttcagtagttcaacaaccttacctcagctgccctgtcgaagaaaaatgatgccacaaacaaattcttctgtccagcgccaccaccaccattccaaatgccaccaaaagaacatttcatgtgagtgcatgcttggtcaactttaagagctttcactacatcatccctgcattttgaataactagcaccagatggtgaagccgacgcttcaaatttgccattgccatatttgtattgccctacaatcacaatgcaattagaacaaaactatcttaccaacatagaaaagataaaattgcatctccaactattgtcacagattggtcatttgtgttgatgaggatttagatttatacacatcactataaataattctaactgcagactgatggttggaaagaatatcaaggaaaccagtaaggtatttgtttcatagagaatttgagggtaacctcatttaaaccaggttacgatccactataagggtgtgttccttaccacctcttcccaacttctatttctcgttttccacgcacacgtttgccaaactgctaaacggtgttttttttttttgcaaaaaaaattctatatgtaagttgttttacaaaattatatcaatccatttttttcaagtttattttagctcatgcttaattaatcatgcgctaatgggtcgctttgttttgcgtgtggcgaggtgaagttcccaacctccacctccgaatgcagcctacgcattacattcctcccttgaccaaaatatgcataagggtaacaacaattgaaattttaggaacaaacataagctacttggcagggagttaaatgatagcagaagaatatggtagaagtatgttactagtaccttgatgcccctccaatgtacagtagctgtaacctttgccattgccggcttttaagatctctgctctagcagccagcaacccataatgcaaatagctgtgaagaaatgtgtacagttatatatgtggttcaaagactccagactaaaaacaggtcatgtgatgtcatcttatacagcagataataaaaaagtaaggagtattaagtttgtggctatgtcagattaagtgtttgctgtagaacattacatagaataccacgtgatatttaggtagaatctttacacataaaagtacccttacgtttggtctggacttaagtttctcaaatttgcattaatacgctattcttgcatttttatcaatacgagatagtatcttagaggattacaacagctgtctgctttgcaaagaatataacctatgaattggcataggcagacatcagaaataggcatgacaatatgccatcagatgcttaaatggattttgaagattgttaccgtatcacaactgaataacttttttcttgacaatgtagcagcagccaaaagctcaacggtatttcatactaacctgtgaacataaagataatatgttgttcctttaagaaacagtttcttcacatatgaatcttcaccctctgatggtttaggagccttcactgcatccttctctgcaattgcatatgccatctgcacagatccacctccaagatcaaccactccaactgtgtctgcgtaagtctttcccaatttccccagcagataattgatggtaacctataaggatagagaagagcaacacttgttatcagttaatggactaaaagctagacatagaatcactagttgtgaacagatcctaaacactcaaaaggtgaattaactgtcagaacagtgcaccacatggattcagatgatctgcatctattttcagggaaaatgttgtttctggtgcccttactttcaatgtttagctttcgtcatttggattttgtttcgtcatttgtttctggtgcccaaattttgtttttcaaaaatgaaaatagttattttgcctaattcactcatgaaagcgaaaatttctctttttttatcatgtcctttaaaacttatatctttgaagctggcagatgtcagctctaagagaattggcagatttgttgctgaacaaaatagttttttctaaacaaaaagaacttatattgtcaatctgacaaatgtgaggcatttctaataatcaggagcacaaagtaatgttctgaaccatatgaataaatcaggccagttttgtacccattcatatgcgccttcctgaggtccatcaagaactgtaacccaatccggttgggtcttgaacgaactcttttcgcgaagaagatccctgacctgcaaaaattgtgagtgtattcaatattagggacaaccaatataaattcagtgatcgatcaaacaacaattaatcaaaggtgaataaaagcaaaatttaccgcttgcaaaatctcctctgatttttctgctcccaacgctcttagcccggcggtggcctgtgtgtgaattataaagcttattattagaagatgaccaagcagcaataggaagctctactggtatcgtacaagaactcaccccaactctaacaggagtctggccgcgcaattccacgggaaccactcgtttggcatcctcaaggagagagacgagcgatttggcagcctcctgcgggttattggcgtactcgctaagccccggctttttctgcaaaaggggaagtggggggaaattaagtaaaaatggattgagagatgaaaggatccctagcagatccagatccaattgggtggatggatcacctggacgaagagctcgatctggtcgccaatgtggagcagatcgaggttggcgtcgaagcggaagacgtggacgcggctcccggagctcccggcgtcgaaaatgacggcgtacttgttggcgtcgagggggccccacctcctgccggcggcggcggaggaggaggcgggggagcgcggcatgaggaggaggacgagggagacgagggcgagcggggcgaggatgacgaggaggacgccgcggtagcggtggaggcggtcggcgagcgtgtcggggcgggcgccgccgccgggcagcgcggagtagcggcgcatgttcttggcgtcggcgtcggagggcggggcgaggaggaggtccggggaggagggcgtgcggtagcggatgcggcccggcggcggcggcgacggcttgaccgcctcctgctccgcggaatccagggcggagagaggtggatctgcgcggcgtgggctctgcctctgcctctgagatcgcagtggagagtataacgggtggggtttgacttggcggggatcgcgtcgcgtcgagatgggcgtcgtcgcgagctggaaatgcgtgcgcgtgcgggtgcgtgtgcgtgtgtgtgcggcgttgggatctgcggcgagagaggggttcgctgctgctgctctgctccccggcgagccgagcgccagaggaagaggacaaagtggcgggcttggaatggggacgcgacaggtttgctcttgctgacgacgatgcggatgcggtgcggtttgcttcgtgcgcgcgccggctcgatcgatcgatcgcgcgtcccccggtcaccggctttgcccgtttgccgtgcgtgttgctttcagagtttggctaatctgtgcgcggtccacgcgtgtaccgtgacttggtttggtacgatcgggcacgacatgttccttggatttgaccatgtgtatacatcaagaggcgaatgcgatcgatcttttgtggtttgtttatatatccagaatgcttttattttcattcctttacaaggcttgcctctacggcttatgctttttttctcttttacaaaattaaagtgttgatgaatattatttattccagaattatatattttgatttttactgctttttctttaagaggggttaatgtaagagacaaacgaccctgaatatataatctttcgacacgcaattattggaatattcaataattcgcttgctataattgagcatataagcagtacactcttgttgtattctttgtcctctcctcttatgcacgaggttagcttctcttgagggatatcttgcttatctatcatgaataacaaacgcttttctcatgatttcttcttgtcccatctacatataagataacatatgtaacctaacatgtctaccgaagagcatattctctcctctaatgcatgaggtaccatttataggcggacattatgttgtttgtctattttaggcgtatagatagtagatgattatacgacgaacaactccaatggctagtgtagtattatcgctattggcatttatgcgttcctatgtattgtattcaagttatagtaatccttccctttttaataatacctccatccagaaatatatgggattattcccaattgggtacaaattaaggaagaaagtatacaccaaatctgattgtgtgaaaagacatatatagttaacacgttgaatgatgtgcatagagtacatctttaaaaaaaaactactaaagtttggtaggagtgaatgaattttaaaatgcactacatattagtattaatgagtttgtgagagccttatatgctgaaatcagtttgttgctgcccttgttgcctcagtataacaaaaatcgtctatattcttggacaaatgaaggagaaataatcccctatattcccgggcagatgagtagatgtcgacaatgattttgtttgcaaaatgggaaaaaataagataaaacctcctgaaagaaaaaaaaacaaaaaagagatttgacaaaattccatagcccaggtatcgtgatagaaaattttgaaatacgttttgtttgcaaaatgggaaaaaaaacaagataaaacctcctgaaagaaaaaaaaacaaaaaagagatttgacaaaattccatagcccaccgagtcaaaggagttactaggccgagggcaaaagttgggccgtaatcggccagccgcgcaagaagtaaaggaggcttggactgcgacgtaaagcgcgctctgggagtctgtgggctggaagcctgcaagcgccgggtctgggaggaaggctgggccgtgttgtcgcgacgctatcacaggcacatgcttgaacaacacgctgggcttgcttttgaccgcgatctcactcgattctcttctcgttgacttgtctcgtgccattttctcgtctcttcgctgtatgcaccatgtgttcacgtggcacgcacgtgcaacgtttcatataatccacgcatgtgttccctttttgactcgtacaagtatgaatagtatattgcggtgctataccttttctttgcgtatcagccatctactgaactgcaagtctgcaacgtgatgcgaaaagaaaaaaaaagagctgcaacgtacgtgatgcgaggactgtatgaaactgctcgcttgggttgggccttaaggcccatcaatatcgagtgcttagtaatatgggccgcttcgctggcgccgctgtatacaaacgtgacgtgatacgtactagtacagctttgaacgcacctcgtcgatcgatgcaaagtgcgatctgcattaatagcgttgcgtctccttgccaacctcctctgcatgcggtcgcttcccaccgacgcctccatcacatcggcgcccgtcgcggtcaactcgaaatcaacataccaccagccgcgcgcgtgcagccgtcgtcgcatctcaccatcgcagccatatcctctccctctcccacttcgcctcatcactactccgttccctaaccaccattcctcgccatggcggccccggcggacgactactacggcgacgacgacgacgagtacgacgactacaacccccacccctacggcggcggctacgacatcttcgccacctacggctccccgattccgccctcccccaccacctgctaccccgtctcctccgctgctcctacggccccgccgcctaagccgtcgcctactccgcctccggcttctccaccgcctgcgcccactcccccgcaaacgcggccgccttctccgccgccgcagcagcagcagcctcggccggtttcgccgccgcccgtggcggagccgtactactggcccaagccctacgactacggggatgcgccgcgcgagcagccggcgtacgccacgccggaggtcttccggggctggcccttcttcgcgggggcgcgctgccactcgcggtgcggcggccgcgactactggaggcagttcatgcgggggctggattacctcttcggccacgccgatggctacggggagcgccgtattggggtggactaccacggcgtccccgtctacgccaacaggaagggaggcgtcgaggaagccgtcgtcatacaagtggagccgccggccaccgggactgtagagtggcaccacgccgccgacgacccggagtacaactacaacaacggcaatgtgagcgaatacaccataccactcgggatttttcacttcacttctgacttgctattgttgttcacttgctacgtctgctgtcttgcatgttgagccagcgcttatcttgggatgacaatgccaaagatgaaacatatgcatatgtgcagcacaattacagttcgtatgatcgctcttatgatcagtcttacagtcttgatgccgtttccgatgaaactacttggtttcctaatcagaactaccagcacgtgtacaaagaggaggaatctcagtatcaggtactaattaacttatcactgatcaagaagaatgaggtcaattagtcgtcagcctgagtatttagctcaattgcgtgcaatagtactgtaatttagttatgtttgattcatttttctgagaatatgctagctaatcttgtcagtggacatatttgacatgtaaaatgacagaaaatggaacgaaaaggattgtttattttgagggagtcgctttctgtgactagacagtttaatcaatgacacattagcgttcgcgaaaaaaatcaatgatacattactcttgtgtagcattcaacagatcctgcctgctatcttcgcttctaatccctgcttaatattaaatttgcgtgcaggaaatcttgtccagctcttgtgcagaaagtaagatttcagctcagcctatttattgttacaaccagcagtttagtgaacaaccgctacatgttcttgttgagcccccagaaacagtttattctcagaagttggagtactatgaggtttgtctgtcatctacaaatgctgtttacagtgtcttcatttggtaattatgcatttgcttgttcaggttgagttcatcaatctcaagggagaacactttttttttatgtagtcttgtgattgtcaattaaataatttgtgcagagcttctcaacatacaaccaccataacagcaacgatgattcagatatgttgggacattcatatgacatacagctgcccgatgaacatgtgccagatgaaccatttgaaccaattaagccttcttgggctatgcattcgggatactatcagtcctgcacagatggggcatctgctgaattcgaaaatgtaagttaggtagttatttcaggaattatgttgtaaaaaaaatatccaactgagactatctttttcacatttgatgttataccgatatggtgataccttgctgcttcaagatcaaagtaattgtattattgaaattttcagtggaagctatcgttatcacatatgttgtgctactaataccttcctgaggcaatattattttttctttaaactccttgagtgctacattttatcggaccatgaacttttttattggactatagctacttatgttttcctttactaattcgttactttgacttgcagcatactttaagctccagtgaattcagtggtattgcaagcttatttgcaacttccttctaccctcaacaaacacaaatttatgagtgtcatggagatgagaatgtttccttgcagcaaaattggcagtgcaactggaatgtggtttctgaaaatgatttccaatcggtaagcgtaacggtgtctatgtctgtgaacgtgcttttttaataccctatactcttatttttatcgctccattttactcctatttgtgtactgttgaatgtgtgtcatggtcggtacacatgtagttgaagtgctaaggatggcgcacagggggcagaaccaagcggcagcagatagaccatcaatgcatttgccgcacctatcgtacctccttagttgtttgattcaatttgtttaggttgagatttgttaaactttttaggtttgttaggggctggctttatttaagagagcttggcattatctttgaaattaagagcaaattacaagtctactctctcatcccctgttctctctgcctctccccttttttggtgctgcctggtgccatctcattcaaccatgggtagtaagactgttaacctatctagctacttcccactcctatcttattagatcactccctaacgcccgaatatattatattgttcttggcctcatgggtggctgatgacgatcaatgaaaacttcagacatgtctgtgagtgatgctttttttccccttgcaaacgatagaattatgaattagtatctgttttcgttttggatgctgtaaatttaaaatgtctggacctttatagtatgtcccgtgtatcctttcacattcttctgaaatatttatttttgctatttaatatgcaatccatgacacaatttgttttgttgctcaagaatggccatcacatgatctcatttgctgaagttcaaaatggcactgcttggctgcgattttttgcggctgcagctgtgcataatgtctgtggctgtggcgcacagccgtggctactagcagcagacgcagccacaaaaatgacagccaaacaagcccaatatatctctttcagatttagttaatacttggttgctctttgttccatatattctgatgttagtgtaacttttatccacattcatgatctaccacacttgccagtgttagtagtaattgggatttacttgccaaaagaataattctcagactccagcagataagtgaggttaactctgtctttatggtatagttttcttaacaaatcagcaatctcagtacccttgctagacgattttaatgagtgttaatagtttggttgtttgtgctttgctggtattgttgctagatttcaactgaaacaatcttgtatggtgcccgcatcacatttttatggttgaaacatgagtgtgcaactgtgcatgcgatgtctccatgttgtcttttgaactgaaatatttctccatttttatttgcagggttacgattccaaccatatgaatggctccttctggccgtttggagatcattcagcataataccacatagtctatattgttgtaatttcactcttatcttttttatgtacatttcatttaaatttacccggccaaatgtaaatgaaaaaaatatatataagaggttatgcaccaatgtatctaggttcagcatataatgtaagatcattgacgctgttgttgaccataattacttctttttatagtgatatccagtttctttttaacctgagaccataccactattatttacattcaaccatacctctgaatatattatcatattcttgtattcctgagcctaagactgttttacccatttcaggttcctctaatctgcaccgcaattatttggcactacatgtttgacttgcttgaatatataagctgatacctactgttatgctgtttcagttttctttgagtcctggctgaaggaattagcgtattgcatttcagaaccaaatgagcttttcaggatcttcacagaacatagcttgctctgcgtatcatttgataattggtacattatggcattcctgtcctgttttagtttcttatgtcagttgaatcattatgattgatgagcgcctttttcccatcttccttacagcaagtcctactcagtataatcctttgtcagtagaacttttttttcccaatttatttcctttgtcgccaatttggacgggatgagcatatttggtttactactttagtttggttttcaagattatgcagatttgtgtgaacacaaatcctgggtatgatatctggtacaagttggctatctagaaactgtttgttcttaactcgtcaatcaatcataccagcactctatacagtactattttcaaggttttgtaccatcatgaaggcttgatcgtgaagcaacaaaaaaagggatttggaagtagacagctacgtcctgttgtaagctgtaacttatgaagacgacttcccttttccaagcacaatctaatgatagttatgctatctcttttggtatctgctaggcccataggttgctgctgtcaaataggagatctattgtcgttaactctagtgtttgttggttgctattttcaggtcaaatctttgcaactctcctggacctggcccaattaggtcctcctgtcagggccttcaacgggaacctggagagcgaggaaccaataataaaaatagaagttctaaagctacatatgacggtatgttgaagttctgaagtatattttgaacttaagactggaaaacatcagagcggctataggtcaaccaatagcactaactgatacacaggtccacttgttttccatactatcttatgcttgtttagtggatgataatcaaacaaacaagccttttcttccctctacagttttagctgccataatatattttacatttcaaagctttgctactgattgttccctgctcttgtgaaggtgtatcgaagggtaacatctttctcctgtaattaaatctgctataatagcaggcccactcattggagatagatatgtttttgattcccactttcttttcttgaatcatgatcttttaaataagattaccttacccctgggaaaaagcaaagacaggccatagaaaacagaaagataccgaatggatcttaaggccatcatagctctctgctttctcatgtcacctagttgagtccctgtagttgccagaacttgtttgtaaacagttgaagaatgattgccttttacattactacgtatatatctgtaccttttttttttcctttacaactgccagtaaaaaaagtgtcaaaaaagttgggtcgaacacaaacagctgtcccgatccttcaatccttttagcaggtattagtgctactgttaagcaaatattaactaccgccgtttaggtagtgatgcagaataatgttttaatacctgaaaccatttaaggtggttgctagttctacccggtagatatgtggagtaaacattatacctgactacctgagtgcagttgaaaacaagtgacttccacaaagggtaaccccttttgtttgtgcacctcaacttacagcaagtttagccagttagtaggaatctgggagaagtccttatcagacctaaaatgcatgccagcatggaactaaagtgtagagaaagtaaatgcatagcgtattatgatcctttatttccttcctctttgatgcaccaaatagctgcgaatctatgataagacgtttcttagtagtgctagtggtgtaaacatacaattcgtttaagccttgttaagtttgactgttttttataatgaccatccacacaaaattaccattcaaaaattggaaggttgttttctatatgtaagttgttatagaatttcttgtgatggcttctttcccttgctaaatgaacaatatcactatcacagtaagttatctattttttctatgcaatataagtaccaacaaactcatttgacaggctttaataatcagtgtgtacaggtctaaagtggattatatttggaatcgtattgagtatgcaccatctatgcttgtttgcctacttgtttctgctgtagttttagttttggtgcatggagacaaggacgagaagcatttgttattgtgaacacgtaggcccatatgatctcatgattctgatcagatcccactattaattacttagtgtattattgaaaagggaagggcaaagagggagtcagatttataatttatacaggtggactaaagttgtcgtttgaatggagagaaggccaaagctaatgatatccctattctctaatccaaactgtaatgtgtattgtgtaggcaacgaggaatggtgacatctacagctcgacctgagccaccacagcgacctacctgcgtttggcagaatggcaggtatgtttccccccttgcccttttatccgtgtttgcttctcacctcctgacaataaaattcaaacaaatccgacaagttctttggtggttgcttatgcaaaaaagcatataatctcagcatatctgtcatagtctcatagaattgagccgtgatatagatttctagcttccatgtagcttcctcaagatattgcgatcttgtgaagatggcatgtagcatagcagtagtgattctagtgtaatcggcgagatatctccactgtggagtggtctcttcccgaaaatttcgctgtgtccagcaagggtccaattggtacccacatgggtgggatccggggtgggggggttttggttactatttgctcccatctcctgctgttgtctagtgacctgaactgacccacaaacacacaagaccatgaaaagttttcttgctctgtagtatgtactctgtactggtgtagtgccttgcaaatccatgctgaacaaaaaacaccgtgccgcgcccatgccccatcctttgcagacccatagccagcctgcccaggtctctctgttggactcacttgagctgcctctgcctgaccctgagacatgcagtccggttgcaatgcaaattctgaccggcgaacagcgaccacgagacggtgatgttgaagggaatcaaaatcgatcagcaacatatgcatgtgggtgttgttccatttcgcttttggatgtactccccagtatagtggtacgtacaagagtgacatcaaaccactgtttcccctcacgggttcatatgagttacctgttggggctgtacactggaggggcactgtcaattcaaaatcctagcatggacattgccaatttactacgagttctatgtggttgtccccatgctaccgcatcaatcgcccaatcaattacccaaaacccaagattggacagtaggttgccgcacactagcctccctgcatatgcaaccagggtagtgtctgttgtatttgcgcaccaaagtacggcataatgtatccgcacaattattagcttttctttatttttatcgtgtgctaagattcctttggattgattggatgaatttcatacgatttatgtcggattggaattcttgggaaattttatgtcctttggaacaaagaaataggatgccagaattcctatagattggcctcatatgaccctaattccataggaaaataaacatgagctcaaacatcatgtttctatctttctttgacaagtcccatgcacccggtctctctagtttctctctgtcattaatttacttcctctcttccagaataaataaacctagaatatgatgtaaaattacctagtaaatctgaataagagcacctatccagattggccatagtaatgtacagtattattctagtatagttggtttatttttggacggagggatatatgtttacttcctacttcgtccgtaaaaaaatcaattttttgaggaataatggacaaacatagttcgttattagaaagttctattttccgaagggtgtagggaacggacgaactgagccatcgtttcacttaattgcgaaataagcgaaacggcatatttgcaaatgaaaagtaatttgtgaataaaacttttataaacgtgttcttagcgatctaaaagtaaatgctgaaaaataaacttcgttgaaaaaaatctcaaaatcaactctaaatttaaggttgaaaatttaaattttgattgataagcataaacataagcgaaaaaataggcccttcaaacacccactatcatcgttcctgtgttttggaatccgattcatgtttatttttctgatcctgcattccaaaaaggttggtgacctgctgaggtaggtaatggggaaaataataaatgctggtgatggcaacggggttactcttaccaataagatcgctcacaaaaatgtcgcatcagggagaacaaagcacccaaggtacaacactgttgtatcagcatcaattatcaacccatcgatgccagataagctcctagattagggacctgcctacttgatcaaggaagggagcgcatcagcaaagggcatcaatcataattagtactgaaacaaatgttcctggctaatctcttgacagcgtccaggtcgtcatgagtggtcttgagctgatcggttggggttcgccatgttacccatcgcattcactgtcacgtaaaaatcgatcagtgcaccccacacagcattcattgggggggggggggggggggggctcccgtgcgctgctgtaccttttaatgtctgatgtttgcagacagtggcttgtcagccttcgctcgagcgctagtggttgttgatctgggcaacagacattgccactgcacctcccaccaagtagtttcgaaatcccctcagattattattgataggcacttaagtttacctaatccttccttaattggcatctaacatcttttttgctgtggccaattcccataaagtccctttgcctactgtacgtgtaactcaaaaacaattttaggctctgttggtctgcagtaggtccacaaaaatcaaataattaattccacatctataggagtattatgttaaatattttgccctctctactatgaccaccacccaagtttacaaaactgaacaatttatattttcttcagttactaaaaccaatttaaataccctccagccgtaagaacttttcctgaatcatacagaacaattaaattcatatgaaattgatatatgtgcctaaaggggcatgagaacttctcttacactatattggttttgtataggatggagggagtacatgacactttgtaacgaaagaatgaccctgttatacttctaaggtacagtatattcgtggcgttatacttctaagttatattcgtggcttcaactagggcaattccaaggcctggtgatgtagggatcagttttgttagtgagccgcactacagtgaatggctacgtgactgatttcttggctacatagaaattgatcggtagagccgtagagatggctgcgtctacctagcacatgagccgcagcatagctttgttgctgcagagcagtcacgggcagctgaaacgtgcaggcctagtgatcaagcgcatcatcggctcgttctcgctttttaaactgccaaataatttctatataaaaattattctaaaatattaaatatattcaattttttaaatttgtaataattaaatttcttattttgcgtgtcttaattttaatcttcagtatggctccattcttttgtgattaagttgtatattttatctcgatttttggtaacatgtttttcaagctgttaaagggtgcatatgaaaactttctatacaaaagttgttttaaaatatcaaataaatttatttttcaatttgtaataattaaaacttaattaattatgagctaatagttttcttgttttttgcaccctaacttcattttatcttctatagagacgaacacaaccttatattatattaaaggggatacatgaaactatcccgttcggacgggatgatcccttagagcttaaagatattacatgataactggatattagccattacctattaagtatcaagagataccttagaggtatcatattgtccgaacgagtatcagccaatatctatcaggtgtgaagcgatacctcgtagatatcactccatctgaatgggataccatattgtagcatttccctacattataccactttacacatgttttcgcacatgctagctgaagaaaatattcggatcttatgtttggctctaactatgttgaaagttcactatcgatattcctcttttttcgctatggaacacagaaataacacaatatccgtgcttttaaaaatcgtactaggagttgaggcactgatagctccaataatcgccaagaactcgtcaacgaagaacagaggggggggggggggggacaggcagaggcagaggaggaactgcaaggcaggcgtgggcaatttacttttgatgattgcgcatctgacaagagtgtgcaaggacaggcactgacatgaggcacatggtgctgaatcagtgatgaggggcagccatgttgcagctgtccattgggtgcactctggtggcccccattcctttcgggtctggttctttttgttaacccgactccttcaaaatgtactcctactactccctactttttcatcagttttgtcacataaataaaaagcccaaaacccgaacgacaattcacgcctccgtctccgttgtttcgatggcagtttagcagctgccgacgacgtcggccggagcggaggaggaggaggtgtttgaacccaacacaccgccgtgcggccgcgtcaaaaatgtgtgctgccgccgcagcatgtgcagctacaattgcatcgccgcgtttgcgtatcgtatcgtatcatcaccggccttgtcgtgtgtccccctttgtatgagctgttgtggtccgtccggtcctatgtttgacaaacaaaacatgccagcagtaaaaaaaaaaagtacgtacacacaaactagtcacgtactgtacgcactcctactgcagtactgcactagcacaacaaagtagcaaacagtggtagctagatcaagcgagtgactttggcttgtttgatcaacttaaaattatgagaaactgacggccattttggattagtatatatgacggttttgttttgaagccaaatcattggcattgccaatatccaatttgatattttctatattctactcaatgcttggttctaacttctaaattggcctccaaccaaggccgtgtttatggggtgtttgggagagaggggctaaactttagttcacccccaactactctaaacttccaactttccatcatatcacatccaaaactttcctacacaaataaactttcaacttttttttctaaacttccagctttccccaaactttcaacttttttcagaaactaaacacagcccaaatacaactctaccctaccaaaatgttggtagtaccaaaacttgccaacattttggtaaggtattgaatcaaacaagccctgagaaacatgtagttgttacagttttttagtttctgacttatagtttattttttgaattgtaaaaccacagtttctcttgatccgaaaaatttatatacaatttggaggagtttctgagcttgggaaaagttagaaatatcagaaacttcctcaaacatattcagggactctctgcaattgtttgttttacactttcaccgttccttttggtgtgtagcagtagaagaacgggaggcaataatgtaggcaaatgtcgggtgtcttggtacgtaccctagctagcttgggtggtgcgggcactgcagtgggccaaacttttttttttttgtgtgtgtggcgtcccggttccagcgcagcagtcctgaccgagacatttgtctccaccagtgacaaatccgtcgtgtcatctcatgggggagctcacacacaaagactacgctacgccacaaatattgtctactccttccgatcgatcttttccatgcaaacgatgataccatgcactccttccgttctaaaatactatctcaagttttagaagtatactacatccctcctaaaatactttgttctaaaatgaagctatttttctatctaccttctcctctcaaccaatcacaaccattttttttcatctactttctcttttcaaccaatcacacacttttttcaatcattttcacctactttcttaatacccgtgccaacctcaaaaatgcttacattttgggacagaggaagtatatgagatcaacataatgctaaaaaaaatgattggttaagatgaaaagattcatggagaagtgaattgtaagagatggttatgattgcttgagataaagtaaatatgcaaagatttaagttgtcatatttttatataaaatttaaatgctgaaaaaatttatatcttagaacgaattgagtaaggttgtgttcgttttagagtttagggtgacaatgtcttgttttccattagtgtgctttctaaactgttaagcgatgtatttttatgctactatatataaattttatttatccaataaacatttttaagtctattataattaattaatcataagctaatggcttgtgtcatgaagttttcacctccatacgcccaaacaaattcagcctgagtaggaaaatttttttagaaatgaacttgtgccaattaccttcccgtacatagcactatagctacaatacttttttaaagagagagagagagagagagagagagagagagagagcatagcagcaatacggagcagtagttttctaggtgtgtactgtatgcctttgagacttaaaaaatttccagcaaagagaagtgcacagtgtaaacttgatgcatgtgttgctttgtccgtaatgattgatgcgcatttcacggcaaatttgagcaatctaagattgatcatgccccccccccccccagtaggttaagatactgtttagcatcttaaatgcagacaaaatggacaagatatcagctgtggacaaatgaactactcctagatcaaaaaagtgctgggcaatgaaggctagtcgtgctaatttcggctagtaaagtttatcagtacaagtagctgctacctaaggtcttatctttcggctcaataagcagttgagattgcaagtggatcatcacttcactagtaggagtatctttttttgaactatatattgatggatcacttcattatcaaattaagctgatcaaacctccttctatatatgcatagtacactagtaattaattagagagatcaggatactactctattaaagtttgcttatttactcagtatccgtgatttggttgggaggcaacgagcttataggagatctctcatgtatgcaagcatttggcgatctcatatataataatgcatcccaattaatacatccacacacagaatgtttcattttctgtcaacgaaagcatgcaggtacgtaagtaccctagctaactcaacttctttgttagtcattatcgttaagctcatcccccggataatcatgatgattttaaggccgcaagcaacataagcattgagtacgtatacgtggttgctaggactaggagtactctatcacatgcaaacccaacataagccgccctgtgtttgttgcaacgcgtttgatcgagcacacaactggagtagtagtaattaattaattagtgctggatgtggcaaattaaatgtgcgtgatgaatggcttgttaatgacgatgtctcacccagagagaccggcaacttaatgagcccagtgactttataacatcactgcccgtacaacacacattactctgtcataggcttataaattgttggatgtggatggatatattggatccggtctgaagcaaacgaaacacattacacggccggggcagcatccagccactacgggggtgtttaaatgcatgtgtgtaaagttttaacatgtcacatcggatattatatagggtgttgtatggagtgtttggacactaataaaaaaaactaattacataatccatcagtaaaccacgagacgaatttattaagcctaattaatccgtcattagcaaatatttattgtagcaccatattatcaaatcgtggagcgattaggcttaaaagattcgtctcgcaaattagtcgcaatctgtgtaattagttattttttagcttatatttaatatttcatacaggtgttcaaacattcgatgtgataggatgtaaaattttgaggtgagatctaaacaggccctacattgcatttgcatctgcatccatgcacatcatatattcgacattgcgatatgagaaaagctttagatttcgtcgcacatacgatgctatggttttatcagtcacgggcgcaagtgaatcagttgtagctagtagcttagctaggttggttgttgcacaggctgcagctgctttgttgcgtgcaacctggtggaccatgctagctagtgtgcatataatgcaatacaaccagcaacagatgcaaggctccaacgttgcattgctgcatgtatgtatgtatggacggtacgtgggcctgtcacatcggcagcatgcgtgcaatgtacaccggcaaccagccggcaatggcacgtccggttgggatgcacgctcacgcccgcaaaacctccttttcttttctcccaattacacgaaaggcacatagtacacgtgcataaaacatacccgtaaatgtgtacttttaatgaataatgtttggttaagacccgctaaaataatgattttcgcatgtgactctcttaagagacctgtctatgaaaataaatctattttcacagatagacctcttaataaacatgcctaacacaaggctcgtcctcactccctcttattttctcttctcacctatctctttaaaaaacctccttactctactcggccactcccctctctccctcttatcctctcctcacccaaggccgacgggagcggtggcacctagggcagtgacggcgggcggatctgaccccagcagacggagagacaacaacaatggctcctccgctgctccctcttcctctccctctccctctcactctccctctctcttactctctccttcgcccctcatcatctttgtctctcaaactctataggctggcagaacacaaaatttgacaatttgaccctttccgaaatctaatttcgcaaatgaaacgtggccaaaacttatttcaaaaatgactcttttgttcaacaccaaatggtacagtgctaaaccatacgatttggcgctaaacaaaagggtcgtttttcaaataagttttggccgcggttcatttgtaaaattagttttcaaaaagggtcaaatagtcaaatttaatgctggcagaagcacttgaggatagcagcgggtccagcggtgcgtgaggaggtcggcaaaagaggcgcacgttgacggcggcaatgatgtgcatcgacattactagcggtgttgcctccttggggcatctccaccgcctcaggagtgcccaaccccctcacggatccatcactgtcagtctcgagtgcagcagggtctcgacaacaatgacggcggctgagatggtttgagctagagttttgactttttgaattttcaaaaatgtactctcatatagtcatgtatatcataaattgaactctgattggtaaatttgtggacacactattgaccattacaccatcggtattttcccgacctcttgtttcattgatagcaaaatttgctaaggacatctaaactttgtgtaattggctggaagacattgcaaaatcgcatatctgctaatggacaccataaaatttgtatacttgactgtaggacaccgaggcaatattttatcaaatttagacataaagagttgaaattttaaaaagacaaaattacccttagcctgattgaaccatcgcaaccccgaaccctatacccacatgcaccctaccctaatccccatccaaagaccctaaccctaggcgacggcggtggcagcgagagctggcaagcagtgctgggaagcaggtgatggtcctgatggaactgaagtggatagggctgagggtaattttatcgttttaagacttctctcccctagttttgccaaaaatgataaagtattatctcgggtgtcctacaaccattacataaattttgtggtgtccatcaggcatcagcagcgacatgattttgtagtgtccctcagtaaattacataaattttgaatttcatgaagcaatgtactaccaactaggagttgtagtcttatggacaaaattctgtgcttaatcggctataaattaaacatgtgtactgcttgaagctttgtatccaagcagtactggatggatgaatgtcaaacaaaattctggcgggaatcgaactgaattgttgtaatcactggtacaagtactagtactaaaactaaagcagcgaccgtatgatgatgagtcgccgtccatttgatagcaacacgaccaacaagttgcgttgtagctagcccgcgtcaggtcgtggcatatccatccatccattcatctagctacacaactatacaattctagccatccatctgtccttctccccatctggcctttcaattagtcctctctcttgtcgtctgcgtctcctccaaattatatatcttgtcgacaaattggcacttagcaattaggccctctttagttaccaaaacaaaaaaatttcacccatcacatcgaatgttcggatatatgtatggactattaaatatagaaaaaaaaccaattacacagtttacgtgtaaattgcgagacaaatcttttaagtctaattgcgccatgatttgacaacgtggtggtacagtaaatatttgctaatgatagattaattaggcttaataaattcgtctcgtagttttctggcggaatctgtaatttattttgttattagacaacgtttaatactttaaatgtgtgtccgtatattcgatgtgacacctcaaaataaatttttttccatctaaactgggccttagcaacaaccatgctctcatcacttaattacgagctagctatagccaagaaccaaacagcagttcacacccatgattggcacaattaatttactactaatcataataattaatactcctagctatactaatcattcatcccatgcatgcatcactgagcttgcatacgtaccagcagctgcatcagcaggaagaggaggagatcgagctggatcatccgttgtcgctctcgaacagagaacgtcgcaacagtgacaggttcttgattaatctatctattataaaataagcatgcaaaaggaggaatcaatcggcagatatgtatgtgtagaatctagcatcgacataacgattggaggatttgtctgagccactcttttgggtccatgaccatggtgaatcacctaatcaaccccacttgtgggatcatttgtgtttgtatatctaaacaaggttctcggaacagaattgttgcatcaatcatatgctcctgtccatctaactactgactatatacaactgcagatatatttactaactttccaagtggattcgaccagccaattcatgaatttggaatggggaagagcaattctaacttctcatgctgccattccgcaggataaatcatgtcgggcatatctatttgtcagacatcttaagctcggtttccctcaacataattctactttgccaacggataattattatagtgtcctatcatattgacataatttcatttatcaagagtaattaattaggatatctatttcatgttttacccatattaaatatctttgaaatctctcactttggaaactacacaagcagttcccattcttttctgactaacatacatattttaccttggtttcatcagcacgttttttaaattgctaaacggtatatttcattcggaaactttttctttaaaatattagataaatcctcttttggattggtaataattaaaattcagttaattatgcagtaataatgttttttttattttccgtgccttaacttcaacttcattttcaatagaaacgaaccccactttacaaggggtaaactcgcctaaaaacgtacactaatctcgaacggcataatgcttcccggaaaaaaaaacataccctgactattccagtgatactgaatcttacagtttgctgtttgccaacctgaatagcgaacctcctgaagccaaatatccttgagagatccgtgcaaatgattcgccagttgggttactgcacccccttcttggtcacctcaccatcatttttaaggccgtgtaaccgtgttcgttgaagttggaaactaacccctcgcatgcatatataatacagagcgatttattagcatatactccccccgtcccataatataagagattttgagttttttcttataacgtttgaccactcgtcttattcaaaaaattttgaaattattatttattttatttgtgacttactttattatctatgttactttaagcccaacttttcgttttttatatttgcaaaataaatttgaataagacgaatggtcaaacgttacaagcaaaaactcaaaatccattatattgtgggacggagggagtaattaattaaatattagcttgagtattttttaaatatattgatatgattttttaaaacaactttcgtatagattattttttaaaaaaaatgtaccctcgtagtttcgaaagcatgtgcgtgcgtaaaacataggatggagttgggaaagtcaataaacgaactcagtataaaagctttaccccatgaaaaaagaaagagtagtaaactagtaataaggcaccaccagtgcaactacttctcgcagctaataggtagccaaatctttatgtatggtgcaaagcctagataagccctttccatttcctaaaagaaagcctacagaagctttgaatcccaaatgttagatggatctggtcaaccggaaactaagtgacaattaaattaacagcgaccaaaccaaatcggagcacgatcaaattaacagcagtaatggtccccaggcaattggtgccgaccagagcagtgttctcacggcgccaaaaaggctaattcgatttaaaaaaaaacatgcatagtagtagaagggctcggcgtaagtgagtgaggaatatttggttgccagcaacgcttttttaggctgtgttcgacacccctcgttcccgaccctctctccctcgttttttcacgcgcacgtttttcaaactgctaaactgtgtgtttttttaaaaaagtttctatacgaaagttattttaaaaaaaatcaaattaatcaatttttgaaaaaaaataactaatacttaattaatcacgtgctaatggatcactctgttttccgtgcggagggaatgagttcccatcaggacatgcgaacgcagccctagtagtataagattagaccagtctgattaacttaaataaatactatttcctccgttttacaatgtaagattttcttgcattggtagattcattaatatatatgtgtgtgttttttcattaatatctatataaatgtgagcaatgttagaaaattttacattataaaacgaatggagtagctactatatggttgtagctaaagttatagctagcttccctcttagtagtaataaattaggttctatactcaatgaagagaatggcaaaatcctcttaaaagggtagtaaggactttgatcatatactttctcgctcccaaaaatacttcatttttaatctcacacatatagatataaagctgaaaagactgtaatactgtgcacttttaacaaatttaaatgtattaattactctaaaagatactccctccgtcctaaaataagtgcagttttgtactattcacgttcaacgtttgaccattcgtcttatttaaaatttttttatgattagtatttttattgctattagatgataaaatatgaatagtattttatgtgtgattaaatatttttaaatttttcacaaatttttcaaataaaacggacagtcaaacgttgggcacggatatccacagctgcacttattttgggacggaggtagtaaagtcttcgtgggacaagtgcgatagacttaaaaaaaagtaggctgtgtttagttggattcaaagtttgaattttagttgaaattggagatgatgtgactgaaaagttgtgtgtatgacaggttgatgtgatggaaaagtactgaagtttggatctaaactttggatctaaacacagccgtattgttgcgagggaggtagtggcattaagcaagtacggtaaattttgtttgcagataaccttctgtaccataaaaaaaagaaccagagatttttacccttctctaaaaagaagtgtctctatttagagatttctctacttagatgaataaatcatactctcttcgtctctgagtatttgatagtagttagttcgtcttttaacaaatcaacgtcaaatagaaaaaaccaaaggtaatatgctagcagcaaatagtggctgacaaccatatagtcgtagaatatgcgtgtacaacatggtctcttgcaaggtagagtagctacagtgatggttgccggtgcagttgctttcagttgagcaagtgggtaggagccgtagtagtagttaggtgaatctgatgtgctaaaattttggggaattgaagattgtggcaaatggcaatggacatggcaatggcaaaattatggcaagtgaggaggaggaggaggcagtgctaccctgtgctcccttgtgttgctccaaaacaccgtcctttgcagtagcccaggctccttaactgcagcatctattacttcattacacaaccatcttgcacgtgtcctgtccatcctctgcatatgctccatgtcctacagcaacaagagatactacatactgggtgtatccagcactaagatttccattttatttttaccacagtgctatcttcagtatctccccaattctaaattaacacatatatctattcagattgatatatcaaatcttatattaaagttgtttattttaaggcgaatggacttgtacataggagtaaaatcctagagattttttttgggtcagaatcaagtgtatgttttcggtacaaacacaaacctgcattatgatccatcatacaggtcatgatggaagttgtgcagccatgcatccgtgcgaaacaaaacaatccgggagattgttgttgttttcggggaaatttggtggtcgttttcgaacagtaggctgatttgaaggaagaaacggggagaggaaaggtggtggtgagctggactgaaatcagcagcggtggtgactgcaaccggccaagcaggacgacgttgctgctgctgttggagtcactcttggactgatacggcggccacaggagggaccacgcagttggtgacgacaagggatccggagaactcgcttcctccatgtgactatccatccatcattcgaactgggaggagcaaacttttctgcctgccttgatgaaagctcctcccctccacaatttctcaatctccccggaaacaaatcccctgtaggatttctgaaaattctatatgatccatagtagaaattcgatttcgatcaggtgtttgggaaccaaggattataaaaaaacaaaaaaaacgatgagaaccgctttttttttctggttttcgttgacttcgttgtggatcgagctgacaaaccagttggtaaatcttttcaatttttaaaaaatcaaataaaatttagaattttgttaacatttgtttaagtttatggttttcataaaaatagacaagaccactccggagtggtattcagtgaatgattttgcgaaccatgtgtgagactcgtttgagtttcaaaaatttttatggaattaccatgctccggtctaaggtcatgttcatttttttttcttattgattattgcatgcacgcttcctaatggtattgtggccgagtttagttccaaaatttttctttaaactttcaattttttcatcacatcgaaacgtcacatcgttccaatttcaaccaaacttccaattttgacgtgaactaaacacaccctatatttccttgctaaaaatttcttcattggtatatattaggtgatgccctgcgctttgctgcaaatatatgttatataatgaagaaatgatgaaatgatttgaattgaaatattttaaaaatgatttgagaatgatgatttatcatgtatatgtttagttttagaaagaaataaattatggatataattactatatacttgcatgttaagctttgtgtgttttaatgggttgatgtgatatgcttgtatgtaggttttaggagtggtaataaataccatatttgcatgtttatcggtcattagtgtacattagttttatagaaagaagagatttcgtagaaaactttttaaaattaacttcttcactttttaaatatttaattcattctggttcaagtgtggaattatactacttcacttagagcaggtacaatagcagactataagccaactataaacatattttaaggagataaaagataagagataagagcagcatgctaaagatttgtagccagatgcagcacggacttcaagatacacgtgtatgacaggtgggaccaaacattaattatttagagcaagtttaatagtatagccaactaattacatactacactattaatacctggtcccatctgtcatacacatactgtgtcttggagtccgtgctatagctggctacaaatctgtagcccgctgatattctctctcttcatttatctccttaaaatatatttgcagctggcttatagcctgctattgtacctgctcttataagtaactattgtatgaattgtctattaaattgactatatgtgatttggagcaaataattagctatactattaaacttgatcttaggattctggtcagaatgggattaaatcctgcgaactgttggtgaaatttcgacgaccgagacaacatatgcccaatgataccgtattgatttgttttgtctgttccatgcattggttaggctaattctcacgctaagtggctatagtacccccgcactacagtacagtgattactggtcatgttcaaaactcaaaagaaacatgttggtagagtgaatctgaacaagacgacaaatgatcctatctctcatcagttccattgtataggagtcgtagtagcaggagtattcaacatttctacggacgctctcgccagcacaaaattgaatcagacaagcagtatactatgtgctaagagcaagtttaatagtgtagtctactactagctctaaattatctatagccaatgtaatagtcaattcatacaatagttgcttatgatagtattaatatctggtcccacctatcatacacatattacgtcttggagtctgtgctgcagctggttacagatctgtagcccgctgttcttttctttcttttttttatttctttaaaatatgtttatagcttacttatagtctgttattgtacctgctccgatgacacaagcagttaacagtgagaccgctccgaatgtccgacattctgacgaagaagatgttactactagtcctgattcagagtttttcaccgccaaaacagggaggtaaatgcatgttgactcgtcggtcagggtaaagcccgtacgcttaggaaacgagtcaagggattcttgatgacagtgagaggttaaaacccaagagtacttccattagctatgctagtaattactgctacctgccgtgccgatggagcatccgggtggtgttaaattggattcttccgtttggtggagacgaaaacgatttgggagagaattcgtatggaaaatcttctatactagtatacgaggtactagtactacagtacgtagaagcagaagctgaggaagtgaagtggagtagtactcgtacagtaggcaagaacaaagctgcgactgctgcggctgaaaacgacggtgcaacaaaagcgagcgaaaggcgaaaggcgagcaatctgtagtatctgctgtgtgtggcctctgtattatctgtcgcttccgttccgtcatgccaaatttgccatggtagattggtagtagcaaacctgcagccttcgctcgcacaaacacacgcaccatggcatggcatgccatgcaaaggcgcacgcacaggcacgcgcgtgcgcacacaaaagtcggtggaacgccaaaagatgagccaaaagctaaccgggttgataaaaagtccaccagttgcatcaacgtggtacccgaccttgtttatttactacctttccccatctagtctaatctaaccttacttagttactccttcagttttaaagtataactatttttatatagcttaaaatcttatattctaaagtagagtaattagtaaacacataataaaatatagacacatatcctctttcatcaaactagttatcgttatctatttttcatgaccgacaccaaatacctagagtttgggttaggccattcacgacggcctctcccttctcaccttagacatcaatgtggcgtccctctctagcacagatcggggagacaggccgatgagcttagcggcgtggagaggagaacgacaagcttgctggctagggttcgagcgggtgcggcaactactctctccaatgatgaccgttgtagcctcgcatggggtgtagagttgaggcgttgcacaaggccatgaaagcgcatggccacgacccccacagcgtggccgcgctattctcactcatgccgcacgatagcttttctgacaaagagcgtgtgcccagtttaggttacaaatctcgttcggccccactccgagccaagctgctagagaatcttctattatcatgggttgatcgaatgccacatatgtgcactgaccttatagtttgcgcaagtgatgatgggaagaaatgtggcattatagattagtagattagtagaaaaaggatgtgccttggatcaatggaggcaacaagaaagttagcaacaaacagttgatgagacaattagaaacagattaacatggtgcagagacgatgataaccgattgatggttattcttccaaggccatcaatacaatgttgcgacatggaaaaaaaggaggggagcatgaaaatcatgcgatttgaagatcaaattataaactgttatggtttgatgtaggagcgttgttgaaaaataagggatagtacctagtgtgcgggtggcgtaatagagattgagagctaggataatgattaaatgatgaataataaggtaaggtggaaattgtaaaaatgtacacatgtttatttaagtgttacaggttcacccaataggatagccacacattaaaaatcaggatattgaatccggtacatcttaaatctacatgagcaacatccaaaagataggagtatgctcataggccttcatagagaagagctaacctcacactcatcattgctcttctcctcgaccattgaggtcagtgagctacgatgtgataatcacgaattgagatcgcatgattaagaaataggataatgtcataatcaggagatcgtcgggagaatgacggtgacacgggcataaggcggctctggtacgacaacagattatatcagtttttcttcatgtaagcttacaccatatcttatgttctcgtggtttgatactatgcaatcgtctttcttttctattcagattcattgttaaacgagtagctgctatatttcgggagcaagagaacaatagtactgaagtactacagctcccatcgaatggcatattcactcaaagaaaaagctaatttaaattttcaaacttaattttgacattaattttgagatatttttaacgtagtttttttttcagtattagcttttaagtcaccaagaacacatatataaaagttttatttattctctaataagcttagcttattagaaaaaagccaaacgataaggccctacatgaattgatcacaatagacgccctggccttgctgaaatggtaatgtcacctgctgtggttgacgtggcaactgcgtatcatgcatgtaaagccgatttactcgagggagggaaatggaaatggaaatagagtgccctgatcacaaagacagcagcgtcgtccacccaacaacaaagaaacaaaacaggtggggccccacccgtgcagtgggtccctggggaaagtgatgtcgaaattatcccccgtcatttgtttattggatttgtgcatgataggacgcgcttctgtggcgacggaccgaaagcgaccgtgtttgtttgacagggaaatcagacgcagccattgcattttttgcaattcctcccccctcaacccacaccacccctgcataattccaattccaaccggatcatatgcacttcctaatccctcattagtagtactaaactcaaactcgcgtgaagagttgagatggattatgctttccttctttttttcttttgtctgaaatctgaatgaactctctcttctgatcgccatctcgtatccactgtagcagttcatttttcagagagacacccatctacagttaaaaaaatggtgagacaaggccattcttacggggaaacccgcagtttgaaggcataaaaaaagagaggcaaatggcgtcgcagcgtgtgaaacagtatccctggggacagagacggggtttaagataatccaacctcatgtcgataaatatgatttctcatggggaagtgtgccatcttatcgtgaaaggccctcatctcatctcgctgcagcggccctgcggtttttttgcagcagcagcggcagcgcagtgggcagaaaggacaaagaggaacgggacggtggctgctgcagcctcgagaaacgctcccctcacctcgtgtgggtccctcccggtcagcaccccatattacggccgtgtcactcatcaccaaaaagctcaaaatcatgtatctgacgtgggatgtttgatcggacgtcggaagaagttttctacacgaatgaaaaaataatttcataactcttcttaaaaccgtgagatgaatttttttagcctaattaatacgtcattagcatatgtgagttactgtagcacttatggctaattatggactaattagacttaaaagattcgtctcgcaattttcatgtaaactatgtaattactttttatttttatctatatttaatacatatgtttttggaaaaaaaattgataactaaaccagactaattcccctattttgttacctcattattctcgtattccccttttattaccgtacggatcctcctgcagtagactggcgcaattaaatctccatcttcttgctcgtacaacgtaaatactcgtctcgtattccccttttattaccgtacggatcctcctgcagtagactggcgcaattaaatctccatcttcttgctcgtacaacgtaaatactcgtactactactgccagtgtacagtaagaggaagagagtgatggagctagaggctggagtgcactggagcggatcgagccgagctcagctggaggagctggagctggagctcgacatgtataaaaatggggtccacggagatccagatctatccaacgctccacgcacccatcctcctcacatcaggcagcaaaaacaaaagcaaaattacttacagcaaaaacaaaaaatttcaccaaaaacaccctgaaagaaggctcaaaattacaatgcaaaaacattttcgcgaaaaacaccctggagaaattgtggcatcacctgtcactcccccggccccaacaaaagcaaggggcaagccaagtaaagaaaggagtagtatagatcgatagggatgcagcgcactagtacgagtactacttctactacatagccatagcttagcttcttgttctagctcggctgcgagcgagctcttcttcctctgggggaaaatggagctcttcctctgctcttcactgcctcagtggcgccgctcccactgatctctctctcgtcttcttcttctttgagcttgctttgctgcacactctagtggtggtaatagaacacagctcagcagcagcagcggagcaagaagccaagaagccaagaagcaacgagtgttgtggtaaagaaagcggaggaggaggacgaagaagctcgattgcttgcttgctgtggagctcgccatggacgcctacgaggcgaccaaggtggtgttctcgcggatccaggcgctcgacccggaccacgcagccaagatcatgggcttcctcctcatccaggaccatggcgagaaggagatgatacgcctcgctttcggccccgaggcgctgctccacaccgtcatggccaaggccaggaaggagctcggcctcctcccggcgtccgggcccgggacgcccacctccgtggcggcggccgcggccgccgcccactcgcccttcatgctctcgcggcagaactccgggcgctgcggcaccgcgccctcgccgctctcggtgtcctccccctcctcgtgggcgcctcccccggtgttttcgaggaacaacagcatcagcaatggcgccggggaggagatggtcggcctcggcgacgagctcatcagcccggccaacggcgggggcccgccatcgcccttcttcggcggcgacccgctcatggacgagctccagctgcaggaccagctcgcgttcctcaacgagggcggcgtccccgcggggcaccagatgcccatgttcgacggcggcgagtgccggagccccggcggaggcgacggcggccttttctcctacaacctagggtgggcgaacggtggccccggacaccgccggagcgcgtcggtcagcgagctctgcctcggcggcgccgacggcctcggctggaagccgtgcctctactacgcgcgcggctactgcaagaacggcagcgcttgccggttcgtccacggcggcctccccgacgacgccgccggcaagatggacccctccgccgtggagcagcagtgtcaggacttcctcatccgctccaagtcccagcgcctcgccgccgccgccttcccctactcgcccaccggctcactccccggctcgccatccgcagccaccaagtgtttgagcttgctcctccagcagcagcagcagcagaacgagagccagaggtgccaactttttccacctccgagctcctcctggagtaccagtatccctttaacttagctccgattccgtcgatttgcagggcggcggcagcggcggcgctgatgctaggcggcgacgaggcgcacaagttcatggggcggccgcggctggagcgcgccgacttcgcgagcatgatgaaccccggctcgcgccagatttacctcaccttcccggcggatagcaccttccgcgaggaggacgtctccaactacttcaggtagtatactataatcccaccgcccaccgtcaccgccatgccatagctttaatctgatgatgccctctcaattgaagcatctacggccccgtccacgacgttcgcatcccgtaccagcagaagcgcatgttcggcttcgtcaccttcgtctacccggagacggtgaagctgattctcgccaagggcaacccgcacttcatctgcgacgcccgcgtgctcgtcaagccatacaaggagaagggcaaggtccccgacaagtacaggcaagccgagcttacttacagtccacattgcctctctaggttgatcccctataaccaatttgtaacttgctgttactttgcaggaagcagcaccagccgggcgagagggtggacttctccagctgcactactccaactggactcgatgccagagaccccttcgacatgcaccagctcggtgagcttttgcgatcatcttcttcatggtgattgggtgaatgattgttgctgaaatcgcatgagtctgtttgtaatggtgtcaggtgcgagaatgctgcagcactccaacagcgcgaatgagatgctgctgaggaggaagctggaggagcagcagcaggccgccgagctgcagcaggcgatcgagctccacagccgccgcctcatggggctgcagctgctagacttcaagtcgcgcgccgccgcggcgccgacccccattggcaatcctttcagcgcttctcagaccgccgccaacgcgaccggcgagtcgcctcccgattccggtaggacctggtgtatccgaccgaacgacgtttcacctgttgccgcgccagatgcagtgttgctaatgtttaccatggcggatttgcttgcttataggggagctcggtaagggaagcggcttccttcttgctcacaagaaggcggtcaacggagccgataaggaggaatccaccggagagtcctccagccctaacacagacagtgaccaaaggtggaattttgcgattaacatattgtctcatcgtcatcatttaatcatttgttattttcgccacacttagctttcgtccagcaatgcagacaagtaacatttcaccaaactgatcttttttcctctgcccattgtgcttgctctctttggcagtgtggagcataatctgccggacagcccgtttgcgtcgccgaccaagtccgcgggatttgctcgcgatcctttcgctcccactgaggcggagatctccgccaccgcgtcgactggttgtagcgccacctatgttggcatcaacaatggcgccagcaatggcggcactaaccatctcctaccttctgccttggacatgccctcaccaaaaccttatttcttccccatgtccaggtatgcatcataataatgtatggccccaagtgctattttagtattgcaaattagtacagtatgcatctgggcgccatgatttgctgagtgctatcattcattcatatgcatgcaggctggcctccgatcacggcgcgatcggaatgtaaagttgttctgaatggaagtgagtaatactactactgcctaatcctagtaagcacctcagtcctcttgcctttccacaaagtctatatcaagctctcaactccatgcttcctagtattgaatcatttgcttttcaccccccattggaatgatggtgccttactctcttttcctctgtccttgccatcacttgccccttgcaggaatactagcagcaaagaaaaagagaatagtggaatataggaaaagagtggagaagttgcagcatagtgttagtttcagtcacccccctttttttttactttccttttctttttcatttttcaagaagatagctttattaaaccataaagagaagaaagaggatgccctggcctccagaagagaagcagcagcagcagcatcaatcaagccaccaccaaccacaccaccaatgttttaaaatgcagtgccattcagataaaaatttagagcccctcctattactaccatatcatatcaccttagttaatcttagttactattaccacccaccgacccaccaccattgatgaattaccccccaaagctcttgataagctaccaccaaaatagccactagttttatagcattaggggtgatgtttagccacaagactagtactagtaccaaccacaagatacatgtaacactactactgcctgattgcagctgtgtgcaaggcagtgagtacagcagatatgtaatggacccaagaacaagtgacaggtttgagtgagagagagagagagagagaggaaggcttaattagctagtgtagtgtatgtaaaatcacaagaagatgaacaagtcagtcagtgtaggtgtgatgaaaggggaaggaccactcactgctgatgctgcaccattctgttgtgccaatgtggagatgtgtcagcgttggtgttcatggtccccctgatcagcaaatgcagtcccaatacaagaaaaaaaaaggaagtttctttttttcttttataatttcttcatggccttcgcctcataccatatgtatttctctgaatgagttgaatcactcacctgtcccaattgcgttgagattcaccttctccggcgacggtggccgcctccatggggcggtgctggtgccggggtgggggtcggatacggagaggaacggcggcggcggcgaggcttgagttgttcttgccgtcgccggcgccagcggtggcgcgggggtggggactgacggcgttagggcttgggtattgtttacctttgggagagtagagtattagagatcgtagggtaatccgagatttatgcggctggatgtttaatattaccactttagatttggtattatttaagaactgatgttttttttcttgctaattttcatttttagtactttgtccactgtagttgactgtcatagaaagaagaaagggaagataaaatttttagaaataggttagctttggtttttaccattatgatgccgcctaattttctactgctgcctccaaggtgagtaggactacatatatgttcccactctttctaaaagaagattcggtcgaaaatgggaattttaggagaataaataaatgggcatagtagctctgctagtggtaataacgcattattaaggataaagaagagggaaggcgtaaaagtggcacctttggtgacatgcttttggggatgctagtgccaacagccacccccagcgtcaacatccagtaataaaaaagaaatggacgtgaatacgacggtacaattaaaatactcccaagaaaaacccacacaaacaagttatcactccctcaatcccattttaacacagctataagtgttggtgtctaactttaatcatctatcttatttatttattttataaatcatctaataataataaaaatactaattattaaaaaaattaaaataagataaaacgatcaaaattagatatagaaacttatagggaagttctactacttctactcccattattgtgatctcctgtaaataaacttgttgcagcagcagtggtaggtttgctccctacattcgcagtgccaatcatcctatgaataaagcccaggtcaaagtagtaaaaaaaattaatccattcgcgttttcaccgcagcgccggtgtggtagatcgggaaaagggggtggggggaagcaagcgtgggtgtggggcccaggatgtcaggcgtgggtgacgcccacgtgtccgtgccgctgtgtgtgcgtgcatccgacaaggacgctacactgggccgggcccatttgctgccggatttccgcggagcacatcgtctcgtctcatcgcatcgcatcccatcccagatttgttgcagcagccagctacccgcccccagctactgcactgtacgtgtacggtgtacctgtacacgtagtaactttttccctttgtcctcttttcaatcagacgcatgcaatgcattgcacctactcctactcgctgtatagtagtatactacagtaatcactagtactagtaaaaaggccgtaacttttgggcgtgtccgctgttcggatgcacgtgaatgcttgcagaggggcgcatcatcgatccatctttcaattactagtgtggaccagtcaaacgagggcaatttgcaggtaatcaccctgccttaggctctgcttagagagcttctagctgaacagtttagtttttggttcacattatgagaagttgtagaagtagaataaaaaaataaactaaaagtttcagattatcagaagctaactaccaaccagctgcttttcagaatcttaaactccctaaacaaaccctaatcaattaacagattcagcacatcaggagagcagaccggctggatggtacgtatccgtggctttgcagtttgcaggagaaaggcacagtggcctttcctgaatggctgaatagtcaaagcatcgatgggcagcagacagggttggccacgcttgggctggttaattaatccaagcttttctctatcaatgaaatatttttaatgaaaatatatccgtccatttgcttggcaagtgtgcgtgtgcgtgccatgttgttgtgtggcacctcactggagggtacactacaggaggagtattttgatactagtactagtgtgtgtatgatacattggcaccgtggtcgagtcgagagagatggggctttgcatgtgctccccatgtgcccactgccctgtgcccatctccggtttgtccccctctcgctcaccctgattcaatactactacaagtattccttctttttttttaagacataagtgtgtacaagtattattgtttgtctatgtatagtacatctcgcatgcaatgtatacggatggatggatcgatcaaacacccctgttattagttgatttgtgaccatgcatgcgagatctaatccatggcgttgttattggccacagcggctgcatgctcatgtgtggcgacgtacgtactactcctacgtgatgaagctgccggcataaattttccggcgacaggacaggcaccagtacggagagcaacgtaagataactctgcatacgtgtgtgtatagatccacgtcaattagtcgcaatactaactacgtcctaaaatgtagctatttctagcacagtagtttgtcctaaaatgaagctatttttctacctaccttctcctgtcaacctatcacaatcattctttttcacctactttctcttttcaaccaatcacacaactttttcaatcattctcacctactttcttaatactcatgccaacctaaaaaatacttacattttgggacggaggaagtatatctcagtactatcattctatcgaaatgtcttgggtgatgaaaaattactccctccgtctcattttaagtgcaaccataattttccgcgctcaattttgatcactatttaattttttttatataattagtgtttttattgttataagatgataaaacaagaataataccttactcgtgacatatgtttttattttttattaaataagatgaacggttaaagttaagcatgaaaaactatacctacacttaaaaaaataggatggaggtacctagcatgcatttccagcagaatagacggatggacgatggatgtgctacgtccaacgcatagctgcgactacagctacagatggatggagactatgccgtcgctaccatctccgatggccagaaaacgaaagggatacggataattaattattcgagacgaggtatccaattttttcttggctttcttatcacccgagactaatccgatatttccctgcacaaaccagtggttcattattcggattacatctactactctatgctcttgcacggccaattcggtctctccccaatcagcaggctttcccatgtctgtctgtccagcaccaacaccaccaaagataaaaatcatcatctccacctgataaaagtgtggaacctctcaaagcaaaaaacacctgaaacctcaaggcctgtagcttgaggttttgatctaaacaggcccttagtgcatgcaaaagcagcattttttttcctcttttctgaatcttcacctgataaaaagtataaaaaacagagagagagagagagagagagagagagagagagagagagagagagagagggatattgggctcctgcttctgcgacaaaaacaaggcctgacataagccgccatggtagtattgtacaatcagatgtgtggtcttgatgatgattagtatatgatcgaattgtattcgtgcattcccccccacagacaatggcgaatttttgtcccagtccaattcttcccatatgaccaaaccagttgcatccccttgcactactgaaggatgcattttgtgagatttcttaaccttgaaaggcagcatgcagttaccagtactgttttccaaattcgagacaggctttcatcaatgaaggtggtagtactccagcacagtgatactactatattcgatcgaggaaagaaaatcttgtttgtttaggacataccagttgcaaatctgtctgtccctgcttgcttctgccgctcgcttcttgtttatcactccatctcccccccaactcgcccttggtacgtggttcgctgcaggtttccgaggtaagtaaaaattaacgagacgaaacaccatgcaagctactagccccgtgcgcacgggagaccgcgccgtcgtcttcttcgtctcggcgatcgatctgttcgtacgttcgttcgtggtcgtctgcaggttggtttccttcagacgcacggggacgagtttgttctctaccagtactactactagtagacagtctacttatactagcagtagtatatatcagctgtgtatttttagccgagttggggttggagtggtgtgtgtgtgtgtcggcgtttcttggcgggcgaggcgttgtttcttgctgtgtacggtttccatgtttgttttgagtatgttcatcgctaacgtaacgactttaattgctagctgctcctgtttttgcagcaaaccgatgcgatgcggatgcgaatgcgaatgcgaatgcgaatacgagtcgtctttaattcgttagttgatgcggatcgagctggattagttgttcacatgcatccccatttattagggctatctcccctaatataatcctctttgttaattttgagggacaatcacaatctctctggtcgaaactaatccagcgcggtgtgtagggctgatgaaatttgatgccagcccatgagattctccttgcgtgttcaggtccatcaacaggatatggcccaatctaagctgggtttaatgtttccttcctcgagaaacggatgaactaagcacaataaaagcccaccatgtgactgcaaaactattagcatgtgtttggttgggggatatggtgggatgggttaggtccattcctgttatttgggatgggttggacccagtttctgtttggttggagggatagaacggaccctgttttttgtttggtttgagggatatggtgggtcagaatggttctatcctctgtttggatggagggataaatgtgggttgttttggtggagatatctcctggtgaggttacctcacatatgaaattacttggacaaaatctccataaaatccaggataacatgcacaagtactagaaatacagctatgtattagttcccatgatggttttgacggttagcccacatgtcatcagcaagtccttgtctgaactgaaccatcaatgcatggtcatttgcttgcccaaatggctctgttgtggtctcacttattaaatctaatggatctgtaataaactgatcaattccatcatttatgacccaattatgaataatgcaacaagctacaacaatatctacttgagttggataagggaagaatggggtggcatcatctagaattttgaacctcctctttagtaccccaaatgcacgttcaactgtgacacgaagggacgagtgcctaaggttgaacaactccttctcattttgcaccggattattcccccactctttcaagtggtaccggacagcacgaaatggagggaggaatcctggtttggctccatatccagcatcaactaggtagaattttcctatcatatgatggagaagttggtcacatttctattgagatggagaaaatgatgaactaaattgttctattaccttggggtacaagaaggccattttcacgttccaatgcatctcttaaaactacaacatcatgtgctgtaccctcctaaccagccaagacataagtgaaccgaagatcaaaatctatagctgccattacattttgcgtggcatgagacttcctaccacgaaaatagggctccatattcttctcaacagaggctctaatatgtgcgccatcaatagctccaatacaatcctattttatattcaacaccataaaagattagggcacattgaggtttgttcaaatatataattgaaaatgagacacggattaatctcacaccttaaagtaaggatcccacctagggttcccggtaattttacttggggtgtccaatgagggaggcctaattagttcatctcgcagctcaccaacagcatgaaacactttgttgaaataacgactaactgtttctccggacctatcaaaattagtgcgaactaatctatttctaagattgtgccctactgtatttataaacatagctacttgttcctcaatagacatgtggatggtatcttcaagcaaaccacgatttctaaagagcttacaaaaccgaaagaaataatcttttctaagtctaagcatgtcgacacatgtggtatcgttcctccaaatttttgtgtttagatactcaattctcatcctatccctttcaacaattgggccatatttaacaccttccctcctagaaactctctttcttttcctagaatgaataatcatggccatcattgacaacaatagattggcagcagcagcaaaaattaaaatcttggtcctcttatccatctacaacaacaatcaaagaaaattaaacacattgccatgtcattctcaagcataaatcatctcatcataaactacttgcccaaattacatactaatacttgtttccatcaggaaaataagtactatgtaaaaattgatgaaaccccaaatcacatactaatacttgttcccatcaagaaaataactgctatataaaaattgatgaaaccccaaatcacatactaatacttgttcccttcccatcagggaactaatacttgcccaattcacatactaatacttgttcctatcatgaaaataactattgtgtaattgatgaaacaaaaatattgcaatgtgcttgaacagaagttgtggacagcaagggcattcatgcaaacggagtcgcacagatctagcattataaacaaaatagcagatatggtacatagctagggtttcattaccttggctatggaggtgagggggagctgacggggcgggagaggcgggagttccggccgtgggactggaaggaggaggcgcagcagggcccgtggcacgacgccggcgccgccgccctctctgcgccgccgcccccttgcgcgctagttgccgccgccaccctctctcgatttggatttgtttcgcttgtgattgtgaaggggaaaaaggtggtgagaaaagagatagggttactctcgcgtggtctcacgtgatgcgcgagaggaggtgggatggatcggtccgccacattttgccgagcgagaccaacccgcatatgggcagaatattccttttttgacccaacccagcccacacagttcttcaaccaaacacctgtaaaaatgggacggctctagcccaacccaccaaaaccttgcaaccaaacacacgcttagggtactccctccaactattttcattgtatcacttaacccttaaactttttattcgttttaccaataaattgttaaaaatgcttcacttatttcttaatagtatttgtctctttaattttacctctctatacacatcatttattttggagtcgaaaatattttcatttgtttatggatgtttgcttgaacttggtgtttaaatcagttttaagtacttccaacctatgtaaacaatgttaaaaagatctaaaagaaaacattgaaacatagtataatacatctatcatctttatcaaatttctacgaaaaatacaacttacataggaggaagaaagagagaaatactattacagagtaaaataaagtgtagaacaaactgaaaaaaatttacagggttaaatgctccagcaaaaatagtttaacttaggaggaaaaaagaaactgccgtgcatgcgaacatggcagctggaagagtttcttcgctgcagttggatgaccgaacaaaccactagtagcttcagatcagatgcagatggaagaaagaaagagagacagatcgagagaatgtcaacgatgacattgcggcgaggggaagatgatcacatcacatgacggcacatgcgctcgccgccgggtactcctcgtacacgaacttgccctcctgaacgagccggcaacccttgcaccctctgcacgacgacggcccagggcagcacatcgcctgcatcggcgccgccgccggccacccgccgccgcggcaggtgccgcacccaccgcagtacgaggggcctccgcatggccacttcggcgccggaacgccgccccatggcgggagctggtggtggtggtggccagggacgaacgctggcaacgccgccgccggggcttcgcactgcggccactgcgggtggacgacgccggcgccccagtgggtggggtcgctgcacggccacgggtagcagatgccgcacatgttggtgaactgcaggttcaccgtcgtcgacgacggcgccggcgtggccttggtctcctccttcacctttggcttctcctccttcttctcttccttcttgccttcctccggtttcttctcgtcgcccttcttcttctcctcctcggatttcttcttctcctcaggtttcttttcctcaggctgcttcttctcctccttcttggcctgatccggcttcttctcctccttctttgcctctgcaagcttcccaaattcaatgtctttgatgaccccgcaggccttgcatcttagcttatgggcgagctcctctggcttgaaatggcccgatatgatcaccctattgttcgagttctcataaacgatgttaatgatcttctccttgtctgcttcatgttcgttcaattcaaaccacagcttaatcatatactgtaccacctttttggccttacgccacaacttagttatgggattaaatttacataattcagcaagtgcattgatccatacatacctttgagtttgttaaggactttctggatcttcttgcaacacttttcacactcgagatttgccttaatgatcaaactggccatttgctataaaagcatccatgcaatacaaaaacagagcttaattctgcaaaaaccttaatgcatatgcaacctttgctttgcagcaaaactgtggaagccagaaaggaggaccaaggactcaccttgtctgccatgatggatccaacaatataatcctaacaaagttcagcaagttcgagtggaggcatgttgccaaaaaggagtgaaatttatagggttgttggtcattgcaatactataatcgactagtactttacattgcggtcaatcgtcggtgaagaggagtctaccatgattggtcacttcaacgtgctgaaaacctaatccctcttattcaagtagaagattccgaacaacaacctagtgctccataattagagagaagagtcttggaagcccaagttacagagcatataatggtacgtctgtcaattttcggtttagtactaaaaaaacatgctagttgcaatggtccacaaactgaagctgattaaaatggggcgccaaatcgatatgctaggagtgtaacgacgttcgagcttctagtgacagactgacagacagatgttcttgctaatcgatcactagttaattaaagctgattaacatgttagtagacattagctagctagcttgatcagattcatcgttggtgaattctttaatggagagattgctgttggagttcaaaccattctggagtcttgacccgtaccctccttcctttttcagcaacataaaaaaataagataaattttgctataggacatctaaattttgtgtaagttgctgataggcattgtaaaaaaaatatgtcacggttgaaagacactttaaaaaactagtaatttacttcaattcgaaagataaattcttaagaaagaagagaatgcccatataacaacatgcttcaaatataacgctagagtaaaaaattaaaaattatgcaactccacatttaccataattccaagtacatcactagcatacatcgtattccatcctcattgcaacttcagatcaaaagctttcgatcctagacattatcgtcttttagaagaaattctctccaatcgagttaaaattatcctccagcaaattattaatttttaagtgtctttcagcaatgacacgttttgatgtctactaacaaatcacataattttttattgtcctgcagcaaatttggttaaagaagaacagaaccctgggagttcatttaagaggaaaataattagaaacaaaccacgttccaagtgtgattggaatcagcaatacaattagcaacccaataaaagaggtgaaacgtgatcgatgaactgtacgtacctgatgacactgacttgcgttgtagcttgattagcaacatcaggcatgcatgcttgcatgcataaggtcgtctaacaatggtcaaattaagcaggttagatgccactagatagctggcataaagtacaattataaatgatccatgttagttcgtctgatcgatcatcaaacgctgcaccaaccgccatgcatgcatatgctgattagtagtaattatctaaaaaaattctgattagtagtacttaatatcaatccagatggccgccggccggccggccggaggaatagttagttgcggatgtctgccgagattgccggcgacgatggccgatgggtcccaatccgaccgtgcagtgctcggactctcaccatggtttgtaccatacgcagcgcgtgacgtgagacttaattgttgcctgctccctcggtcaaaaaaaaaatcaaactgtgggtttccgtgccaaattttgactttccgttttatatgaaatttttttataattagtattttcattgttgttagatgataaaacatgattaatactttatatgtgacttatttttttaatttttttcataattttttcaaataagatggacggtcagacgttggcacggaaatctacggtttgcattttttttttaagacgggggagtatagacgagacacgtcctcatgcatctgtggttacagtacctgagtcaactggagtcaactcaaaaccgtgggcttcgatctgcttggtattttcgctggcatacaaatcgacaatcaaatccatccactgctccatgtgggacacgttaccgcatacgttgtcacaagagatttcacgtcccaaaatcacatcaccggtgcacgaatttggtactggatagtagtggtttatatactcaaacttgtgctcacgcagcctttcattttttttttaataatgaaacttgtgctcatgcagcctttcattttttttaataatgaaaataaattacatcttgggtctccgtccatggacacacagcacactttgtcctcactcgtgcgcactacccatccctaaattgctctaggccaaacacgcttaacatcagagttctttagagagcggcttccggaaaaaaaattacaacttgttaatatgagtattctattaatcctattaagctctaggacgggatgtcacaataggacatgaaaaaaaatgttgaactaccataaaaaatgctacatatactcttttaataagtaaataaatattttttatgtcattatgtaagaataaattttgccataaataatgccttgtataataaaatcatgaatataatagtcttatataacaaaattatacacttccaacaatatagctagtctacaattttcaaatttccttcatatgtaagggcaaaatgatcattttcatagggattaaacattcaactaacgggatggatatgaaagggatcaaaaccaaaatttagaggtatacaagggagtggacaaaactcgggggtgtagaagagattggctaaactttcagaggtatagaagaaattttctctaaaagaaattaaaagaaggcctttcatgaaccatactctccttcccgcacgtaaaacggagcacgtattattgtatgattaattaagtactagctatttcttttttcaaaaatgggttattttgattttttttaagcacatttcatatagaaactttttgcaaaaacgcaccgtttagcagtttgaaaaacgtgcgcgtgaaaaacgagagagggattgggaacttgaaggtaagaatacagccatgtggtgtttaggaaggaggaactaaactttagttcctctaaaaaaatataagttctgatgggaggaagctgcatgggtagctattcgatcggctattccttcatgtgcaagcgatgtcaaattgtcaatcactggaatacatgtctcaatccaactgcacccgatcagctcaacatgcgcccaatcgaccactcaacaggcatgctgattactgagttttgtccgttgtgatgatagctagtgtacatacagtgcatgcaaacactggtacgataacatgtcactctaaaacacagtagcggtgtctcaattggattaaggcccatcaaccaccaacctagctacaccgcgagacccatttgtgtgatatactgcgatgagccaatgaagtactactacttactatacaaaagccagttagatgaagttttattgcgagaataagttaacaaaaccgcaaatttctgccgctgaaaatcgattagaacatgcatatcatcatttccactgtactcgtgtatggtaaactgcaaattactgctcaaaagagggaacttgtgtatggtacttcagtggtatattttcagacatacaaacatcaatatatatcctacagtatatactaccggggagttattcaaaaccttcaattctatgcatggagaattcagatgtgctagcaaatatagtttagggtaaatgggcaaggttaggctgatagtttagaggcagctcatatgtctaacttcaggctatgtatattcagtggttcacattgatcacaatcctatgctgcctaatattatccaatagcaaggccgcatgagctagctggaaagcataaacagagcgcattgcatcaaattgcctcaccgtcacagcttgctccaatgcgcggttggttctcttaaccacctctggacattttctgacagaaaaaactaatcctctctagtagtatgtgacatgacaacgaacagggaccattttagcactaagatgggaagtggccgatagcacatttagcaattttcaggctcatatatcaactgcaactgaagaacatagcatccttaaaaaaaccaaatatgcgattgatgataaatcagagtggtgtgctaataaaattttaattgatgaagtctgaaactctgaatcgacaccgcgatctgccgtccagtttcagatctcaggagtgacaaattagctccttttcggttgttcgcatgctatagtttactgttgaacaaacctaactaatatgtagaatgcaaggtttgtgaaagggcatatagcctagtggttgcagtgatctgagtagcactctaaggtcctgagttcaaatcttcataggagcgaatttcagattgggttatttgagggctagttccctgttcgataggctaagttcctaggctaagttcctattaaaaaaaagctgtatatatccggttggatatagaggccgggtaaaaaatacccttctccagaaaaaaaatggaatgcaaggttttggagcttgacacggtgatggattctaataactcatttagatgacatgcaataaacgagtgaacgcctactcgagctattaaaacagttcccgcttgacacccttgcctctattccggaactacacagcagcatacctgggtgaccgcccgcgtctcacggcggggatcaccggcttctcaaaatgcgagttgaaaagagtgagaggggtcttgtgcactgtctgaagcggcgtcggccggcggccgtgggcgagtactcgaggcgagaaaaataagggccggtttggtttgaaacttaaattaggcttgtcaatatttaacaatttaaatagtgtttaatgtctatttggtttgaaaataggccatttcaatagtgaacttaggctattttggattcaatccaaacacaactttaccttaccaaaattagtcatacaaaaacttgtcaaaatttagcattgacaaaatttggtaatacctatttagccctcaaaccaaaccaacacaggcttggcttcggagtacgcgtcggactagtgtacggcccagaccacctaaaagcccaacatacttgccagttgcatgctacatacggattacggtccatttaatgttcgggcttactatctttggtgctaagcggcccatatgaagcagataaccggatcgctaagagaagtggcgaaccgttttttcacaattaaaaccactctcctattttcacaatattgaacatgttggaggagagtaagaacgaacgaggctggaagctcagattacatctagatcatactttgttctgaaatgtttaagaccaaaaatataaagaggacatgaaagtcttgatatctcagatacgtagaccttatggaaaatcaatctcaagcttaagttcaatgattgtagctgcatttctcccccatgataatactctcactgtcccaaaatataagagattttaaatatatgtaaaatatcctaatactaaaaatctggacaaaatctattcatattcgtagtattaagatatgtctcatccatctaaaatctcttatattttaggacggacggagtacaatttataatattcatatccaaatttcaattataatgaatgaatcaccaagtgaggaagaacaagtcgaaatgtacagtagaggttaatcacagaggtgtcgaaagcttccaatagcagactttccgtgtgaagaattcgataaataatccatgtacaacaactaagaaccaaaaaacaatgactatcaggattacatatatttacccttattggcagaagaggaagggaaaaaccgtcatgaatcgatggggcgtgaaacacagccatgagcccgaagctcgttgaataccctatctaacaatctggacagtgccttcttccaagagaacgagtatctggacaatgaggctgacacccacctttacttgaagactcattcatatcatcaatacctgcaaagcatgtagtccccatatttgagactaatcccatcgcaaaaaaaatagttaatcaatcctgtcaattaatgaatagaacatgctttgtccactcttctgccgacatttatgaccaacgatagcaacccttctcctgttccacagctgtatttgtagtcgtagtgcacaataaaagcttttgggagctatagcatccagtcagtacgccacataagggtgagactcgttgatgcacactgctatcggttggtctgattcccaggttcaattgtgtcagtttgtcagggaattatgttgcactcatccatgaatttatcgtctcgagttaggaacctcttccagtatctcctgtagcttggtatacctaattcaagccaaggtttcatattgccattgtagtgcaatgctgcagaactccgtgcaacgtcttcatcaattgcataatcatatccaagtccagatagaatcaacctctcatcaaggggataaatgaggtgttggaaagataacaaacttagaggaaaggctgctgctcgcagagatgtctcatccttcgtcaagaactgcaacacaacagagtcagattaatacgtgcaatataatagtaaccatgaggtgcataaaaaacagtgggacaaataattttcagactgagactggaaaaacacaagtagcactacattatctttccagatcaccctttgttgtgcccttttcttatcatatgctatcgcaagaaaataaatagaccagaactataccaacctttttcagaagcagcaggtagttctctgtaactttgtgcttcctccatttatccaaatttataacatttattccagacatccatgcacatgacttggtatcaactgttgtactacccaagagatttctcacttgacccagtcttaaaccacaaaattcgatagcaccatttaccttgtcccccatatcaagagaccacaagaaagaaagatcacgttgaacaaccacatcatcatccaacacaaccaccttatttagatccttaaatatttctggaatgaagaaatgtgagtgactaaataatgataggtattccattcttgtcttcccagcaggttgctcagtactcctaacaagaacacggaactcctcggacagatacaggtgccgcacattaaactttgttaacttctccttgataatatcctcatagttcacgacatggatagctgcctctctgtatgactttttgtcaaaccagtatttcatggcatagaaattttgagcatcagttaagatatgaaaaatgattttttttgggtcctgcgaaaagaccaacatgaatataagcaacacccacctcgaatataatgcaaaaactaaacactgtaaagaataaaaaccatccacatacctttgaactgttcactgttgagttgataacaaccgaagcagcaaggatgttcttagatagtatgacatagtgcctaccatgtgcagcactaaatttgcgagcagaagaatcatttgaacccagtgaagaggatgtgaaatactctaatgtcaacctcatagatagacagtgatgactcttaggcaacgtctgagcaccaaggttgtagaggaatgcactctgcttcatatgaaagtgagcttcatcctcagtcatgtcaagtatctgacgaagtttcctgtcaacatttcgacaatctacagtgcaagattttgctctagctattgtttgctccatctgctccatcttcttgttgatactgaaatcaattgataaatatcattaaaattatgaaagtagacttatatattgatgatgggaaaattattcatcggttgattctatactattttcagatgaatgcacatttttctcaaaaaaaaaaaactatttccccttaagagataaagagtttaaatggcattgtaatttgcaagatatccagatccagtttcagtaacatataactgcaactttaagatgacaatgaaatgaactgtgaaagaccagaagagtaagcaccagaattttaattcttacaaggacggtagatcagcatcaacagtcgatacactaagaaccctctcatggtcttgtatgttttgcttcattagcacagtaagttcctcctgtccttcaagcttcgcaatgcttggataatatgagcgtgccacaaatagttggtcttttagccttttcacaatggagtccttcatgactactttgtgttctctggaccagagacagtagctaccaaattcaagttgacaagccttctcattttccacttcatctgtgtttgtgcctttgtctagtctctttctaactttgctaacctcctgaaagcaatgcatgctcgttagtacctcttgttgaaaaaaaaattctcaggaagaaaaatagagcgctctatgagaatgaagctatcctcgagagatactaggatgcagtatatttagcattgtcctaaaattttgtccttgaaagatactgggacacagtatattttcagcattgtcctaaaatattgtccttcaaacatacagggacacagtatttttcagcatcatattattagaataatggcatgttattacatcagtacgactaaaaggaaaggtaatttttggcgttattgcatactatctacaaatatgtgtttgacctgaaaatatagcatttgataacttctagcatcataatacttactactactgttactgcaggaccttagaattccattttaatgactgaacgtgtcacaaaagtagcaaaataaagtacaaattcgaatgctagaaagcatactcttgtgccttgagttgactccttcacagcctctgatgggtcaacttttggtgagggaagaactgtgtatagatatgaaaaagaatactataaatatcatacagaataaaagaccaatcaggaataactggaatacagcatatagacttcttaaacaaagagcagcagtgaacatattgttagtatcacaatgacaacattgtttctaaacaacatttgcatctagtatgtaaagtaaagtattgggaaatggtgagaagcaagagcgtgggactgaagaaaacttgagttcacatataatatttaggatgaaggaccatgcagttgaaattatgtccatatataaatatataatcttcatgttactatcactgttctttgtgtaacccgaaatgctagatttcctgttaagtttaccagattacttcgtatagcctataaatctataattcatgaatgacatgctagcattggcaacattttagtcacatctaaaaaccttagctgcagaaaatgaactgaagagtaccttttggtttagtgctaatacgggaggtgtgtcgatcagtttgcttatgcttctgcagccctccgctgttaactttgggcgtcttctttggtgcatcctgaaggggggaaaaagaatgtgttagtgttgcagatgcaaccacacaacattggcaattcaccaactgctacaaatactaattctaatttttcatacatttttgcaaactattttttcataattcatgaaaaaaatgtttaagtatttcccttgagaggcaataaccaacaaggatacagtgttgtcctcggaaagctaacacgctagacttaaaattcacctctaagttgcaggtagcaaggattagacaagtatcagtcgtcctggccactcatttattacatcataggagtagataatgcgagcaccttacgatgcattggcaccaattgaggtttcagaagcaaacaacatttacaaagcagtcaccatcatcgaacaggatttgcaaatgcgaacctgattcagtccattgacagtaccgtcaccatccgccttctccacgtgatggaactcaggcaaaacaacctcctaaaagccaacgcgaaatgcaataatttagcgcgcgacgcagccttgtaacacatcgaaatcagaagtaggtgcaggagaaggagaatgggggggttaacagttgcgggtacctgtcggcgccgctcatccgtcgtgacgtaccctgcatcacattcacagtcacagacaaaccaaatcaaacaaaattatccggcggcagttcgaaattacagaaccacagagcaatcgaacaacaagtcgatgcccagatccagcggaagcggcactgatccgagcacgagggggcactgcattcccctcccccaaaaccctccccactaaaatggttccagaaaggcgagagggttacgaaccggattgagagcggtcgaagaggaaggcgaggggaacgagcagcgagcagaggaagagcgccagcacggccacgcgtggccccctccgcctcttcgccggcggcggcggcggcggcagcagcgtcgccttcatcgccacctcgccccactactgacactgctcatggcgaaccgaatgcttgggggaatcgaagcggttgcggtgctcggccacactccgcttggatttgaactgaacaacaacaactcacaattcacaactgatcgatggatggatggatcgatgggtgggtgggtgtagtgcgagtgcgagtgcgagtgcgaaaggggagtggagaaagatggggaagaaagaaagaaagaaaaagaaaaagagagagagaaagccaagccgttgagagggccagcgtgtgtgtgggcgtgacgtggggtccagctgtcacgtgatcatgccaagttgccattgccaaccgtgtgctcgctgctgggccggaggcagcgtgggccgcccgttcgaggatgggtggcctgtattggtaacgatcctagctgggccgaaattaggatcgctgccattgatagctatccatattccgcccaaaactgaacgtatcgcaccgggaagtccatgctccatcgcagccaggctgtgtctgacactagtcttcactgaaaaccaactagaaacaaaaaagaaaaaaacttgatcatatttgaggctaggagcagactctgattcttctacaacgaatcagggtcactggatatgatgatccttcaaggccaaacggcactagtttctaaactctgaacaagcagaaaaaactgaatgaactaaagatcagttgttagtgatgaacaggtgaatttttcatacggataaagagggaaagaagcctacactcattaccactaaattttatatatacatcatttgagaccgtatatgttcctagatatggggttactagcattgacaaccaactggtaacattccttcagatctttaatttcacataatcatgtagcagccattcttcttgtacaccagaaaattgccttccagattgtccaacatctcgacgacacattctcttttcgacccattgaagtgcttgacaacatcctccaacgaaacctgcaacaactaagatcatcaacgaggaacaacatgaattccaatcgaagaaaattcagaaaaaaaagatgtcttaccccattgcgtccttcaaccagttctagtattgcatcctctgtggcaccgattgcggcagtagaatttacaccttgcccgtctatcttttgtagtttacttgctggctcatcaccacaaatcaatgacccatcagtttggcctctccttgtcaaagggcttgcatcacaaacatctgcgccaacttcacctccattggaggtggtctttggtgcctctgatgtcttggactggatcccatcagtaggaacagtaccaaaaacttgatccgacaatccaagtccctcaattgccaagaatgtctggatcatctcataagttacctgcaagtatcatgttgcattttgccaggtaaattaggccttgggaacgctttggatgaactaatatctaacttggcagtgcataagaagcagttgtttgttgatgcaacagatctattagatattaacaacagtagtctaatcatgcatggaggaagggttacattttctggaagttcatctttgattggcttcaacttttcatgtgatccaagctttgtaatggcaagacggatctgtgaggctatctcatgtgtaagtcctacctcctcacaaaacctactccagtccatctcacatccatctcgagcagcatcaagtatgtaggaaatgactgttttctcttttattggtactgctctgcggtaatgctagaataaaccaggatgttaagcagtgaacttaccaaatggatctatagcaaacaaaaacaagggcaactcaccgcaactttctggaacgaaaacttcattttctgccacaattcccatgaacaaaatttcgcgccacccaaactccttgggagattattttgtgtaggttttggagcagcaggtatactttctacagccgataaatcatccacaggaagattcaattcttttgccaattgtgtgatattttggatgaaaatactgccgtaatgcgagatgaagtgctgaaaaccaaaggtcggacattatgagtattaagacaaaatatgatcacatccgtcgtattttccagtagggtgcaccgcaaaaaagtttagtgctctgtgttatggcataaaagtgtgttagctactattattttctgaagtgatacctggttaacaccatcaatattagccaacctagctatggtgctaggcctgaacttcgcaaagtttcttagtgtctgatcaccacatatagcgtacctgaaataatggattaaagagattcaattcagtgttgctccaataagtaaagagcctagaaacctaaacctattgttgtcaacatttaagtatttaactcacggcgccgttccaatatcttgtgcaagttgcatcctgacattcaagagtacttggtagattttcaattcatcctgaaagagatccaaaatgagactaaagaactctaaaataatgaattttacaaataattcctctgagaaacttacctcagaaattttttcagattctgatgggcccaaaggatttaagccctcttctttacactgtgaaccaccatgcccctctagctcaatcatctctgcagtcagctgtaaaaacagcgatgctccatcccctttatcagcagtggatagaaacttgtacccattaggactaacactgaacatagacacaaggaatcagtgagttgtggctgtttgagcattcatgcttgggttaactggagtcaataaattcgaaatgagctagcaaaatagaacaagtagaatattatcttatgcagtgaaaaagaaaatagtcagcacagcacctgatggatctaaatgtatcatggacagtctccttcaaataatctgcacacagaataaaaagaaataacaaatcaaagtgacaatgaaagacaggacaaattgttgtgacacctgatgaataaattcactcactgtagccattaattaacagtacagcattgacaaaacgatactccgaaatctgaatttcagtgctaagagacaatttaagaaataaacatggtagaaaaatacagatcttgagctctaaaaaaaaggtctctaggaatgaaggtatacgagaagaagggtatcccaaaaaaagggtcagatgaaatgagctattatggtgcctactctgtacaaaatatgctgtttgcatccgtgccatatgatcgaggacctaaggtcatgaaaaacactacttttactaaaagaatgaactgcagcatcacaatgtttattgatactattattttaaaaaaatgcaaccatttattttctccaagaaaacgacactgtacatatgtacaaaacttcaagtcagcatacagaacatgtatcttagcttgcacaagaaaatgactaaaaatatgtagagagaggcatacgatggtaccatgtgctaaaagcaggccgccaagagctttccaccagtttggtggatagtcttttccccgcccatgcaatggaagtttatcaaaattgttttcaactattttcttgacctacaaaatgagaaaatacttaccatgaaacataatcctttacaaaattgttactactgctcaaggctaaggtatttttttcaaaaattattagttgtatcacttatatcttattatcttataatgaactaatttgtgattatgaaaagcttgaacgatcaccaggatagtgcagaaaatataagacctaaatatacattccttgaaatattctattcacattgatctttgttcccaaaaacattatcagcacacaggtgatcttatccaatcaagtgctaatggccaatttatgtcacaagctggcaaaaatcacaaacatcaggatagaaaccatacacgtgatccacggagaacatcaataggcaaattaaggccccaccgtccaccacaggacttaatgcaggacagcaacaagaaggattcttttgacaaatccctctcgttttttgtccttgtgcaattttcacaattacctgcaaatcaagagatatgtcaaaaaccaatgagccactagcagttgaaataagactcgaatatatcttactctttttaaatggaaaacattactagatgagttcaaactgactcttaaatgtaacatatatacttaccacagtcagtggtgcggtcttcgccaaagtactgcagcaagaattttctgtgacatgtagcaagcaggcaatatttttgtgctgccatgaaggactccatgatggcttttcgatgagtttgctatcagtgaccaaaaaaatatgagacactaaaatagtaagcaactgaaagaactaggctgcaaatatgtaagatatatcactttggcatgaacagagatacgatgcacataatattcacatacacttttagcttcagcacaatagaaatcagatttcataaaatcacttctttggtaatatagccagcagactgaaggcagtccatctcttccacaacgcccactttcctggtagtaggattccaggctctttggacatccataatgtattacacatctaacatctggcttgtcgattcccattccaaaagcaatggtagccaccatcacaagtacttcatctctaacaaacgatctgtaaaggagaagcataaattatgatgagcccctattgtaccagaccaatattgcaaaggcagcatgcatattataaattgaaaggtattaactactcatttcatctgtctaaatatctttctagtctaataacttcatgatctagtgcatacgtaacagaatgccaatatttctacaaacattaaagatcaaattatagcactgcaatattcatagatgttcgtttttcctcatgaaaattgtggcacgatcaataaaatttaatacagttatgcaaaccgtagccaacaaaacaattatgcaaatcattctttatgcaaacaaaaagggagtaaagtggaaagcataatgaaatgtgcacaaagaaattaaagtagatgatatacctatgtgattcctctctagctttatttcccattctaccatggtaaatgctggacttgattccagcagcaaccaatgcctcatgcacctgaaagaaaacggcttacaagtcatcacatgtgcacctattacgaaagttcaaaaatacgtaaatgcatgataccataagctgtaaacctgttcagtctctcggatggtagtacagtatattattgttgagccacccacagtacagttctttgagacatccttcacaagttcattgataaaggccatagaccggttgcatgatttcacgccatagaaaaggttaggacgatcaaatgatcctaccacaatgtgaggaatgcgcagggtcaaggaagtggcaatgtctccacgtaccctacaaaattatatggcactggtcaaaaaaaaattatatggcactatatatttggtgattggaagggaaaaaaagaattagccactgtaaacaaaggtaacgcaacctacgaggctataacaagtgaacatgtctattttgaaaagaatgagcatcaatatattttattacaatagaaattagtggtcaaagttacgttttggggaacttgtcagtgtccaaaacagcatggtttcatgaacagaagggagtataatcaaatccctgcatttctgtctacaatatattttacacgcatcaagaccaaaatttagtgccaatgtgaaatggaaaatgacatttctcccaaagtcaccagctaccgcgcagcccccactctatcacttgattcacagtttcagacatgctgtcagtttacatatgaacacaataatggaggtaagttacaagttttccaagccatttccagcttctatgatatgtggagtattgtgccaatagagatataattatacccctctaaaaaacatacagctatacactctcactattcttactttaaatagagaagaaacataataatatgatattattaatgggcgaaaattttaccaagcagggaaacaactaatagtgcaacatctatacctttgtgtggctgttgcagttaaagcgacaaagggaacacccactagaaggtcacgcaacatatgcaactgtttgtactccgttctgcaaacaagaaagagaattgcaatcaagaaaaggtcagctatttattaaactggatggtgtgagttttaagggtgggagcacaaattggtaggcagtatgaataacctgaaatcgtggccccattctgatatgcagtgtgcttcatcgacagccaacaagcagattccggcagcctgcaagttactccaaaacctgggaagaagatttagaatgtcaaatcaatagaccgaatgctatgttatcaaacccatgagtgatttgttgtgtccatgaaattgaatgagcatgcctcccatttccagacaagcaaatacataatcaactattccttttagactaaccacgcataatcacaaagtggatgtgactagagtttatcaaaagactactagagtctgccttttaccttgaaggaagtgagacagctttctctggtgtcatgtacagaacatcgaatgcgcctttttcagcctgaccgctaacagagatgtctgtttgggtgctgccaaggtattcagacttcacgccatgctgctttaagctcatgacctatttgaagtagataagacccacgattatgttttcttgtaaaaacaatcaacaaagatcaaagcaataatgatctgcaatgagtatttgaaccatacctggtcttgcatcaatgacagaagagggctgacaacaacagctgtcttctttgtaacaagtggtgggatttgataactgcaataaaaagaaatcaattagcaatcaataactaatccaatgatttcctggaagaagaattagatgatttatgtatgtgtatacccaatgaagatgaacttaactacttaatatagctcataggctctatattactatcaaaatcattatgttttatttttctaagatagcataaatgcacactagaaataagacaaacccaattctgaaagaatgttttacctgcccaatcaacaaattacacaaacgccaatatgaacattacacggcgatacaacaacccatatatcaaccaaatgcagcattccaatttagatttcatcactggaacgatctaacttgcacatccatagaaatatccacgatagctagcaaacagtggcaccgcacgaaggaagggaacagccacagcaaaattttccccacagggaactaactcaccagatcgacttgccgctgccggtggccatgacgaccaagcaatcccggccttccaggaccttctgtatgatctcccgctggtacgaacggaaccccgagaagccgaaatacgtctgaaaaaaaaaaagcagaaacgccccagttcaagcatccagatagggttttagcccgcgggatcgcggggctagggtttattagggaatgggaacgccattagggcaacgagcacttgccttcagagctgcctccatcgtacgtggtatggggctcgcgcgcgcggtcgcgcccccgcgtcggcttcggcgaggggagttcgattgagcggcttcgggaagaagaaggcgaggcgaggcggctggggtggagtggaaggggaatgggaggacggaacggagcgatcgggaggtggtggcgaaatgggtggtgttttggtgtttttggccgggtagaacggaacggggagcgttgcggcgggtctttttattggacttcccgccatttcttccgtttccttttttttttccgcatggtcgcgattattccttaataataaaaagcctgtgaggcccagttttagcccattaggccttgtattctttttcgtgtggtcggattaagtttacttgtggtccctagttatcattgagttcgaattaaatccttgaaccgcaatagttgaagtgaaacccccatctttcaaaaccaggttaaataaaacaatatacgatgattgggccccacatgtcttttatttaacctgattttgagaaagtaggattcaacattactgatattacggttcaaggatatcatataactttgaacttcggattcaacattactaacaggcccaccgttggcacattaggcttcggcaaagccggccgtatcaatttatgttttggcaattattgttaaaatcttagttgtttgatttggactgatgctaccttggtttaaattttgtcgaaaataagcatatgttgagatacagctaccactgcagttttacagaccacacaaatatactacctacagaaatgtacatagacagatcagaaagttctaactggatacgttgtcgagcaaggcctctgtatgattttgggttcacaatgctaccctgaaaatagcaacgttagcaatgcacccagcaaacaagattagctagcatctctccgctgacagaattcagaaattttagatagctcgactgagaaatcctgaaccagaagacatctctacacaagtcctggcctcaaatgtgattacaaaaactcctatgtcagataatgggtgggaaatgtcaagaggcaaagatcacaacaaggtgtcgactacagtggagattgcctgaggtcctcctcgctcaagtaaagccaatgcaagatcgtgctcattccaactccgaagcccagacgctatcttctttagcgtgtccagtttaatgtcccgcaaccatgacgggacaaacttcaccaccaggaacacaaagcgcgatacatatgccttccaggtgccatggtcacaacccagaagaatgtgcccatccaatacacccgccatgaaatccatatggtttcccaccactcgtggccttcttgacaggaaagacaatttcatgacaggagaagttctttccgctccccagagcagactaccacagaagaagagcatgttggccatggcgtaaccttggagtgtgcttgaaactggtccagggtctttcatactctcttctcgagctgatagcagcagcgtaggcaaggtctcctcatacaatacctggaccagaagaggtccacctgcaacacacaggagtcccccaccaagcatcgcaacttgatgcgccatacatgcagcgctggatagtggcgtgcgtcctgattttaactgtggagggccactggaagagaatccatttgcaagtttgtcagcccactcaatgacttgcttcaggattacctcactcacaaagtaggtgtcatggaatgttcgacaagttctcaggtaaatgaaaccaggagccatgggaagctgaagaccttggccggtgattgcatctcccattaaggcaccaactccacggtttgcagtaaagtcagacccactgcacgaggaccgtagaaaggatgagaagcaactttggatgagctgtgcaactgcatctttatctctgccgaatggagaacgcagacaagagaggatgataaagtcatgccatcttctgactttctgtgtccataaggctgctatgatgggcatacttggccaggaactgccccctgcgcagttctctagtgcctggccactgatcgcatggatatactctgaactcttatcaagcttaaatgtaattgttaagctgaccagcgcagccattggtaaaggaagcattggtggtacaccacctgcaaaatgaaataaagaaactatattcatgaagtgatattaaatggaatgaacttaaaagatcatataatgatggagctgaaatttatcagtaattaggtgtgaagcaatgcaactaaattgatgcacaagaataggatgcaggtaatacgtggatagcagctgggaatctgaatgccagcagatgcgagaatttcctttatttctgcttcgatggaatgaagagaagcaccaggactaggccattcagttccattcatcgggaccattttccagattcctcgtgtaatttctgctaagaagtagctaacaattgctgcaatagaagctggcaagaagtccacaagatctctcaaacctgcagcacataaataagattaagacttggggatcaaatcaatacggtgacatgaaagaaatggagtttcctcacttgtagtcaagtctcggctggaaaaccgtccatgagcacatgctgtaagaacagcttcaagaacaaaaggaacagcttctaaaaattcccatgcaggaactgttggcctttggtaatcatctggtgtacttacagaggaaccactgacactactgctagaagtggatgaaagattgccagatgatacaacaggtttgttcatttttctgcaaatcatactcaaaatcttgtttgcaacttgatgaacaggatttttgttgcaaagaccagaaagggttgaagctatgcaagcttgattctgaaaataccaagcccttaacttggggaaagaatcaatataaagtggttgagcaggaacctcatttaatggacctatgttgttgctagagtttctactactggcagatgaatttgcaaagtcaatatggttattgcgcattaacagcaggtagtccagagtaagctccaatctaactgagcctccacgtccagctagacagtattcttgtgggggtttataaaatttccacagtcgaagaagacaaagaaatgcacaagagaagaccgaataaactgatatttcaccaacaatggcaggcttgtggttagatggaggtggtatggacccaaaaacttcacagattggcattaaagctgcagcaacatctggaacctgtattttacaaataataaatggtataaatacatataggtgcagacatggagttagcataatagctaatatgatatagacatgaaaataatcatgtatcatgtaatgaatgtgtgtataccattatgctagtcataagtaaaatattaatatatggtttcagtatatcatgtacaatggctctcacaaaaaaaaaagatatggggaccaaacgacacggtaagctatggcagtcattaactgttagcaacaacaaatgatagacattacagcttactgcaacaacaactacaaaagaataagaagataaaatgttagcaatgagaggcaaactgtagaagatttgaaattgaggatatataagactacacaagatcagctcccatgtttaataatttgcctgtggccttacagcagctgcattgatttgtaggcagttccataatttttactttgaggagaagtgaagaacaaatcaggaggatatttttttcccctttcagaagattaaaataaaggaactataatgaataaaaaaactatgcaaaacattcaccagtttgatattttgagaataaattgtgcaggtgatagtacatgatgtattgctcaccattccatacaaagaaataatgtggatagcatcaccataagaaataccaagcaagagtgcatttaatgtagacatctgagcaaggtagtggctcatgctgccctgtgttgaggaatttgagggcaatggaggtgataatagcttgaccaccatgcggaccacatattcctgagacgacaagtaaaatttaaataatcatcattttaggttaaaaagtatgcaagtgcaaatgaacctttttggcttgctcataagcacaaggtcaaatcaggggcatgaccacttgtaagcgtgcagtaagataaggcatacatcatataggaaagaataggaaagacgaatttgcatgtggacatggccatggcagtagtagacacatcaaatgcgattgaattgtatttcagttaaattgtatcaataaggtgagatttttttaaccatatgaacataaaagttgaaatggcaatataaacaatttccaaacttctttacacaatataattaatctaaaataaaggtacctggatattccaaccacaaacaaatgatgcaccacaaagaatttttgcagcagctgatttttcctcctctgaaccatttaatgctatgtgatataacctatccaattctgtggtgctgaaacagaatttcaaattaaggcaggaacatgacaatgccagtcaatagaccaaaaaaatgagcatgaattgggaaataaaaagaatcattgaatcgagaagaatcagcttaaaaatggagttcctaaacgtgaagtgctagtcctagtgtcttttctaaaattcaagctccaattgtttcagagtatatcttaatgtttacgttgtttggaaaatggcagaagcgttacacatttaagttatcatcttgcttgtggcattggttgtctacacgcagcaaagtggtaataggaaaaagttcctagctgcaggataagtggttcacttggctactattcatttgctggttttcaagcaggctctaacatgtgaaaaccaaaaggttgccaaataagtgaccgtaaggatattgaggtcatagagcaaggagatagtaaagatcaatgtagatggatcttaggaaaggtttggggatctgttccccccaactctcagagtgtcgtctcccagagagaagtattgatggctacgattgaactactccatctccaggatagtttccaatcggacattacagggcaatgcatgcactggaaaatgctctaataatatggatatccaccatatcatacagagagatgtaaggaactaatgtagttcttcggttcagatgaggaacttagtagcatcaatgatgtaagtgtaaccattcaaggccaaactcctaatggtgaatggcttcgattgaattaaatttccatttttgtcataaaaatatataatttcctgacatgtaaacctggaaagttcagcacacattggattttcttttcttttcttttttttttttgcatccaacacacttgacctgaagaattcagagagtttgcttagccaggggtataactcgttgtgcaataggtagtattctttcttaaaaattgcagtgcagcaaaccagcccataaaatttataattttctatactaagttactcgctgctagtataactgcataccttgaagcaggagtagcaatcagagcatcaataagtggacctgaaagtggtgctccttgcataaagtttaaccagggggattcttggggtaatgtcgcatctttcaaatgcccagatgatacaacatagccgggccataagtaagaagatgtatcaatcaaattccttgaaatacaggcttcaactataagatgtagcatattcccaactgaaaagggatagatggtaagaacaaaaggcctaaacaactttacatacaaaaataaatatatttgcatatagaacaaaaaggaaaagtggtagtgccaatctataaaagatgtgaaagaaagaaagatgcgagtatttgtgaacaaagaaagattgttattttaaaaaaaaaatctctactatcaccactaacacaaaggcatggatactcgtgtcaacgaagaaaaatgtgaagtatatatagacacggagaatattatggataagatcaaatctcaattgagtatcagaagtgtaccagtttttgtcgaagagtcattttggcccatcatgccagggttgccacctccagacttatagttggccttaaatgctgctgcttttgaggctgcagcattggctgcatttaccactgatgaaggaggtactagaagtcctgaatactggatcaaatcctggagtgatgatacaagtcctgatgtttttggaagacttttgcttccttgagctccatggacatcagtttcttctttaagaattgcaccaattgataatggaataagagctaatagcatgcatagtcttgaatctagatgaggaattggtccttcgagaggttctctagcctatttagaacatttacatgtgagacacaatacaagtgtgtgtgtgtgtgtgtgtgtgtgtgtgtgtgtgtgtattcaacaataatagccaatacagaaaaggtctatttacccgctgtacaaggcgaagggcagaaatccaaagagctttaaaggtttcctgccaactcgcctcattaattgcttggagtgtcttggtcatttctgattaagagcaacatgatattagtcaataaaaacatgttatctcataaagaattgacagtaaggcggtgttggttacaaaaaccatgttcatcgacattgctagccaacatttaagatgaactcacggcacacagatagttcaatgtattgcagccattttaaagaatgaatacagaaaaacaaaggcaaaatttatgtcaattaatcggattgtgtatgcacacctttcagaacctcgatagcagatatggcgcttagatgttttccatcaattgcattctcaacatatatgtcaaatataacccagcatgcagctctcccagctccagtaaactggcccagcatggagccaccatatttcatgttaccaagaacacccaaaagccttttgttgtttggttgataggctgtattgctaaccctccacatattcatcaacagatcatcaattttatgattagcagtcaatagtgtctccaattccattttgtgagcttcaaccaagctcaacctctggcttaacacactgaacttttcaggcctaacctagaaaaactgtctcattagcaggcatttgtaatgtgcgtcacgcacaaagtatgtcaggagaaaaggtgtattctttaaaggttcttaggaaatttgcgatgatatgaatcaataaaaaaaaaacttagaattggatatttggatagcaatttcctctaactgagcatgacttacatgttcaggaatatcaagcgcagaaatgattggatcttcctatcagcaaccatcataatcaacacatctaaagccataacagtgttcttccggcgtagttgtgcacggtgctcgttttgcttctcagttgaaacccctttgacatctaagtccatatcctgtggcccttcaatagcgtaaatgctcccctgctcctctgtcagcccggatggaaagccacagtcttcaagtgtgcaatcgatcagtttggtgattacaaacatcataaagaaaatgatgacatgtccattgtcgattccagaaaatccataaatctttgacagttgcaaagcatcatcgatggactttgttatcctgaggaaaaaaaaacagcaattccattttagcaacatccagcaggatacaagcgactagtacgttctgctctgttgttcatactacagaagtacaggcaattgcagtatacccctactttgaatttggcggtgcagggtttacaattttgttgaaaaccgatcaaaaatcatgagatttcgtgatttcgagccagttcaaaattcaatcatagctactgattgtgctgtgcccttgagaaagttcatgaccgcacactttccgatgtcacattccaaagcagaactcttacttgtctcgattaggcccggcctccatggagagaaaggaggatgtgacgttacttctcagcaactccaggtagagccggtacgcctcaggctgcgcccgccgctgcggcagcaccctgcaaaaacccaccatcgccaaggagtcactcacaaaatgcttgggaagatcaccgaatccgcgccacgaacgaactgggaaaaggggacccccgccgacctcggggtgaggagcgcgaggacgtggagcgggcagaggaggcgggaggccacggcgtggccgacgagcttccacagcgagggggagttgtgcgcgaagcagaggttggagacgaggatcccggcgaggtccgcgctggggagccccgccccctccccggcgacgacgcgggccacctccaccgcccacaccagcggctggtccccacgcgcctccgacgccttcagcgccgccatcaccctcctctccagctcccctcccccgcccccggcgggcaccatcgccgccgccgccgccgtcgccgccacggtgacgacgccgacgagggtttggatttggaaatttgcaactgtgtcctcctcacgtggatggaccgcccctctcgagtcttccgattcgtgcgggcggtggcgtttatgaaaatggcggggcagatcgatctgggccgtccgatctgatccgagggtcgggcacgcctgtcaggtgggcccggacgcggagaccggacaaaatcatcgggtgactgtgaccaagcacgaatgattgggaaagaaatggtgtcccatgtagtaaaccgttatagctgttggctcacaatggggaaaaagagtggcacctgtgtgttcatcttgttgagaatctatgtgtatcgctgttacgttttcaatggtttttaaacggattgataaaatatgatgcttaggattgtgtgaattcatttattagtgtgttttgtgcgagtgatggtgtgttgatgtggattagtttctctgcgtaataaagtagcacatgctaaggttcaacggatctggagagctgtggccacggcagacgtatgagctgacgcaacgtttttttcgtgtttgtcatttgtgagaccaacgaacatagtaaacctttgctatagtcatttttcagatcttgcgcccgctttaagcttccctttacaattgttttgtgctttgtctctttgttgacgtagaaataaaaattgggtaaattggaaccatgccattataaatttgcaaagtttgagatatgtcatcggtatctcaatgacatctagaacccacatgagtcaatgacatgtgggtcaggatgacatatctcaaattttacaaaattataatggcatggttccaattttcctaataaaatttcatagccgatgtaagttggtttcgaatgccacgttaaaatgacacttgtttcttctatgttgtctaatactatatctctattaaaatattatcatctagtgatagatgaacacattgtatttaaatttagagtgttaggatatgtcacatagatatcaatattttgggacttcaaaagtgttttagtgcaattaaagttaaacagttgcacaagttctcttttttgatttcaacgaaaaaatgtcgagccgcttgatattttccatgtgtttcggtagggtcggggcgatcgatatgcaaccaaaacaatcacgctcactgggactgacagaatcatcgagttggtcactcgttcaatgagaaatgatggtcatcacacgatgcaaagaccagctgctaatggatgattaacacgttgtccttccttgtaaccccgccgataagaacgttgaccttttgtaaaaaaaaaacaaacaaacttcgtcaatgacacactattataaagtgtactactagcagtgattcagtactgacatgacagtatgacacattgacacttacgacaagtttaatagtatagccaattaatagctgcaaattatctatagctaatataatatacaattcatacaatagttgtttactatagtattaatatctgatcatacctgtcatacacacattacgtattggagtccgtactgctcttatctctattcatttatctatttaaaatatatatttatagctagcttataggctgctattatacatgctcttacggtagtaggccgtaacaaactggtagctcgtccatgggccattggattttctgataccggcctgtggctaacagcccatctgtctcatccatttttcacaattgtgttgggctagtgcgcgactggaaggccttttgttatggaataatttaatggccctccctcatctcttgctcccgattaaatcacctctctcaacagtaaaaccaaataagtttattatgttgtgcaccagttttgaaagacgagagaagtgttatacccaattttacggttgagtgagacgattcaataaacagaaagacaagagggagacaaacagacttattccttttgatatctactgaggcccaatattggtgtcactcagcctttcgccacagcccagcaagtctcacgccgaactgggccgtatatacggcctgtgggcacactggcgctactagctagtactagtgtgatgtgctaatatgctatgctgtggtaccttttgtattcctacaaatttactgcagcaattttttttgtgtttcaatcaggaatgtaaatgaagtaacgacctttttttaataaaaaaaagacagataaacaagttgccaagcattttggggacctgcatggctccttatattctacaaaataacaactgtaaaatttttgtgtttcactttcaatcagggtcctaacatggagtagtaatatcctccaggaaaacaagttaccgagcaatttgggtgcctccatttccatgcaatgcaagcgtgaaagtgaccatgttattttcaacttttttcgcccaaatattgaaacagataatttgctttacgcttcaaaatatatgttgtctcaacaaaattttcttctactctattacttggacagcttgtattcagctatttgataattttatttcttgaattatttagtttacctatctatcaagttgataaaccacagcaatataatccacccaataatctaaatgaaacataaggattgctattgaaagggaagataaaaaccaaacaccgaatttttaaggttgacgtgaaagttagagatagctagggtcaagaacatccacatcactattcgctagattagcaagcgtacgtccatgtagatgtataatatcaacaccacctcaccacacaacaagttgtgcgaatgaaggccacagaaaacgaaactcaggccctgcactgcattccgatgcacaaaacaggcactaacagggataaggtcgtagctgcaacaaaagtggaattgccttgcctt

SEQ ID NO: 73415 - DNA, 1153 bp, Oryza sativa
agaaccacacggcgtcttggctcgtcgagccctttccccttctttgctttgctagacatgtccttcacgtagaaaacatacgttacatcattggctaggacgaatggttcatctgagtgtcctaccttgttaaggtcaaccgttgtcatcccattgtcatcaatcgttacgcctccaccagtcagcctaacccattggaaccgaaacagagggatcttcaggggaccataatctagttcccatatgttatcgatgacactgtaatacgtgctagttgtaccatcgtatctcatggcatcgatacgaacactcttctggttcatgctctttctgtcttgggctcttgtgaaaaatatatacccattgatttcatatccttgaaatgtcgagatcgagcaagatggtcccctcgccgagaaggctagttgtcggtcaatcatcccgttacccacgagatgttgttgcagccaagtggggaaagtataaatgtgatggcgtgtaatccaggcatcggacatgctgatgttttttgagtgaacaatcacccggtgctcctcgacgtaaggagctaccaacaaagattattgcaaaaccgtgaaatgtgctttacggaataaatcattgtctacattcattattgctttcctgccaagagtgtcctttccccgtactctcccctcatggattgattatggtaccccgattcgacgaaggtcttcaataaactcaacacagaactcaatgacctcctttgttccataccctttgcgatgcttgcttctggacgagaacggttacaaacgtacttctttagaacagccatgtacctctctaaaggaaacatgttgtgtaggtacacaggaccgagaatatcgatctctttcacaaggtgacatagaagatacgtcattacattgaagaatgacagtagaaaggtcatctcaaagttgataaggcattgcaacacgtcctcttgaaacggtgttgatggtcgttatataccaatgacgaccataaatataactaaaataaaggagatttagctatgcttgcaatgcatatttattttagaataatctacttccacttccacttgtagtattatttgtttctagggataaagcaaataaaatggacaagaaatgaggaaaac

SEQ ID NO: 73416 - DNA, 716 bp, Oryza sativa
agtctatagagatcaactggttggtcaattcatcatcaagaccagacataaacttctcctgcttctaggcatcggttcgcacgtcataaggggcgtagcgcgcgaggcggttaaactcatgcaaatactctataactgttttggttcacccgtgttattagtctgtagtttatcctctactctggaaatgaatcaataatataagattagccgatcgttctgcagtttttgtgtttgctgccaaaacaggtatcaactgatgaacaagaaaaacaatattatggttcaaatactcaaagttatactcacagttgtgatgtatggacgtcaacgttgtggaatatttttttcccacctatttgatactgactggttgtcaattgttactgcacgtcagtgttgaggaatttttattcctacctattttcttctatcgtgctagactttgatgaagtgttgttactggatgtcaattcttgacagccaaatgttatcataagtcctaactaatcttaactctcccaagtaaatacaagaaaacatcaagcacttacaaatttaagtacaagtaaatgcaagaaaacatcaagcacttacaaatttaagtacaatcttccagcctttgttgtgaattgtgatagattctcacaaaaataatttgaacagacgggatcttggaaaaacatatagctcacgacaggaataataacaatggt

SEQ ID NO: 73417 - DNA, 3962 bp, Oryza sativa
catccccccccacccccacccgtgccatagggttggctgctcctgctcctactgtacacagcttgattgatcctttttggtgggtgtggatgttgggggtagcatgccgctgacctgctcggggagatgcagaggtacgcgggtgccggtaacaacagtgggtttagtggcggcggtggcgcgggtggaggcggtagagacagctcgaggttggatgggtcgccctactccgccaacaattatcccctgagctcgaggtgacgcgctatcgctccatttctttttttttccctccatccaacatgatttcttgttttaagccatgtaaacaataagatgccctagtatgctcttatttagttggaatcttccaagttgtaattgatatgatgcgtgtacattttggatgctacagtaatggcatttcttcgaatcataacgattccgtactgttttatgacttgcgttacttgcatgaagtaactgccgtaatcaaactcaccacatgttctacgtataatttcccagctattatcagaatgacttgataaccttgacacaaactgttattgaaccacaagcaatcaacatgtatagaatgttgttctgaccaaaggaaattttttttagtaaatattttctttaactgatgttgctgatatttgtatggttacgacaatactttctctagaaattagataaattccgtcaggctgttcatttattagttaaagaacaagctaatccgtcacgtatagtgattgaatatatattaccatgccatgaatatcaacaagaccatcatcagttcagttttattgaatatagctcatcgcgataaatccctccatcctagttgtatttcgtataaccatctgattatgtagaacatacagattaataggcgtatatatatgacatcatgctttggaaatcagaatgccatagataatcaagtttgtatcattagtatgatattgcaccacttcaatctttgtggtatggttagagaaggagcagtcattttctctttgatatgtgatcgaatgaagtagtgaaagaggttatttactactgcctcaaatcttatacttgtcatgcatatgctttgccatgtttaaaataaaatatgtcataatattgctaaaatatgtaaatgcattttttctgtcatgaaacatgttgtttacctttgatctatatggaatactcaccttaatttatttataactggcaattcatttatattcgactgttgtgtaatattaaggaattcaacgggtaatatataaaaactgcagcgggagtaagtggggtggcagattcactcagcaccatcactccattcttttaaaaagagtagtttatttttcgccgggccagcaaaggaatggtggccaaatttattaagagcagagaggaaaatggttggtttacataacaacaagattgttggatgctacttaaccgctgcagccaaacatacctgacaaaatcaaagtgcaacattaggaagccaagatagagggataagataacagctttgctgcacgccacacccatagctcctccatgattgtctcgaccctcattggggtggatcaaacctcaaccctcacaaataattgaacatggaataaagaatatctgctctgtcaattcttcacctctattgcttgtccaatatcggaagtaatatttgatgaagagtacaacgaacttgctactgtcacaatcactttcttagtatcgattttctgtcaacagaaatgggggtacctaattcaaaccaaacctgtgcaattttatcatcacaataactgaattttgatatgtttttcttcttcattgttgttttcaggcggcagcagcagctagctccttacaagctaaagtgtgataaagaaccacttaataacaagtacgcatatacttcttaccaaagacagttcactcagggagttaagtgggtgtttattaatctagatgttaatctttcagggattgcatttcctttactttctttgcccttcgttttaactttggctgtgctctttgcgtaaaaaaacacatctgtgttgtccaatagcaagttagcaacaaatagtaaaatactacttctttatcctataagatattacttcacttgatcttaggcagtccaactgtacacgatggctcttttgcaggcttggaccacctgattactatcctcaaacaccaaactgtcctgaagagacattgacaaaagaatatgtacaatctgggtataaggagaccgttgaaggaattgaggtgcgtatggagatgaatgttgtatacaatgtattatgagtttgaatccaattagaaattcattaatgtatctatctgtgctatgcttattgagtttggatatagtccaatcttgtatattgactgattcagttttttcttgggattcataggaagccagagagattgtacttagccagatcccgtacttctgcaagacagatattgttgtaaaatgcaaagaggtgaggaaacttggccaatattttctcagtaagctcgtggcatgatcttattttgccattgtgtttcggaagaaatacgaaaaattctttgcaatagcaaatggattgacagttcatggtaacaaagagacaaattgccactggcaccaaccttatattccaatgttctgtatatcaatttggcatctaggcataatttgttgcctggctggtttactacccatgctatttgattaccttgacttactggagattaatctgatatcctttagttataaagtgtcaccgactattaggactaaatctcagaacttattccatcctgcaaggatagttagtctagtgattattaagtctttatcaacaattgattctggcttgcacagttgtaccagctatcatcaggtgcaaacatttaggcaaaaaagttgctgtagattgtgggttgtgtgtttctgttctcttttaggaaatcttgtttctctcgtaatctcaaatatgtatgttgaagatgtagttctttaaatgttgtaagacaccacaactataaatgcatggatacatttaattaacatggttgattggtagcttcatccttttgtttttattttatgatctgttttgatgtatgatatagagtacttagtataacatttaacaatttcttcattatttgctgaaggcactaaagaagcgcttgagagctataaatgactctcgtgctcagaagagaaaggtagttgtgcaatatttcttgatttggatgtatttacctcctgacatcatatcaaacagaccaactaattttcctgttttagcaggctggccaagtttatggagttcctctttttggatcactgttgataaaacctggagtttatccagagcaaagaccatgtaacgaggacacccgcaggaaatgggccgaggtcgacatacttgcctgttatctgttttcacatgcttttttcaatggaactgttggcataatttatgaactgtcatttaagttttcttgcacttttatcttgagcttgtcgctagttaatacttaacttttctgctctagtttgaatcttctttttttaggaattatgggtttagcatacaatcgattagaaactttattttttgcttggtgttgctttgactttaaactgcttattattgtttgaagtcaagggtcaagtttgtgtgaggcagacctcccttaatgcatcttatcatctcatcggttggaacaatgcaagtcaaataacctaagaaaattgagttattttgtttacagacatcattttctacttctgtgatatcactgctgccatgtatctggctatctgcccattttaactttttgattacatgtgccatcgccatgcaggccctttcccagccaaacaagcgactgcgttcattatctgaacatgttcctcatggttatcg

SEQ ID NO: 73418 - DNA, 756 bp, Oryza sativa
gaaaagcttgaaatgttttgccagtttctacctttatcctttttgctagttacaatgtttaacgctgtgaactgatgctgatggtgtgacaagtagtggtacttgtcttaggctcattaaatgaatcctacagacactttgatattatatcctgtgagcttggtcctcaaattctgaacatttgccatgtttttttgggaaccaattcactagtcttgttggtatgtttaccatgctttgtttcctggacttggagtatgctgtcatctgagaaaattggtagtgcagattacatgcttcaggcttcagcaattaccttcagaatatgctggttgcttcttctcatggacaatgtttaccttgaacttcagcatccattcatatccaacatagggaaagtttgggaaatatcattgtaaatattcatgagttgggacgtgagaatgacatgtgagacctagactcaacgtcaatggcacatccgatggtactctctccaatataagaacttgtctagatttcgtagtgctagaaaatgttccatccagttttaagttcttatattttggaatagagggagtagttttcaactccctgatttttgcaatggtgaatggcaaattggcccatcaaacatacgtgatagctcctagtcacttcaggtgtgtgtctgtatacagtagttctctctttcgatgatgctcacgtgatgggaggtttggaagttggaaccagatccgcgtcccatgtcgggag

SEQ ID NO: 73419 - DNA, 663 bp, Oryza sativa
tgttggggattttggtttaggagattaactaccaaagtcaacatgatggtgccattaaggaggattgcagattaagatgacagggtttgttgttgtttcttggtctgtggataggcatgggactagaatagtcctggtaactgtagcaaggaacttggccacatatagccggcagaatcattgtttaaagatggagcaagtgagcagctaccactagcttgtaaatcactatcattttctttttcaagtgtttgctgcatagtttaacctttgcaaatgcatggtcagtgacagtgagagcaaaccttttggcctatcaaaatggccgcctttggcacagaggaacctgacaaggatcttgcaggaaacattcacaactttctcatggcaaaatgcagtaaggccccttttgattcaaagtaaattcataggaattttagaggattttatttctataggaatttttcctactaagccctttgaatcaaaggaatgaaccctatagaatcctatgaaattcctatggaatgcctcttcctatacaagttttgggggaattttaacaagaggtagaacctcatggaaaaaatcctttgagtctttatctctcctcaaattcctgtgtttttcctgtggtccaatcaaacgatcattcctacgttt

SEQ ID NO: 73420 - DNA, 1052 bp, Oryza sativa
  unsure (1)..(1052): unsure at all n locations
ccggggtgttgcggcggctgccccctcccagcttggggttgggccgcccccaaacccacgtggctccccccgaggggggtcgagcccggggtggcgcggtggctgccccctccaagctagagggaggaggccaccctcgcttggggtcgagctgccccgaccccctccacatatcagcccacgtgtacagggttaggtgggcgcgcctaatgcccacctaactgcatttaaagcagtttatgcaaccgcgccaggccgcatttaatgcggcgtgctgcgcatctgaccggttgaatgaccgatgggatggcgactgtgtacccctgccctgtcagtgtgtcaggcggcgagcggcgtgctccatcccgtcccatcataatgatgaggggcttcacagcctcttaccccggtcagagctggtccaaccactctgaactgacccgggttcccgttttctggtgtgaacgagaacccgaaagtcctcatccattaaatggcgaatgacaagggcgctctgcattgatttgatgggccccgcgcagcaaccgcggatagcttctgggctaaggcacaagacatgtaattaatatagagaatattttcccttgtccntaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggccttcacagcctcccgctagagagggtcacccctcaacaaagacgagtggtcaaacaatgcaaacaaaaactcaaaatcccttatattataggatggagggagtacgacagaaagg

SEQ ID NO: 73421 - DNA, 712 bp, Oryza sativa
ttgaccactactttctattgcaatatatctttataacctgacgagattataatattatgaaagtatttgacaaaatgaatctaattctaaacacatgattttcttccatccaatctaaatatttaaaagatattgatggtcaaagtttcttaagttcgatttgaaacatgtccaaaaaaacatgttttcaagaccagaggtaatacaaaagaacatgctactttgttgtaaccaaatatacttaattgcagccacaggttcgatcaacatcggtcagtacatcagcaggaggctctgacaatcatcgatctaatcaatggacaaacgatgtcgttgaatatttacaacagcttttggatgaattttgtttaaaagaggtacctccatcttttagagaacagtcatcaccagggcttattgctggggtcacacaagtaaaaatgaaaagcgaagcacccccagctgttggagacatagacgagcctttggtgcacttcaaatggtggtatatggtccgccttattcagtggcatctcgccgaagaattgcttgttccctcggtacttattgaatggttatttaaccaatttcaggtgattttatttccattgactgagtagctcatttatttaatgatgtttaagttatctcttattttctttacttaccagtgatatgcttctaccctttactcaggagagagttgcagttg

SEQ ID NO: 73422 - DNA, 738 bp, Oryza sativa
cttggatttcagtaaatcatgcccagatcgaaccacaatcagctaccagattatccagcgaagattctagccaaagggatatgtcttcaagtgttttcttgacagtgtcgaccaaaggggctagagccttgcttgtagtttcttcttctgtctcatcaaagtaatctttgatatcaaaagaaaacagatcggctaaggcaacaaaagagaaatttaaaggacaaagatgacaaacaaatatagccgatctaagacttggtgtttaaaagaaacttactgggatagcaggagtagctggttgtacttcttcttcaacatggtgactccctgcagctgatggagttttatcgcttgatgattgctggacaggagaaggaggaggaggctgaaaagagacaagtattagacaagatcggctgaggtcaactggtgaaagaattaagaacatcttactggtggagccggtttgagagttggtgctgccgatttcttcttcacaacaattctctttttctgcaaagacaaaattaatgagtgattggttgaggataaatagttattaaaggaaacagagagagatagttaccctggagaagtgagctggagcagagggagtcggaggagtttgtttgggtgaagccgatggagttctttcagtatcacatacttcatctacggcttgatcaacatcctctccgatctcttcttcatccaaagcttgttcgatggtgggtccag

SEQ ID NO: 73423 - DNA, 952 bp, Oryza sativa
acaaattacccccctcgacccaatccgcggtggttttagtccacgtgacgtacgcgtggcagcccagtcagtcctctatttataaaaaaaaaagagtaaattgcatcttagggctactatttcttacgtgtgttgtaacttggactagtgtaaaataaaacttttcactttggaacaagtatgtttacagaaggttttaatttggactatcttcttgttcctccagctccctttcttcctctcttttctctgtacagctcacggtctctttctcgatcaggcgtagtgcatgagaagtcaagaaggaaaacccttcacagggcagccacccaccgaaattgagctcgagctcaaatgtaggcggcactgggaaggcggagcttgagcactgcaaaacttgctgaagtgcgagcggcacatgtggaaatttagcgcaggcgcgcaacacgtatagcactagcggaggtcgagcatgagctttagcgtggctgtctgctactccctccgtttcataatataatactttctaccactgcccacattcatatggatgttaatgaatttagacacgcatatatatctagattcattaacatccatttgaatgtgcgtaatgctacgaagtcttatattatgaaatggaggaagtacttggcttagttcttatagtcagttcagaaagtagcagcaactgtatgtcattgccggccagcttcttcatatgctacttgctaccagtaggaatacttgttgtgcaccctctgctttccttgaaattaagcaacaagcactagctagttgatgattgaaaatgcaaactaccctttgaattctttggaagactttacagattgaaggagagagaggaggaagagagttggaggaggaagaagggagtccaaattgaaacatcatgtaaagatatctggcccaaagtaaaaagattggcttt

SEQ ID NO: 73424 - DNA, 678 bp, Oryza sativa
actcacatgctcatggatattgttttcaacttcaggcactccagtgcttgtgcttgtagaaagagcaccatctcctacatttggaaggctagaaccacaacgaagctgtatatcttggcactcctttaaaaggacagctatctgcaaatatttagagggcagacacagcatatagttagcaaaagcatctgcagtaccacaaaagaaatgttgattcaatgttcttgtcagtagtgacatgcaagaatgaatatccaccttcaaattatatttgaacaggtgaggaccacaagcatcgacatattttcaaagggcatagtctatttttggctcttggactcttttctaggtccattttaacttcaaattgaaaagctagtgttttccaccctttgactttcaaaaccatacaaatactattaataccttcaacactgctccacagtggtttccattgatatcataatagtttttgctagtgcagactcctaatatgcaagcttgtgttggtgcgaatgtcaaatagctggttaaacatcaattaatctcagctaatagaagctaatcatcagtgaaaaccatgtcatctcaactaaaccaccatggaatcaggtatgaggtgttacttgtctggttttataaataaaagttgaaggtgaactaaaaccggggctgcag

SEQ ID NO: 73425 - DNA, 1467 bp, Oryza sativa
tcatctaaaaataccagcagtataccattcatacctcaagttgctggcggtagaatgaacagtgccgagatgagtaatatctctccatggtttgcttctgcacacccttatgctcctgtagctgcacagccatttttaccatctagaggagaacagcctcacccagttgagacagctgctggaagtggaacccagaggatcattacatccttggcagatggtgtccagcgtggaagtgatccctgccgtgctccagttatttctacttcaccaaccatggtttttcatcctcctgcgtatcaatatgcaggattcccttttactcctggtgtgcaccttcaagcaccggggttttcaattggctcgacatcttatgccaattcagcacctgcaggagttccatattttcctagcattgctccaacactgttagggccagcaggtgcattacctgctcaacatactaggcaatatgcaataaaccttcctgaaggaagcagcactgttggacacgacagtaatcggaaatggggaaggcagggccttgatcttaattctggccctggaagtgtagatgcagaaataaaggacgaacgagtatctttaccagttagacaaaatttaatcacgccaccacatgcctttggggaagagcatacaagaatgtaccaaatgccaagtgttggaataaagaggaaggaaccagaaggcagttgggatgcagaacgttcttcatacaagcaattatcatggcaatgagcttttaactgttatcatttctcatttcacagtgacttcagcttccagtgagcttgtatgtacttgtattccgtctccaacaacctgcttgtttctcacttgcagctccttttcttttgaaattaaggtacggtgcttttatttgcagaggcaactgcatgtggaacttgggctctggtgtgttgcacccttgctggaatatacagttcatacatgaccctgtgatgatgtgaattgtgagaggaatgatactttgctgtaaatgttcatcatatttcatactttcctggaaacatttttccttggcttcagcagttgcactgctagattttcgtagctgtcaggcatatgcttctaatttgctccgatatgactggagatggaatggtatagccgtataggtcctgagccacaacaaacatctgaagccgttgtaattagtccagcttgtttgtttaaagtttcttatgacaaaccattttcacattgttgggcaaatctgcagccttacatatgattttagatgtgacatgtatttttcgtgtaaccgttgcatcagtttgctcatgtaactttatggactatccagtagactgtctgcagttcccgaatgcttgcaaggggcattctggtgtaaccatctctgccttgcagtcataagaaatttagtagaccaagaaataatctatttctgtatctttcgttatt

SEQ ID NO: 73426 - DNA, 2018 bp, Oryza sativa
tatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcagaaagtaaacgtcgcaatgctcgaccagtatccgcaagccacagaggaaaatctcatccatctcctgaaggcgcagcattacaagacgttcatactgttgccgtacaacacagagttagtttaattttactgtcttcctataccaaatttcattcccatacgaacatgctaagtgtttcatatgtaatgcatcccacgcacattgcagattccactaggtgctgttactcttcgacctggaggcctgcaccgtcaacatatatgactcaatggataaaaaagagtctacgtttgacaaggttttcgaacttatagacaggtattgtcataagttcctatgttaattaagaatcttgttataattaattgctactaagaatcatagctttaaactccatgtagggcttggtatcggttccgtcatttggtccgcggcaaatggagagaaagacttatgcggaagttcaattttcctgtgagtacacatgctctacatttatattgaatctccaattcaaatacatacaagtgtatattaattagatgtctcgccgtttgtcatttatttatagtgcgcaaagcaaaagcatggaactaacttgtgtggctactacgtgtgcgagtattgccactgccttgcaaaccaaatcatcaccacaagagagctcgatgtacgtacaaataaattcaaattttcattacgtatcgatttgttgtttaattactaattaatttcatacattcatatagtttattcgcatgagggataacctgatcacacacaaggaatttatcgcggcggttcaagaacaactcatgggattcatcaacaaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtgtacacattttctttaatgtaaatatatattttggtcatatatatatatgcaaaaaaaatgttaagtgctttcacatatatatatatatatatatatatatatatatatatatatatatatattatatgcatatatatatatatataatatattatatgcatatatatgtattgaaacatatatatgcatggtatatataaaccatgcagcaacagggccatgcaaaaaaaaaaggtcagctcaatctttagtcccgattgatggctcagccggccacgtggctgagccatctttagtcccggttattttacccgggactaaagatagcgatctttagtcccggattgatagtcctggtttagaaaccgggactaaaggggggttacaaaccgggactacaaacgctttctccaccagtgtagagatcctaccttttaccataaactccctttaaatagcaagttttacggttaggtcctttgccccatctctaccgtttatttttaatccgatggctttgaatcaagtggtgacacgtggcaaatttttagaagggctaaccagatttatagggcgccatgtggctcaataggaagccagaagctataccctgaattcagttttagagattggagttttatatatgtaattatacaagccaagcaacaaccttgccatatgaagtagagtgaaagaagagttggtgtatgttataatttgttaattattaatttttaatttcgaaattaaattaacgaagagccatattgagaaacctaactaatgatgccttcgcttgaa

SEQ ID NO: 73427 - DNA, 8782 bp, Oryza sativa
ccctcgctcgccggtgagctctcctttttcatccatctccggccggccacattggtcgttgcggtcgtcctctccacccctaatccctctcctcctttcctataggtgtcgcctccgcccgtccacccctcctcgtcgccgggtcaccgccgcctttcatcctccgctctggtcgccgtgctcgccggtgaggctcccctctgctcccctttttccctctctcccgtgtgcgccgccatccttcgcgcgtgcgccgtcgccttcggccgctgctgccgcttttcgcgccgcccgccgccgcctcccacgccgccggttgccgtcgccagcgaccgcatgccgccgccgttcgccatgcttgccggccgacttgaagccgaggccgagcccggtggctgctccctgcatcgtccgatcggcttgggccgatccggacccttggtcccgtggaccggccgccttgagccgctgacatgcgggccccgcttgccggcgccgccccctcctttgatgacgtcagccctgggtattattgcgcaataaattgattaaggacttttctttattagtaaaaacacagtttatcttctaaaattcataagtaattcatccgagctctgtttaagtccattcaagtctcagtaaattcataaaaatgcaaagaatccattaaaaatggttttgtttcctgtttcagtagtcttatagcatgttttgcttgtgtgctttgtttgtcacgtagatttcggccgtttcgtcgatccgcggtttctcaaagacgttgctgaggtctcatcagttcgagagacaggcaagtcatgctttacatttgatcatattgtacccaatttacaaataccttgcatttctattaattgttgcactcttttacaatgtcatgtgggatgggtcctattactcagccatatatcgtttaccatatgccattgataactggggtatcaaaatgattagatgttggtttaggaaatgcttagccatgcttagttcaactagtacacaaaaggggatcacattattacatgagcatagttcaattttgactatgagcatagttctggttggtgccaccgcaatggtgttagttatttaaaatacactgaatggtgggttgtgcgtgcatggttttgctggtcgcacccatggcaattaaggaccggttcacgggaaacactgggagacttaccgtgcttaccacaagcgggagtgggtaactgcttgatctgaggtatagctcaaccctttcctaggcaccggtggcgagggtgggcgtgatggagttgggtcggccggggtgtccggttgtctagctgccggattcaccgcggcacaagaggggaccgcccactaccttttgaggggtgggggtgaaaccttagcatggtgtggatggttagggaagggttatgaggagggtcttgtcacgatttccccctttgcagtgtcatggtgatacttcggggcatggcgacatgtgtggaatcgtgtcttgtgggtacagttgtacacctctgccagagtaaaactattcgaatagccgtgcccgcggttatgggcgatcaaccagatttaccgtgattagtctcacccctagtttagcttaatgaactggtgtagttcaggtggttggttgggcctattgcaatgtggtgtagcgttggacaatgtttggttaatattgattaattactacaactgttttactgctttcaactactgtttttaaatgcctgctttgtgcaaagagcctttagcctccttcggttatatcctgcatcatacctcctcttccggtatgacttgctgaatacagttggtagtactcagtcttgctctcttttcccccacaccagagctgaagatcttcctagtgggaagtgtcttaccgaagttgatttcgtcgctgtcgtcaaggattacctgtggagtggagtcaccccgctgcagaagtcaagtttccaagtctagctcgtttttcttttctgctgcatttgtaatcatctccatttttgtaagacgtggatctgtatgtcaaaaattgtcgtttgtgtaccctggctggtcctagacagggatttaatgcacattcagcttcgaaattctggttcgtgaatttctgggcatgacacatgtcttcttggcactcagtccactcagtgacgaagtcggctaaagcttgggacttgatcgaagttcgcggcatgaaggatatatccagggacatcaattctaaggcccactttgctatccgcccatttgcttcacgattatgaagtatatccccgagtggaaacgatgtgaccaccgtgaccgagtgaccttggaagtagtgaggtaatttgctgacggtcattaaaacaccatataacagcttttgaacctgaggatatcttgtcttggagtcagccaaaaccttgctaacgaagtagattggtcgttggactttttgaacatggccttcttcttcacgctcaacaactaggactgtgcttacaacctgggaagttgccgacacgtataacaacagcggctcttgcggatgtggtgaagctaagactggtggagtagtgagaagttttttgaagtcttcaaaggctttttgtgcttcgggtccccactagaaattgtctgttttcttcaacagcttgaaaaagggcatccccggctcgccgagtcgtgaaacaaaccggttgagcgccgccatgcaaccggtcagcttttgaacatctttctaggagctcggcggtttcatgttgaggatggcattgattttctccgggttggcttgtatgcctctacgggacaccataaatccaagcagcttccctgacggtactccgaagatgcacttttgagggtttagtttcatcctgaaagcgcggatgcttgcaaaggtctgttctagatccgtaatcaaatcatccttctgcttggtcttgacgactagatcatccacataagctccaacgttgcggtcgatttgagttgaaaaacatctttggatcatgcgtggataagtggctcctgcgttctttattccaaacggcttggtgatgtattattaggccccgaagggcgtgatgaacgaagtctttaaccagcggatctgatgatatcctgagtaccaatccactgagtagctcgcagccggccgttgagtcaactacctggtcaatgcgaggtaacgcaaagggatctttggggcaagacttgttgaggtcggtgtaatcaacacacatgcgccattgtcccgtcttcttccgaactaggactgggttggccagccagtcgggatgaaggacttccttgatgaagcctgctgctaacagcttggtcaattcctccttgatcgcatccttcctatcctgtgcaaaacggcggagtcgttgcttgattggtttagcgtcttccttaacaagtaaagagtgctcaatcaccactctaggaataccaggcatatcagatagtttccacgcaaataaatctttattattttgaagaaagatgatgagcgcgctttcctatttacaatctaactcagcgcctattacagcagtcttagtaggatcagaggaatctaggggaatcttcttggtcttggcgtcgccttctccgctctttggcatcttggttgcgggcacttctccttcgcttgctgtggacgtagccagtcggatttcttctcgggcgagcgtgatctcgcgggtctgggccatctcacagctttccttgtcgcatgtgacggcttgcttgatgtcactccgcagggatatgtctcctcgaggaccaggcatcttcatcatcatgtaggtatagtgcgggacagccatgaacttggctaacgccgggcgtccgagtatgacatgatgttctctgtacggaaattctcccgagtgctgaaagtaataggaagagtgtggccgagtggtgtaacaaatagccccgggatgactctgtgaaagggcgcattactcggctttaattccgtgcgagggatctgcatgtcgtccagggtcttggcgaaaaggaggttgagtgcactgccaccattgatgagggatctgcgaagcttgacgttgtgaaccaccgggtctagtaccagggggtaccgtcccgggtggaccactcggtctggatgatccgagcggtcaaacttaatcgttgtctctgaccaccgaagatattggggcgtgtcaggttgagcagcgttgatctccgttcggtcagcttttgctttctcttggattcataagccaggggtcaaccaaagatgtggttgagctccttgcgatggtcttggaaaccagtcagtgcatcatcttcaccatccttcttctttgacgtgctttgatctccgtcggaggctttatgtgcgttcttggcgtattgttctgcaaactgtttgtagacgaagcaatctttggccgcgtgattggaattgggatgatgcggacattgggagttcataatcttgtcaaaggtgttgacgtgcgaacgttgtcgggaggatggtgtagtagttgccacaagttcctcgggcttacgcttgcgatccttgtgattggtacttccactcccccctgtagtcggtgtatctttcttcggcttccaagtggtgcccgactgcttggacgtggtaatggcatcttcggctttggcatactcattggctttttcgaacatctgcttgaccgtcctgggaggcttgcgcccgaacttgccgactaggtctgtgtggcgaacgcccttggtgaaggcggcgatgatgacgtcgtcggtgatgtcggagatcttgttgcgttgctcggaaaagcgtcggatgtaatctcgaagggattctctagacttctgaatgacgttgtagagatcaaactgtgtaccagggcgttcaaaggtaccctggaagttggcgatgaagtggtcgcgaagttccgcccatgatccaattgtgccacagggtaacccgtgaagccaggaccgggcagaatccgctagggccacaggcaaataattcgccaattgcgagaccgtagacggtgagccaagactccgggttagtggtgccgtcatacttctcgattccaatcggcttgaagccggctggccaatccactcgacgcaggtcgcttgtgaaggcagcaactccatccacgtcgtcgtcgtagcgatctggagaatggtggggagcgtagcctcttgccgcgcggcgctggttgatagtatcgcgaagatcgacggggcgcctgcgatgtggggagtgtggtcattcaactcgatgctccctgtgtcgtttgggtggcgagtggatagatcgctcgtcgtgacccctactcctgcgagtagatcccgcgccgacgacgctgaggcttggttggtgatagtcttgagatcgaagatggggaactcggctgccagtcggcgtgtggacgcttgcggagttaatcgggaccaaggcggcgatcatggtcttggtctggttcaagatgttgacgacgtgattggcttgattgagcgcgtcttccttgaggaggatgtcgaggagggtgatcgctgcaaccgcgttctgttgggggggcggaaaaccgctgtcccctcgacgtcttgttgcccaataagttcctatgcttgtcgcccggcatccagggcacgttgtcgccagtcctcagcctcttttgcagcccgttcgcgttcctgtggctcacattgtagccgttctcgctcttatgcttggcgctcctcttccagtcggcgtcgttcggcttcctgttgtacacgtagttcttctgcttctcgggctttacgctcttcttccgtctcattgtcagccatgaaaatgccgaataaaggggtgtgtagttgtctttcaaacccttcgtcgaagtcgtcgaggtggcgtagtcgtagcggtagccgaagtcgtcgtactccacgatctccgatggtcgcgagtcgatgccgggggagctgaggtagccatccagttgttcgtcgaaaccgtgccgagaggctggagtatgacaccgacttccctggagctaggccgggccggggctaaagccggatcccacctaggcctacggggagaagacgcccttgtggtgaatacagcagccaaatcatcgggagtttcatcaggattggcggataggccccatcgtcttgatcgggtcgtgttgaagtagattggatcccgtccgagtggtttgaagccaactcggtggagatgatcttggggtagacctcggccgagttcgggataccgaactaggtggagatctggcctcttcccgactggtttgaatccgagtcgaggagagaaatcttgccgaagtcgttggtgatgaagtcgaggctgccgaattggaacgcctgcccgggagggaagacaaagtcgtcgatgccggaaacgaaacccatcgcactagtcggcgaagaacttgacgcttcccatacctggcgtgccaactgttgaaacaagatttcgacaatactaaaagggggtggctatcaggctggaaaagtggatgggtttaaagacaaggaattttatacaggttcaggccttcttaatcaagaagtaataccctactcctgtccggggattgatccaccaagtatattattgatcatatgatctgggaaaaaatcgtgcccctagaggcacccgtacctctccttatataggggaaggggtccgtattacaaaatacagtccatatccctaacggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactaggatttatccttacagaggcattatgtttaaacttgcatgacatttttattcagatttgtatcaccccgatgtttcaacttgtcacacacgatgatgcatgactttatttttctctcctgtactactatactgctacaattcaataccagataccaccgacggtgggaatgctacagggagcagtgttgtagcttgggtagataccgcatattgacggcatgtttagggccaacatagcttgggcttgagcttgactctgatcgaagtagacgctagcaaactgttgtagctgtagctgctgcacaatagcctgaacactgctaatggcctggcagtgagactgttgtgcgatcatcctgagctgttggcagcactgctgctgcatgacttggcagtttctcagttgaaacacgggtgattggaagaagggggttgccactgtgctgcactgctgccttacgaactcaccgcatgggctaagcatctgttgctgcagcatgagatgcggctgcagctgatattgcctgtaaacttgagtaacagcatcaaactgcgcagaggcactgcatgcagcaatagcaaggagagcaaagaagaaaatgatcttcattgtggtgggtttctagttcttatgcttttgctgtaatgtttgagttgtgagaagaatgaagggggtttacattgtgcttgtctatttatagatgcgatggatgggttttctttgaattccttatcggttgctctagagtgtttgtttttgttggatattctattgggatcagagtgagtcatgtcatttggaagttacgtgatgtgcctccacagatgtccttgtataccatcgtcaaagtaactttattgcccatcacagatacttgatggttggcaagatagataatgttatgactcctcactcactttatatctcagtgtgacatggtgtcacacccagaaattctcgaacccgaatttctaagctgaatgtgcattaaatccctgtccaggaccagccagggtacacaaacaacaattgttgacatacagacccacgccttacaaaaatataaaagattacaaatacagcgggaaagataaaagcgagctaaaccgggaagcttgacttcagcagcgggcgactccactccacaggcaaaccttgacggcagcgacgaaaccaacctctctgagacggctccaactgagaagaacttcaactctggtgcgagggaaaagagagcaagactgagtactactgtcacgcccgaaaattcactagtaatttccgaacttatttgtgcataaaatcctcgtccaggaatcagccgaggtacacaaactgacaatttaatatacaaattcatcaaattaactaaaacgataaatacttacttaagatgcacttagtcctcaccatgaagaaaactgcagcggaaaataaaatctagcgaagctccggctccactcccacaggcagctcaactggggtataagccaaacgtcttctcctcctagatcttttttcttcaactgaggttgattgattattgcaagaatgagcatatgacatactcaaccagccacacagcaaatatgcaagtgcacaaggataccaaaggatggca

SEQ ID NO: 73428 - DNA, 1041 bp, Oryza sativa
tttttccatggattcttgattatggtgttccttccataagatatcagataagtctggcctttcgtctatttgttctcctccagttcctatacctgtctgaaccaccgattgtacccctctttcggtggttgttctcctttcttcgttagtgttcctatcatttcctatgttccaaatctgaccatacagctcatgttcgttggacaacttgctgattacggttgccatgttattcttgctcttgactcgcgttgtgttcagggatcatagcacgggtctcctggttggtattggccctcgcttccattattcacagcatctttgggagcttgactgactgttttctttccttgcttctgctatagcatccttcactcagtggcatcattgttggggccatctttgtggctctcgtctgtcacctttagtttgtcaaagtttattagggtctatgactggagatatatccttaaatcaatgtcatggttgtaaacttggtaaacagatacaacttccctatcatcctagtgagtttgtgtacaagcatccttttgttcttggttattctgatgtttggggccctgctccctttacttcaatacggggtcatcactactatatctgtcggagatatgggcctgggggtatgcaaagtgaggggatgttaccttcccatccagccacgtgactctatagcctggccctccccccgcgcctcgcgagtcgcagaagcagccggggggcctcggggtgccacgtcacgcccttcgggccctcgcgctgcctcgccccaaggccctcgcccaactgtcatgtggcggggggagcgtgcgggaaggagacctaggctgaaccgccatcaatgcgcgcggcgccccaactgtccctcaccgcgtttaatgctgtaagggcagacgtgtggtgccgtccgactaacccacgtcaatcgagtgtgaccagactgtgacaggcctgtcaccggtcacgtccgattggatgggtggtcgtgcccccacgttcgcctctgtcttcagcggagtg

SEQ ID NO: 73429 - DNA, 953 bp, Oryza sativa
atgatgttaaattttgtcaaaaaattgttcagtttgttaaaatgctgctaaatttttgtagaaattccatcaaattcagaatatgtgccaattgttatgttagtcaatgtgggtcatttaaatgtccttttgccaagaatttaaattttcaaagcatgcataaaatgggggcaaaaccccaattaatgaatatagataggagagggtataaatgtccttttgctaaaaatttaacaccgttaacttttccatccaaaacaggggcaaaaacattgttcggttcaaaaaagtgagggcaaaaatgaaaaccccaatattggacactaaagtgggggcagaaacgaaattgccccttaaagatttgctacataaaaattcagaatcagcaccctttgttcatcctcgatcacaactcttaaggaaccttgttttcacacgcacgcttcccaactgctaaacagttttttttaacaaaagttataaaatcatattaatttattttttaggtttgaaataattaatagtcaactaaccatgcattaatgtctcacctcgttttgtatatcttttcaattttctttttccctcttctttcaaacacacccaaaaacttagctctcccaggttaccaatggcatgcagtgcattctgggtagcatagacgcctaatagctctagtagagatgtcatactccccagagccggactatctcgcagctttacttaatttgttagcaagtagctgaaccagctatcttttttctttaagataatggacaaaaattcggtctatatatccacatagatatgcacatgaaactcttgtataatgcattaaatatttttgaaaataaacttgacatatagcttaaaacaagtgatctaacaaatgcagtggagaatatatatttcaaaccgtggagtaaataaaccatttcaacaatcccatgaat

SEQ ID NO: 73430 - DNA, 529 bp, Oryza sativa
ccacgaacggcagcacatccgcggcgcctaccggaggggtggttcagttcagtgagtcaaatccaagtcagatccaaagtaccggactcgaagcacacgctcgtttaccgcgcgtacctgggccggcgaggccgacggcggaggcggcggtgggcttggcgttgacgacgacgaggcggtactgcggcggctggccggcggcggcggcgaaaaagtggcgcaccgtacactgcagcgcgttgtaactgtgctcgctctcgttcacccctaccaccatagaaatactgccctccgccgccgacgacgcctggggcggtttctccgccatgtcctcctgtcgatcgctcacggaaacaagtcacgaagtgtgtgtacgcttcgcgaaccgtgtgctttctcctagtaagacggcagccattggctgacaggtgggcccgggggaggtgggtggggacgcggcatctccaataatggtggtggtagtaggtccgtgtgtgccacgtcacttcgtgggtgttcaggttcagtg

SEQ ID NO: 73431 - DNA, 616 bp, Oryza sativa
gcagtagttcatcaatggtcgagtatgttcgctcgatcgatcgggatggctgctcgtttccttgttgctctgtaatggttcgaaactcatatatatataacacggaggagtatttcagaaaatttggtgttctctagatctctcgttcttgtattgaatgaggccttcttgcgactctgaacgtcgatctatatcccatatcctacgcctcatcttaactatgagtctagacacatattcttagttgtgaaagttatcttttttacagagagaggagtaatcgttgcgatcgatattgtcatactctgtgatgaagccaaccttactttttgtacattcggcgcttagaggaatattctttctatattttcctatgtgcgaccaatggcttttataatggttgaatgattaaacgtcgatataaaaaggccaacaatgaagcaatggaggcttttgttgaagattcacagagctgccattgtttcatcgagtactctaacacatcgaacaaaaaaaaagctgacgcggatgagatcacgcccacacagagttgccccatcaacgcaatcttgcgtgagagggtcttgattacctccgttaccaacccaattcatgt

SEQ ID NO: 73432 - DNA, 1824 bp, Oryza sativa
gctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcataggctgtgtttgcatccctatgttcccagcccatctccctcgttttccacacgcacgcttttcaaactactaaacgatacgttttttgcaaaaagtttctatacgaaagttgcttaaaaaatcaaattaatctatttttttaaaatagctaatcaaatttgcttaaaaaatcaaatttgcttaaaaaaatagctaatacttaattaatcacgcgctcccatcactagactccgaacacagcgtggagtactatacactttaattttttttctttaattaaattttaggcttgactaaaatttaggtcatcatcatcgattgctcatattctgtaataaatcaaaacggtttactagaaaataaaaataatttattaaaaattattaaaagtcaatacttaaaaagaaactacgttaaaaatatttaacatcttattcgttaaaaaaagttaagtgttttatagtattaattataaacgaagggagcacttaagaaagaaaactaaataaacgaaaaaaaatgttcaattattattccttatagtttttcggtttatttctgaccacctacaggacgcttccgtagattaatgacgttgaaactgtttcttaaacatgtaaaaggacatgcaaacacgtatgccacatgcgccacctacggcgtgctgcgtgcacggtctcacacatatgcttatcaagtgcgtcaaaattgatttgcaaattgcaacattcaaggacacgcacccccatttgtcccgttggcagtgacgtgatttcgcagcgttctatcgtaaatgccagaaaactagtaatttaattttgatctgattaatgtcaacgaaaaaaaatgtgtcttatgataaaaattttcttagcatatgtttggtttcgggactaagtgggatgggatgaaaccatccctgattttggagttgggatgattccactcacatgtttggtttgtaggatgggataattccaattttttgtttggttgaaaggatgaggaagagatgggatggacgccgtttgccatcaccgtcaacgaccgtcgcctgcgccacctgcatccacgcgtggaacaaccggatcaagcacagcggcagcagcaggacggccaccaccgccggagcacccaacccgctggcccaccgtcgtcgccgcggctggatcgggagatcccctgcgccggatccgccgccgccgctctccctacctccaagtttcgccgccgccgagtcccccttctctggatccgccgccgccgccctccctacctccaagcttcgccgccactcgagcccgccgcgtcgacatcaccgcagctgccgcaaccgctctcgtcgagcatcacgatgagcggcgggatggcgccgagcatctcgctcgcggcggcgaccggtgttaaggcaaggggtcgtggaggagcgcctgcggtcgcagaggtggtggcaggcagtcatggcgg

SEQ ID NO: 73433 - DNA, 2222 bp, Oryza sativa
aaaataccattctcctgaaaaaaaaatccttctcccgagtaaaaaatatcattctcccgattggatgttgagcccggataaaaaatatccttctctaaaaaaacgatgttcaattatatccttctctagaaaaacctagtatggtaaatatccttctctaaaaaaaactttgagtgactagtatacttttgtggagcacatggtgctagtactagtatggcaaatatccttctctaaaaaaactttgagtgactagtatactttcgtgtagcacatggtgctggtgctagtatggcaaatatccttctctacaaattgagtgactagtatacttttgtggagcacatcatgctagtgctagtatggtaaatatccttctctagaaaaaaatgaattaaagtaaaggataaacaacgtaaaatctactaaaagtaccaaaaaaatggaatttcatcaacatctgaatttttgtatatatattatttattttattgttttgtatctagcaaaattgtagggtagaacgacataatagatcctggcttctccatttaattcggagaaaaggaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaatctaaaaaaaactttgagtgactagtacacttttgtggagcacatggtgctagtgctagtatggcaaatatccttctctaaaaaaaactttgagtgactaatatactttcgtggagcacatggtgctagtgctagtatggcaaatatccttctctaaaaatttagtgactagtatacttttgtggagcacatcatgctagtgctagtatggtgagtattcttctctagaaaaaaagatgttctcgattttgagtgactagtatacttttgtggagcacatggggctagtgctagtatggtagtactgtaaagacagcggtagttgttcaattaattgagtgactagtatacttttgtggagtacatggtgctcgtgccagtatggtagtattagagcaggtacaatagcaggctataagccagttgcaaatatattttaaggagttaaataaggagagagaagagcagcgggctacagaattgtagccacctgtagcacggactccaagacgcagtatgtgtatgacaggtgggaccagatattaatagtgtagtatgtaactattgtatgaataagctattagattggctatagatgaactggagctagctggtagctatactattgaacttgctcttataaagacaatggtagtcgttcagttattcaaagcgttgtcgtggtatcctcgctgaatatgactgttgtatggaccttgtcatgtaagccgcgagacttagcatgacttttgcacatatggctgttaggcgctcgtatggacctgcttgtgtacgactaagattcgatatctagtcatttggaactgcttctacatatgctacatgggttggtttgttctgactcactttgcaactttgctttggttgcccactggttatgaactcagggatttgattatttattgccgtgttcacttcaactccaaatgtgccagaaagacacaagttttatcatgttatgcatagctaagcgccaaatattatggcgtggaaactgcaacattcagcgccataacatttggcggggacatacagcactacaccaagccatacctacctggtcgactaagttaacccgttcagcgccaaataccttggagctgaccttagccacaacagagccgagtccgatggtgctgagctttgacacactggcaccatccacggtgtcacgacattcagcgccgttacatttggcgctgaacctccgggttatttttgaaataagttttgggcgcgattcatttacgaaataagtttttgcaaaggggtaaattgtcaaaaattttgcatggtgcagaggcctattcctcccgcgcgtaagaggctgttttacgtggatggatcatgcggtggttaaatcatgcgcgcggatggacggtaatgattggtccagatgatttggccggtaggattggagagggataactcctcttttttatattagtatagatatagatatagat

SEQ ID NO: 73434 - DNA, 2006 bp, Oryza sativa
ataggtgcttcgttttacgtgccggggaggacccctcctcccgaacacagcctaagtttaattgcttaaatctaatgtttctacttgttcctatttaatattgtaaattaagtacaaaaaaagtggaacagtagtgggaaatagtattatgcaagagttagtttgtaaaaaatctttaaaaaaagaacttaattttgtacttggtcaagaccagtttctgttgctatatttttaatcatttcacactagccgtgctttcatttttagttgtaaatcattttggaagttacctgtcttcacacaagtttctattgtttgatgatttatatacatttgtcataaaccatttatattttctgttaataagtaatgttgttgtttatttgtagtttcaaatcatttactagttacatccttatcttcacattagtttctattactgtattaagtaatttagtcctgatgaatcattttcggagttgcctaaccatgttgtcatgaattgatcccgtgtattcacggaatcaagttgaggggtgtatctccagggaatgacccacttgaaccacccaattatgtttagtgacctatagtgcaatttactcaatatttttaattcaaatggaaactgtgtctgttctttctcttctttcttttgtactcttaacaatatgtgttagtttttttattacaatgaatttcttgtgtgccatcaatcaagccctttttcgttgctttgtgaattacatttctctcagttttgtactgtacagaaaactgtttgtttatatgatactcttgatggatattgcagtttctgaggcttgcttatttgattggttatggagttgagatagaaaaaagtccagtcaacaggtactaatccagctcctctattagatatactaaattcaactttcctattggtcaattaccaattaataggttactttcctctctttttacatgtcactgaacagtgagacattgtatcttgattgtttcatgattcatcatcaatcttgcattcaaaatgatatgttttgttgtgtctgcagtgcatctttaagcatgctaccatggccaaagccagctacatggccttctattccaccggattcatcagcagaaacaatggcaaaggagaaggcaagcagttttcagcattactttttgacatttaatcttctagtgatgcttcatgtagactgctgttctcttgtattgagtcagtttgctcttgtcctgcttaattggcccataccacttcagcacttcctaagttataactctaatgaagccataacttataagaatgtgtatctttcgcacacattgaaaactttcacatgcattacaaatatgtaccagtcatttgttaatgtagaacaaatgaagaagaatgggaaaacaagttcccagattatatgacacagaacagtagtggcaatgatgattgaacagtgtaccataaagttgttgctgatattttcagtacttactgaaagatgcgatgggatggaatatgtaatttttagaaatgcttgtactgacctgtactttgctagtctttttgtttatcgtcacgcatgaacttatgtgtttattcatttcatatttgggaaactgtagcttaaagttatgaaatattttccttgtccagatgattctccaagcaaaatcaagagaaaagatcttcaatattcacaggaaaccactgccattagaaccttctttgcttcttcgtgaggttaataggcgtagggcttttctttctgttggaaatatatctgaatcatatgattcaggtgatgggtaaggactgtcgatttcctccattttcatgatgtaatctttcaagtgaaatttttcagcatatctgtgttaatgtattcttattaacacatatctatgttcttttttgtgtgggcaggtcaggactggatgcaaattcaaaaccttcgcccaacaaatatgcttcgaactacatggccaggccaatgtca

SEQ ID NO: 73435 - DNA, 741 bp, Oryza sativa
aggacgagctagcccgagcgacgggcggcttgaggcagagcttgcccagaaggccggtggttaagccggtggcggaccaggcagccggcgacggaggcgaaggccgaccaggtgctggcacggtcccattcgcgtggcagcctcatcacggacctcgcctattccccttcctccccacgcgcgaccgccgaagtggtggccccccgcccccatctcctcccatccttctcccttctttgtcgccacggcgaggacaatgctcgccgttgtggcactgacagccgccgcggtggtcgctgtcctggagtgcactgtcggcggtctccaccgagtgctagatacgggagcgcggtgggtggcagcactaaacgcgaagatgggagtggcaaactttgggagggcgtgtgctagagtggggggccccggagacgaagcataggccagacggcgtcgttgatggctcataggtgggagccggcccttccggccttctctgcctccgcctcactccaactctcgagatctagaggctgatgtgtgggtggtgcgacgaggacgatgaggaggaagaggaggaggagaggtggcgctccacctcccccgtggactgcaccggccgccccgctcttggttttttatgggatagaggaagtacttgttcgcagctcttttttaatcagaatttatcactccgttcgtagacctgtcgggttaacattgttcgcggctcttttttaattg

SEQ ID NO: 73436 - DNA, 5204 bp, Oryza sativa
cattaggaaaattaagaagtgtgcacacagtaggtgaattgcattgttatcatgacgtccagatgggcaagacacaccattcactgcatgtgcagaccaacataaccactacatcctcgccatacttatgtattaccattgaccagtaacacctttgaatacatattcatggatgtatttgcctggaaaaattgtagaatgcctaaaacagcatggtgttactcctctaaacgatagacaattgatatgttccaaaatagtaagagcaatctaggtcacttgttcacaactttgtgcacacctgatacatatggaacgcacattggtaaaacaaagatgcccacatgttccaatccaatcatgaaaaggaaccctattttatagggcagattaacgttagcatgttagcatccaagttaactcgaaccacccaatacaactctcacgtttacttaaactttcgtcgtgacatgtactagactaaatcttgaatgtcccaagcaggcaggcaatctaattactctgcatagatgaaattttccagatagaaactaataaagaacgaatcgacaacaccaacaaattacaaagtgtttccacaaagtaggcacctttacaaaggagtcgggtgacacgggccttggagaatcgacccagtcctggttatgagccgccgctggaggagtcgtgggtgccggcagacaaggagtcgtcaggggtggaggaacaggtaagcggggaggaggagaagctggtccctgtgccggtggtgtagctgcctctacacgagttgctggccacatgccccgaacgagaagccgcctgttgccgcacccctcaccaccgccttggcgtcgcccatgcatagccccgcatcttccccgccaacaatcccgcctcgccgactcccggcgccccgctgcaccatcaccagatcgccgccacaggcgacttcgcagccgccggccgtaaccctagctccgaaaccctagatccacggggccttcctccatgaccaagcgcaccgcccgaattcgcctcaatcccaatcaaaccccagacgaaacaacctccctcctcccggaggaggatgaaacagcgaaccggagtcccccacgaattcggccgaatcgacccccaattacggcaggattcggtcgggaaattgggggattcggcagccgcgcacacgggcgagctcggcgacggctctggtggcgatccgccgcgggggggagagagaattcggcgattcgggatgggaggggagagagagagagagagaggaggggagaggcggaggggatgggaggagagagagagagagagagatcgcggcagagacggcgcgcgagcgagcaagcgatgtctagagagagagagaggaggggatgcggtgcggtcgtggttggagaggaaagcagggggcatttccggggatcggctcggctcgcgcatggaaggcgtgggtgtggtgcggtgcgggtgggcgaggtcggttgcttggtgctgtcactgggggtggggtcggtgccggtttactgtgcgggggttgtgtttgtgtgctcttttcctcgggcgctgacatcgacgtgggagattgctggtaccataacagtactactacagtcgtatggcttatttggatttaagctgtattcttttcatattaaaaattcggtaacatagatagtgttacatgtagtacacgtttaaatttgttattaaattcagtctagtttaaattcaatattaccaaatttagcactgctaatattttaataggataaattgggttctaactcctaagcgaacaaaacaaacatgtttagttcccaaaacaaaaattttcatgttgttgcatcgaatgtttggatatatgtatggagtattaaatgtagataaaaaaaatcaattgcacatattgcatgtaaattgcgagacgaatcttttaagcctaattgcgtcatgattcgacaatgtggtgctacagtaaacatttgctaatgacaagttaattgggcttaataaattcgtctcgcggtttactagcggaatctataatttattttgttgttagactatgtttaatacttcaaatatgtgtcggtatatctgatatgataaaaaaaattacccatctaaacaaggcctaaatgaattttcttttgatagtacgacatcggtacatggctccaaagaggatagtacattgatagtacatgctgctttttcaagcgcaccatggtcatttattataatcgtggcatcatatgtacatgtatatacaattgtcaaaacaaatggcgggtgctcaagtggagatcgtgaggttgtgtggtgttgttcggatcgatgaaagtatcattccgaatgatgcaccaaaataggagtacagttgagaagcagtggcggatccaaaaaaaaatagtagtgagctctgagcaaattagatagagttacagttcattcccatctacatatggtaaaaaaaatttagcagagtcttcgtggagctcttatagtcttcacaccagtgtaggggctcgagactccgccgcccccatgctggatccacccctggctgaggttgcaaaggctttgtttcattttgtagatcatgttgatctcaagtattacagtgctcttttggtagttactaatactatgttgtcctcgttgaggagtttccgttgatattcatccggctgaggtctgttccaaaatataataacttttactaataaatttagataaatatatatatatgtatcttaatcatagcttataaagatggtgctcctccttatggtcatgtgggaatgggatcaaatggagagcactgagacagttccgacgtaactgaagtcacaggcctaccaaggatatatcacgagctgacaatatgacaagcagagccctgcggaggtgcggtggccgaggttcgttgttaccgccgccgttcgtacggagcagagtttggcccactatttccagcgtcgagttgaaatttccggcccgcgagtggtagttggagtcacgtagcccatccggccgtgccccacgccaaatcgccctatgatcacgggccacccccgttttcttggcccaccagctgcatgttgtcaaggcctgaaagtctacaaactactggaacaaaccatcgatgtcacgagccaccgcaaaggctcatggtatcacggtgcatttaccactttaaccagctgggaactgggaagtagtagtactgttccccgcattgcgagagaagcgacaggaggaaaatcatgttgtcactcacgctcgccgtggggagcagatggggccctgatcctaggacagcaacctcctccctccttttcagagtgtgcgcatactttctcctcctttccgctctctctttcttttatcacacagagagagaccaaaggggaccaaacattattcccccactagggggtagatctcccgtccctcccttccctcggccatgtggtggggtcacccgtagtagatctcgcttttctgcatggttgtggggcgcggaatcggatgggagcgaaacgatttcagtgggtgtgggtgcccgggcgtacttctccctccgtttcacgcgatacaagttattttagcatttctcacattcatattaaggattatctatacaacattcgattaaaaattagcctaaaaatctatcaaatgtaactgtaacataattacaatgtaattttcataattacactatatttatactataattacatatgtaaactcgcatgtaattatagtataaataagatgtaagttcaatctagatcataaaaatatagtagcccaatgggttagtcacgccttcatcccatgaggtcacatgatctatccctaaatatggttttgtttttcttcctaaaagcacatatcttgatgcgtattaaactgttagtatgaatttaggacacatccaacggtttagaaagtgaaagatttagccataaaaaatctgtcaacaaatatttagcaattccgtttatattaatgttaatgaatctatataaatatatatgtctagatttattagcatcaatataaatatgagaaatgttagaatgacttacattgtgaaacgaagggagtagtgtactggtgtactactactccaatgcggtgatcttctctagtgtgtttcggtttcggtggcgagccacgcgcgtcttccgccacctgctgcctgcctcgtcgcgtaaaggttcggtcaaacatgtgaccggggaacacatttggccattttcgtgccttgtgggtgaaatgattcagcttttgctattgtgaggctgtgtttagttctacgttaaaattgaaggtttgtgagactgtgtttagttccacgttaaaattgaaggtttaaaggaattagaacgatgtgatgttcgatgtgacgaaaaaattgaaagtttgaagaaaaaagttgcctgagtcgcaaacatggttgaccccggattagtatcactactattcaacacatgaagaagctcagagtctgctcagaatttccacttggttattcttattcagtgacgtggtgatcagttattaagccatacgcacaagttataaaagtcagtagtccgaagtgagatgtttccagggaacttttgggacagctggagtatgaatttcttgagtttacggtcacatcgcgagtacattagccacagccacgtaaagcaaagagctctatcacgttcacatgcatctcaaggctcaagctgcgttaataattcaagtgggaggagttttccccaccaaccataccgtaccaacaaacaaaccctcgctttctaactttgacaaggtaaagcttggggggccaacgcctctctctaccacaagactccacttaattatgcccatgagaaaaaaaaagaaagacatggagcacaatttcctcccctgaaaagaaacgcaattgtgcgcttgtgctatattggtaggtttaaagcaaatcctgttagtgagagaaaagtactgtctgcacagtacaagttctcctgtctattttttaaacaggctgaatttatgctaacaattcgaagtcaaacttttagctttaaactctcataacagattgctagaattatttattgcaagatccgagcccggtttagttagtgggggtcatgaatgtacaacttctttattat

SEQ ID NO: 73437 - DNA, 3850 bp, Oryza sativa
  unsure (1)..(3850): unsure at all n locations
tattaatgacaccaagctaactacggatcaattgctacgaggcgcaccaatcgaaaaggcggaagtgaaatacatgtacgaactcggtaaaccgcttgtcaagcctgagcagttgcagtccctacccacacaaatgtacaagttccatcaactgtacatggagatgagcgccaccggtagagagatgatcggagcgaggatcagggacacagacttcttgcaaggagatgacattctctggatcaatttcaagggtatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcagaaagtaaacgtcgcaatgctcgaccagtatccgcaagccacagaggaaaatctcatccatctcctgaaggcgcagcattacaagacgttcatactgttgccgtacaacacagagttagtttaattttactgtcttcctataccaaatttcattcccatacgaacatgctaagtgtttcatatgtaatgcatcccacgcacattgcagattccactaggtgctgttactcttcgacctggaggcctgcaccgtcaacatatatgactcaatggataaaaaagagtctacgtttgacaaggttttcgaacttatagacaggtattgtcataagttcctatgttaattaagaatcttgttataattaattgctactaagaatcatagctttaaactccatgtagggcttggtatcggttccgtcatttggtccgcgcaaatgaagagaaagactatgcgaagtttcaattttcttgtgagtacacatgctctacattantattgaatctcccattcaaatacanacaagtgtatattattagatgtctcgccgtttgtcatttatttatagtgcgcaaagcaaaagcatggaactaacttgtgtggctactacgtgtgcgagtattgccactgccttgcaaaccaaatcatcaccacaagagagctcgatgtacgtacaaataaattcaaattttcattacgtatcgatttgttgtttaattactaattaatttcatacattcatatagtttattcgcatgagggataacctgatcacacacaaggaatttatcgcggcggttcaagaacaactcatgggattcatcaacaaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtgtacacattttctttaatgtaaatatatattttggtcatatatatatatgcaaaaaaaatgttaagtgctttcacatatatatatatatatatatatatatatatatatatatatatatatatatatatatatatatatatatatacacacacatgcatttgcataacatatatatgtataaatacatatatattatgcatgtatatgtattgaaacatatatatatatatatatatatatatatatattatatgcatatatatatatatataatatattatatgcatatatatgtattgaaacatatatatgcatggtatatataaaccatgcagcaacagggccatgcaaaaaaaaaaggtcagctcaatctttagtcccgattgatggctcagccggccacgtggctgagccatctttagtcccggttattttacccgggactaaagatagcgatctttagtcccggattgatagtcctggtttagaaaccgggactaaaggggggttacaaaccgggactacaaacgctttctccaccagtgtagagatcctaccttttaccataaactccctttaaatagcaagttttacggttaggtcctttgccccatctctaccgtttatttttaatccgatggctttgaatcaagtggtgacacgtggcaaatttttagaagggctaaccagatttatagggcgccatgtggctcaataggaagccagaagctataccctgaattcagttttagagattggagttttatatatgtaattatacaagccaagcaacaaccttgccatatgaagtagagtgaaagaagagttggtgtatgttataatttgttaattattaatttttaatttcgaaattaaattaacgaagagccatattgagaaacctaactaatgatgccttcgcttgaaatttattatttaagattgcaaaagaaaatgcatatttaaattaagacaaaaggaagaaaagcacctaacctggtttgctcgctaaatttgtaaattaatcacaactattcctcctgttttgcatccttcattcacccgcctatgaccatattttaaaagaaatcttccacgatcaccttgtcattggtctatgctaatatgctttgtagattgccatggctttgttgcacgggttctgcagcagaactgcatacatgatgcaagcatatacctgtcattagaaccgtcacttaaattatagatggtggaatgattaacgaaacaatacttcactgtgccggcgtagtggcaggagattcgaaccgggggatcacgaacgagatgtggccatctcagcggccgctcgctcctcactgcactgtttctgcagcagatactactactgcaagaattcgccgagtttgacgcccgcgatgatcattgtcaggtagatgcatcgtccatgaagtatcgattttgttcatcaacatgacaacatcttaatggccgcgtgcatgatcatgatgaaaagccactggaaacaattgaaacgaccgtgcggacggactaaagatgatgaaacacgatatggattggtcaacacacttgtatattagatgggtttttggaacacgtatataataaattcgttctaaattaaaacccatatataaatacgtattataatctacggatctttctaattaacgcgtgagagctcctaaaagtgtccaattagtataggtatagatagatagatagatagatagataggttatagatagatagattgtccatatagttgatgagtaaattgtatcgcgaagggcggtagttacacaaggacaaagcgtgattcctacttttatttatggttatcgttcatcactagaaattaattgcaaaaccccggccatctaccgatcatgttctttctatttactcaacctcttcatctttgttcctgttgcaaacgcacaatcaaaaaggctacagtagacggcatggcttcacttttgaccaatcatctactgttggagacatgttacgaggattttcgaccagaactgccaaaacgaatcaacgaccatggggcgaagcatagccaaggctccgggcaaagccgaagctcttcgctaccgagttggccatcttcgccaagaccttggatgatatgcagattcctcgctccgagctaaaaccaagcaatgcgccttttcatggagtaattccaggattatccgcaactccactcggccagatcaccctcccggtcacttttggcactcgggaaaactttcgcacagagaatatcagctttgaagtcgccgatttcgagacagcataccatgccatactcggacgcccggcgttagccaagttcatggccgtcccgcattacacttacatgatga

SEQ ID NO: 73438 - DNA, 845 bp, Oryza sativa
acagatacagattaaatacagtcgtgaccgactaagtttcaaggtgtttccttgatatacaagttaggaaacaaacccaggatacacataagatattctatctatattcggtatcctatattcagtccaaatatcatcgccgtgtagatatgggatatccataatctccacagtagcccccgagacctttgcagtcaaccatcatagccttctcaaagacaataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcacaatcatgcatcatatgacaaaagcatacgcggcacccaaagaggcattctagccgactgctttttagtcacaataaaaggaatccgagtggttaacactctaaaaagttcacgaatgaacacacttgacaggcatccgaatataagactctaaagattacccaccaaatatcataaaaatcatggtaatgaataagtctaatagcctaggctatgactatttaccataatgaaaacaggcatataacataccgaggaaatgactatgataaaaacaagtcatttcaagttaacccagacagcttttgtagctaaaaaagcgtacaaaaacagcataacgccttttgtcgggcaccttttaatttgcatcgcaataattcaaagaattatatgaccgcgtaaaaaggattttatcagcattgggcaacactattgtgtacataaa

SEQ ID NO: 73439 - DNA, 24562 bp, Oryza sativa
tatcatccacagccactgcatcatttcatttctgcgctcctcatctactattgagccactcaattagagttagtcagagagggcaacatggctggagctatagtgagtgtttcaactggtgccctgagcaccctgcttcctaagctctccctgttgatccaaggggagtacaagcttctcaaaggcgtgaagggtgggatctcctttctgaaggatgagctgaccagcatgcatacccttctagtgaagctggcaaacaacgaggagaacttggatgagcaggtgaaggattggaggaacaaggtgcgtgagctgagctatgatattgaagactgcatcgaccttttcctgcacaaggtgagcagttctaatgctaaagcgggccttgtccggaagacggcagctaaaattagaaagttatggtcgcgccacaaaatcgcaaacctaattgaagaacttaaggctcgtgttatagaagaaagtgatcgccgtttgagatataattttgaagaagttgctgataattttagccatgttcaaattgatcctcgactgccagcactctatgtggaagcagagaagcttgttaggattgatggtcctagagagaagattatcgagtggctggaaaaagatgaatctcagaaactcaaagtagtatgcattgtgggctttggaggtcttggaaagacaactcttgcaaaccaagtttatcacaaaatgaaaggtcaatttgattgttcttcttgcatgccagtttcacggaatcctaatatgacaaagatactagttgatttgctcaaagaattgggaagtcgtgttgatacatcagatgatgagcgtcagctcatatgcaagctcagaacattcctacagtgtaagaggtatgtagaaaaaactgcaaatggtgtttttccatatattttaaccatgtttgaatatatttcccatgttaaaatagctagcactgtaaagcgcttgtagattctgatcttcaatttttgctagattgtaatatctttgcaagaaaaaaaaaagaaaaacttgatgggcactccgctcattggtgcttgcttaacattggcatgatgaaatgtaaaatgaaaggggcaatctgcacagaatagttagaacctttaagtaaaggctaaaaatagtgatactgtggcttcttcatagatcataaaaataaaccatccatagtttcagtgattatgttaaggattagctatataagcaatgcaattctggaacaaataagatggcattgaacttatggtcttgtatttacatctatgccaaatattacaaagtagttcgttaaattttagaagtgatttggcacgattcatataaagtgccgagttcatcaaaaagaaatacttcttccattttatattttaagtagttttgattttcttagtcaaacttcttgaaagtttgaccaagtgtatagaaaaatatagcaacacttatcgcactaaatccgttgaaaatatttctagatttttctataaattagaaaaaatgcccgtgcgttgtaacgtgtgaagtttattttaattttattattattatatggtttagttaagatgaaattcactgtgggagttcgcttggatatatatatttttagaaaatcatgagctgcaattaagagtccgatcgtctcaagttagcatgtgagtttttttaaacatatttcttacatggttccttcagtattatcaaaagtgaacgatcttaattaaaaccgactcaaatacagatttgtatttccaaaagtaaataaacttaaaaaccgaatcatatatggatggcgtaccaaaataccggcaaaaacatctttaatttttattatagtagagacttggtcaaactttcaaaaagtttgacttaaaaaatcaaaacgacttgtgatgaaatggaggtagtaatagcaagtctggtgtgtggccgtctcaagcagggaatacatgctgtagctgcaacaaatgacaaactccaccttaattaaatattggtctcgtttcacccaaatggccaatctagtaaacttttacaatgtagttttcaaatgggattgatgttttttggagcagggcagcatggtatttgctgaaaatgactgcacaatacatagcttgttcgttttaaactctatgatttattaaccagatcacgttttctcaatgctaaccaggtacttggtcattgttgatgatatttggagcacaaaagcatgggaagttgtcaagtgtgctctcccagagaacaatttatgcagtagagtaatttcaacgacaagaaatgcagatgttgcaacatcatgctgctcctgtttagcaggatatatccataacatgcagcccttaactgagcaggactctcagaagctattttttaagaggatttttggggacaagtcagcatgccctccttaccttgaacaagtctcccatggaatcattagcaagtgccatgggttgccattagctattatcagtatagctagcctgctagctggaaaatcacatatgaaggagcaatgggagcaagtgcacaattctattggttttgtgtttagtcaacaaggaattagagatatactgctgcttagctactatgatcttccgataaatctgaaaacttgcttgctatatcttagtgtgtttccagaggattacaagattgatagagaagagctaatatggagatggatagctgaagggttcatcagtgaagtgaagggtcaaacactggatcaaattgctgataattacttcaatgatcttgtaaacagaagcatgatccaaccatttgacatcaagtacgatggcagggcagatgcttgtaaactgcatgatatggtgctcgaccttataatttccctgtcaacacaggagaatttcacaaccataatggaagggcaacaatataaatgttcttctaataagattcgtaggctgtcagtacattcaaaatatctggaagatgaagtaatgcacgagattatgatgaattgctcgcaagttcgttccatcagcttctacgaattgcaagatcaggaaattagtcttctctcaactcttaattctttgagagtgctagcttttaataattcccaccatcttggtaacaaaagcattaaatatcttggaaggtttttccagctgacatatttgagcatcgcttctcgtggtatcactgatcttccagagcaaataggaggtctgcagaatctactgacactagacattcgtggcagtagtgttgaaaaattgccatcaacaataggttgtttgaaaaatctggtgcgtctacttgtaaatgaagctgtgaaattgcccaatgaggttggagatctacaagccttgcagcagctgtcatttgctggtaactataattccatagtatttgtggaacagctgaagcggttggcaaacctaagggcgatttccatacgactgcatgatagcgcacgacttggtcatcatgatatggcaaggtatatggaagctttgaagtcatctcttgctgtgatggataaacaagggatccaatcattggaaatatcctgctttgatagtgtgataggagaaaaactcatggatttattatgctactcaccatgcctccaaaggcttgtcatacatggttgttgtatcggtctgctatcaaagcagatgacgttgcttgttaacctcaggcatcttgaaatatgggttagaaacattaagcaggacgatctctgcgttctaggaagcatacccactctgctcttcttcaggttatttgtagtatgtggacctgatgaaaggcttgccatcagcagccatcaattccgatgcctcaagcagttcatcttcgtaagttacggaggtgggctggagatgttgtttatgcagggagcaatgcctgagctccgatggttctcttgaattccgcgcacatgaatcagactgcaagatgggttttgagttcagcttaaagcaccttgcaagcctggagcacctcaaagtcacaattttttgccatgttgccaccagaagccgggtggaggctgcagaagcttcggtcaggaatgcagccagtgcccacccagggtgtcccatatttgaaatcaatagatgtggggaacaaaacatggtagatgataaggtcgacaaggaggagatactcaaggatatagatgctcatgaagtggttcggcgtgacatgaataactgaaattgcagtttgcaacaccctatgtgagattctacttttactgctgcttataattgcctgagacagaggctaaactgctagccacatgatcactattgatgcatggaaactaagttatcagaccttccaattcagaaccatcatcatttggttttgtctaattactactggtaatactggcaagtagaccttctagcttgatttgtaaacacattgagctttaatatttcaaatgcgggtagccggactgccaatgagcatctcttgcttcagttgtactttactctatgtacgccgaaagtctgcaagctttgagtaatctcttctgcaattacttctccgaaaggaccaagataagaaaacaatatgtactacctccgtttctaaatgtttgacgctgttgacttttttaaacatgtttgaccattcgtcttattcaaaaaaaatataagtaattattaattcttttcctatcatttgatttattattaaatatacttttatatatgttgtcgaatggacaactgcgtcacgtcgaaagacgtggttttctcaacagtggatgggaaataaaaaaacaattgtattactttgttcaaattttttgggatccccctattacatggccataaagagctatttatagccccattacaggtttctactactagggtttagattatataggggaattttcatggttacccttatgatagggacattatggagggcacactgtgtcctttacacatacgggcccctactgggcctaaatggctcggcccatctatctggcgaaatcccccgagggcgtagcggcccaccaggcctctcgacaatgaggttcggtacttcggcgaaacccgtgcctgtgtgccgaggctttcaccgcatcatcttcgcccatgccgccttctggcaaggactccactcggcgaagctggtgtaacccaagccactgctttcgcccgtatggctttactctcaaccttcgccgcccgcctccggagcgagcctgttgcttgaatttttggtttcagcaggttcggccgaaggccctccgtggtaagcctccaacaagcccctaacgggcaagggtgagtagggagcttcggccgagaccgtgcaaatcgaatggtataccacgaggtgccccctttcggccgatgttcctgccgaaatccatgatgtacccctgcgaaataaataacttgtttccatgtttacaaaaaattcttgagaaaattcctttctcgcatttgttacaaagtatcgaaagggttgacttgtctttgtcattactatgaatagtaatgggccctgtgggcctctcctttattgcaatcggcctttcgctgttcggctcaggcccgatgggaatttaccgtttcgtctgcccttgggcacgtgtcaggatttgattggctggtaggcgaacggtctcgcgatggggttatatagccctgggccgacttgctattttctcttcccccccccccccgctcttcacttttttaccacttgacgcgctccacgctctcttcatttgtctgccccttagcttcttcgccaccgttgtgcttccgcctttcggctactttccccttttttcttggccgcgagcctgatggctcctcgcaagcccactaaagccgggtcaactggcgaagaccctagcggccttggcgaagggtggtcgtgtttccttggcaaatcgctcgtcaaggaggccgacttagccgagttggtatcctccgatgctcttgtggagggccaaggatcatgtgggggcgaagccgttgtcccttcgccctgtaatgggcgaacggttgtcttcgctgcctacttcgccgccgggcttcatctcccgtgtgacgatttcttgtcgtctgtgctcgcgacatacgaggttaggcttccccagcttagtccatcagcgttcctgaagctcgcggttttcgcttggatgtgtcgaacctgtgggtccgctcctaccgccgagctattcgccgttctatttatggcatgcgccacgaccaaggacgtgcagacgccgaccgggccgaggaaaactgtcttcggctgcgtgaacttcatgctgcgtctggagtgctcaaatgcttggccggtgcccgcgtcgatggccaagtgggataggaactagatgcaaaaatggttctacatcgccaacccttaccccgccgaggatgccaaggcaaattggctcctttttcagcgttccgccgtctccatcatcgcgaagctaaacgtggagatcaatgggaccctcgagagtcgagtcccggcttatactcctccttaaggtcacacgatggctaagcacccaagacctttgtgaggagttttgcctccttcggatctcccttctcgctcgtgtctgggatgtgttcgtgaacgagggcgaagaggttctcgggcttccccgccttgttctccccactggggtcgaaagtgagtttttgcttttgctccgagccgtatatttcctttatggaaatgccctttaggctaaacagttgtttttgttttgctttttcacagcccgaaccttggaggacgccgaaatagaggcgtcgaagatgataggtggtctgacaacggccgaattcgctcgcttgctccagcgccagaccgacgaccgaggtgaaccgagttcatgttggcgaattgccaagtcagtcgaacccctccagggccagggatgacgaagtcggcacttcgaagaaacgcaagcgtgcagtcgcgaaaggtggccaggttcgaactcgccgcggcgcgaagggtgcggttgaaagtgacggggaggaggaggaagaagaagatggggaggctggatctgaggatgatgggttccatggctacacccctagttcgactcctgtgaaatctggggcaggttctcatatttcacctacgcgcccgcaagatatcgttgtggcgaacaccctcctggcgatttctagtactgcggcgaaaccggggatgaccgccaggaggaagaaaaagaaagggaaggttgtgcaagtcgcccgcggcttttcgaacagcgaagggtccgacgggacgcctacttcgccgattctgcagcacggacctcctcgtggtaggcgcatgtccccgccacctgctagcgatgccgaagcggcgatgggtgggagtgcctcagcactagccgctaaggtgaatgtttctggggacgaacgggttgaggcaattccttcgccagcccgtcaacgggagggaaaagctccggcggtcgaagcgaccgtttcggacgtgacgctcactgcccacacttcgtccctgctgatttcgccatgcggccggagatcctccgttcgtggacggtgtgtgccatgttattgcaccgaccgacggccttgggctcttcaccgaactaaacgagttcggcaaaagctgcgcggctgcggagagcctgtttgtgcgggtatgagttttctgtgtgccgaactttgtcctttcgcttgtgtcctgccgtaacgtttttgtttctccttgtccagggcctcgccgcacacttaaacgcgaagaaatctgccttacagaggctagacgggtaccgccttcgccttcgaaaaaccaaagaagatcttcgccacaaggaagacgaaaggcgcgtcgtggcggagactttaaagaaggcgaatgctgaaaacaaggttcttttgggggacaacaagtctctccatgctgaccttgatgtggcgaacaagcgggatgccgaacgagaccgacaacttgcttcggccgaggagaaaatcaaatcccttgaagcgcgtcttgtctcggccgaagctgccgccacgaccttggttccggccacagtccgccaagcaggcctgttacactctccggctgccccttaatgaccttggggcgcgggcggaaggcgctctgggcgaaggcgggaccgtattcgacttctccgaatggacgcaggaagcagccggcttggtcgttgaagtggcgggtgcctacggggactgctgcgctcgtgtttcggcgggattcgtcctcagccttttgcacgcgcacggctgtgaccatatcgggaattttcccgacctcgtgaaagaagaatggctcagcaacacgcagtgttctggggcggcctttcgaaaagggttctgggaggatggcggtcgggactgtgcgaaaactcgactccgcgagaaccttgagaggatcgcgagagatgaggaagccgctgctggcaacaccgaagttgaccctgggccgtcggaacaggccgccgggtacgagggcaaaaacaacggaggccaagaccaccctgatgtgtgaggcccttcgccctctgtgcttttttctttatttttctttagtcctttcgggctttttggtagcctagccttgtatataagctctttgcatgttcggctttgagccgttttcaacttgtaaccaatatgaactttattctaccgatgaaatattatcctttcgctgatctaattgtttcgtttgaaagtgggattgatctcatctatatttccccttttttgcacttttttcttttgtgctttactagcaggcttgtggccgaaaggtatgcgttcgacctcctactgaaaaatggcgaaacaagaacgagaagtttgtggcgatgaaaggcctgccgaagattaagtgtccttttcggcctgtttaccatgagatgttgattaatggcaatagctataaggttgtaaacgttgctaaattgatgcgcgtgcatccaggccgaaccttagaggactacgatcgctatcgtgtgtcacgtcgtgaagatagttcgagcttttggtgaaactttaggagatggttcgccaagaggcgatcgctcgtcgccgttatagtttagtttgtgtttgtcctccatcccctttgagggttgtatatgatattagtagtgacgacgaacccgattcgccaaaccattccttagggggtgaggactgttgtgtgggcgaaggtgtaatttatctgtaagctcgtatcttagggggtgagcaccgttgctttcttcgcttgtatcatgttgtcagacttgtattcttcgattattttttcgaagctaataaagatatgctttatttccttttcgctatttctcgcattgtcactcttcgtgcttttgttaggtcggaacgtgtcggcccctttgcgtatcgtagcgaaataggtctgctgacttttcagcttttggcttccgttttcgatctgtagttttctgcgctgggaggcgcgcttgtgttttcatattgatcgagtgtaacggtgttcggttagttgtttcccgaaacaagctgttgcggtttcaacgttcggcgtgcgatacttcggccgatacgttttgccccccctggcatttttgctgatcaggcgtttgccttggggtttttccacaaattatcattcacacaaaaaggtgaaagacacaaatattttatgctggttcaggcctctagagtggataatagccctacatccagttttatttttcattttcctctcttttttttgcattttcgtgctgaagggcttacataatgccgaaaggcttacataacagtatgtacatttttacaagttggcgatttgagtgccacccattctacacatagaaacgcttaagggaagcagcgttccaggaatggtcgaactctttgccttccagcgtcgctaggcgaaaggagcctgtcctggacctgtgcttgatgaggtacgggccttcccacttcgattcaagcttcccgaccgccactgggtttgccttcttccttaggacaagatggccaggaaatagctctgtcggtcgaacttttttgttgtaagttgccgaagtgcttgtggcgtatttgcgcatgtgttctaaagcttcaactctcaccccctcgaggagttcgagtgacacctcacgcccttcttcgcctccagagaacatcacccttggcgaattagcccctagctctgttggggtcattgcttcgtcgccatggagcatgaacgggctgaactttgttggccttgtgggggtcgtccgaaaggcccagagaacagatagcatttcttccggccatttacccttcgccgccccctcaagccttttctttagcgcctctaggatcttaccatttgcgcgtttggccgccccatttgactgtgggtgtgcgaccgaagcgaacctgatttccaggtttagcccctcgcacatctctttgaacttatcagagtcgaattgcttgccgttgtcagtgatgaactcttttggtactccgaaacagcaaataatgtttttccatacaaacttctgtactgctgccgaagtgatcgcgccgagtggttcggcctcgatccatcgggagaagtattcgattgctacaattgcgaacttgtacccgttttgcgccacaaggaacgggccaatgatgtctagcccccatctagcgaaaggccagattggtgcgataggctgcagctcatattggggtgtagtttggcttcggctatgccgctgacagctttcgcacttttgggcttgctcgacacagactttcagcatggtgggccaatacacaccctgtcgaaacactttggaggcaactgttcttgcggcctggtgtgcgccgcagagcccttggtgtatctccttcgccatttcttcaccttcggcaaaggagatgcagcgaagcaagggttggagcaccccggagcgatatagctggcccgagactagcttgtattttttgcggctctgagctgtaggcgcttcgcttctgcttcatccttcgggagccagccgttcttgagatacttcacgaacggggttcgccaatcaccaatcctctgggtcttcacccagctctgcctggtcgattgccatgatgtttgggctctctatgggcacacttggtgcgtacaggacctcaaaaaagatgcctggcgaatgcgggcctccacaagcagcagattttgccagggcgtctgcttcctcgttctggcctctaggtaagtgttcgaccgttatgccgacgaagcacttttccatagatcgaacagcctccaaatatctcctcatcccttcttcttttgcctcaaaggatttgtcaacatgacttgccaccaatttgaagttagttcggatgagtaagcgccgaacccccaaagctttcgccttttttaggcccaacagtatagcttcgtattctgccgcgttgttggttgtgtcgaactgtaaccttgtggcgtaccgaatcggcacgccccctggcaaagtgaggactgccacagcgcccacccccttgtgcgaccacgagccgtcggagtacatcacccaaggttgttcgacaggcttgggttcaagggcgaatgctggtgtccatttggccacgaaatcagctaggacttgggacttgatggcagtacgggcgacaaaatgcaagtcaaagggagataactccgccgcccacttgctgagccggccagtaatttccttgccccggggcacttcgcccaaaggatactgcgatggcaccgtgactttgtggacctgaaagtagtgtttaagcttgcgcgaagccatcactagggcgtaagcgagcttctccatttcaatgtatcgtatctacgccccttgcaaacttcggagacgaaatacactggtttctggcctgactctgtttcttgaacgagggctgcactgactgctatcggcgaagctgctaggtagagtagcagttcgcttcccggtgctgggctgaccaaagcaggtgggctctgcagatattgcttcagctcgtcgaacgctgcttggcattcgggtgtccaagtaaactttcccgtgccccggagggtcttgaagaagggcaagcctctttcggctccctttgagaggaatcgactgagtgccgcaattcggcatgcgagcttttgtacttcacgtacgcttgacgggggcttcatttgctgaatggcatcaattttctcggggttcgcctcgatacctctttcagaaacaagaaaacccaacaacttgcccgcgcgaacaccaaaaacacacttctcaggatttaatttcatacccgccgcgtataagttgtcgaaggtctcctgtaagtcggacgcacggtcgaaagccttgcggctttttacgacgatatcgtcgacataagcctccacatttcgccccagctgcttgtaaaggaccttgtacaccagcctggcgaaggttgccccggcattccttaggccgaaaggcatcctgaggtggcaaaaggtgccgaatggtgtgatgaaggccgtcttggggatgtcggctggattcatgtggatttggtggtagccggagtacgcatccaaaaaactcatgagttcgcaaccagctgtcgaatccatgagctggtcgatccgcggcaaggggaaatcatcctttgagcatgccttgttgaggtctgtgaaatcgacacacatgcgccatttgccattcgatttctacaccagtaccgggttcgccagccactcgggtggtcgatctcctgaatcaccccggctagcagctttttcccttcggctttcgctgcttcttggcgatcagcgaacatcttgcgcagcttctatttccttggcttggcatccggcttgaccgccaggtgatgcatgatgaggtctgtcgaaacacctcccacctcgtcggggccccagacgaagatatcaatgtttttcttgagcacctacaggatgttctcaacttctctttcacccatgtcaccccccagcgatacaaatcttgtgggatcggcatcgtcgacttgcaccttgatcaccctgccgtggggggcgggcttcggcgtgtgcttcgcccggtcatgcggttcggcctcaacattgtgcaccgctctgttgattgcggccaaatcgccctttgatgtagccaaaagttgaagccccttgaccacgatcacccctgcaggtccagacatcttgagtttgagataattgttttgggaggtggcttcgaacttgttcaaggttgcgcggctgaagattgcattgtagttgtatggaatgtcgacaacgtcgaacagtatttgctcttcgcgtatgttttcacctgtgccgaaggctaccaccaactgtgcttggcctaggacttgaactgcttcttcgccaaaaccatgaagcgaggccagtgtttgggtaagggctagggtaggcaaccctatcttggcgtatgcttcggcgaagatgacatcggccgaactccctccgtcgactaagatttgccggacttcgaagccagctacctcggccgagatcaccagggagtcttgatgtgggaacatcactccttcggcatcttctggcccgaaaaagatctgttggttcaaatattgcgaggccccttcgcccgccgaagtgatgttgtgcaccattcgcagctgcatcttcttttgcctttttgacagttgattcggcgggtcggcccttataatcacttgcattactccgcgctgcacatcttggcgttgttcggccgggggtgcttgttcttgaacggcttcgcggggtgcttcagcagctgctccttgttgcggtcttggatcttgcgcgttgccacgctgccgaatgtttcggcattgctcggtggtgtgcgaagagcgttcgtggaaggcgcagtaaaagtcttttctgaccttcttgcgaacaggttgctcatggctgcttgcttgctgggcgtcgaactccttgtggagggcttgaacttcttcgacagctatcatagccttgcccgcacggtcggttttgaatttcctccaagtcatgggagcttggccttgccttggcggttgtccttggtgcaccggctgaggctggctaacagcgagaggggctggttcggcgacctgggcttgtatttgggcttgagcagcggtgacagaggctttatcatattcggcctggattgcttgccgttgcttggaatccttttcgccccttgcgtacccgtcaatgatgcgaagcaagtgctcaagtgtctgtggctccttgttggcgatttttcttgtgagttcgccctcgagcagcccggccgaagcggcgttgatgacggacgcctcagttatgtcctgaacttggcatcgggcttgcgagaagtgacgcatgtactcccttatcgactcccccggcctctagcgaatgtcgagtagatgttgctgcgtcttcggctcctcgtaggtgcctcgaaagttaagaacaaagacatcgcgcaattgctcccatgagttaatgctgttagctggtaaattgaagtaccaagaacgggcgatgccgtctagagcaagatgtattaccttcgccttggtattttcgtcgccatgagtggcttcgatcgcggactcgtagatggacaggaactcttttgggtccgttttgcccgaatagcacggaacgggagggaacttgaacttgggtaggattggatggatcttgattcccccgctcagtggtagccccttttcgcccctcgctttgttcgcagcaccttgctgcgaatatggcgttgcgaagggcaaagtcatggcttgcgcgtgaggttgagccacagtgttcggctgctcggctccgaacggcgatgcttggtgtgccgccatggatgggtcgaacgacggctgggtccatgccatggcggcctggtttggcgcctggttagctccgaagcctggtgtcggtgcctgtggtcgaatggttggtgcttgagcagcgttggtgaagtcgaactgcggtccttgactccaaggcgaagcccccagatcgggctggctcgatggcaaccaactgggcgcaccttgacttgtgttcccctccggtcaggccgaaggggctatacctgaaatgctgtggggttggttgagttgctgaaggaaagcttaaagctgtgcttgcaaagctgaagccccttccgccaatgcttgtgacatttggcccggtggtaaggggtgtacttgggcagcgatcggctgagcctgcagctgcacatgaggggtcgggtgtattgctgcggccgaaggctgcccggcgaagtacactggcgcttgcatggcttgtggcggaaggggttggattgatgcttgtgggtggacttggggtggaatgtaacctgtcgaatattggaggattggggccgaggcgaccttggcttgccgcgctgcctcatacacctgctgctgttcttgcatttgacgaagcatgtcttggagtcatgtcatgtttttgcgcatggcctccatgtcagcttcggcctgtgcttcgaggttggggttgacttatgcagcggcgagcgcggtcaaagctacagcctgttgcggtgaagcagcttggggcgccgctagttgacttgtcgaaaggatttctgccctagtctggagcgcccttgctgccgctgccgccttcgccgcatcgaccatattcggcgcctgccccgctgaagcggcaggagccgaaggtagtggttgcggcgtaggggccgacgtcgatggtaccacaccagcttcgacgccgagtgccgaaggctctgctccctctttggctgccatctccactcttgtttcactctccttatgtcttgcaaccttctcatttgcgaccttcttcggtggcattttctctcagtggtttcgctcggaggtccccacggtcggcgccagctgttgtcgaatggacaactgcgtcacgttgaaagacgtggttctctcaacagtggatgggaaataaaagaacaattgtattactttgttcaaattttttgggatccccctattacatagccctagggggctatttatagccccattacaggttttcactactagggtttagattatacaggggaatttacatggttacccttatgatagggacattatggagggcacactgtgtcctttacacatacgggcccctactgggcctaaatggctcggcccatctatctagcgaaatcccccgagggcgtagcggcccaccaggcctcccgacaacaaggttcggtactttcacgaaacccgtgcctgtgtgccgaggctttcggcgcatcatcttcgcccgtgccgccttctggcaaggactccactcggcgaagctggtgtaacccaagccacggctttcgcccgtatggctttactctcaaccttcgccgcttgcctccggagtgagcctgttgcttgaatttttggtttcggcaggtttggccgaaggccctttgtggtaagcctccaacaatatatacatatagttttacatattttataaaagtttttgaataagacgaatggtcaaacatatttaaaaaagtcaatggcgtcaaacatttagaagcggaagcggaggaagtatgatttattgctgcagcaatgatagctgcaaaacaagaggatatcttggtgacattgccttctgatactgtagatatataaaccctagtttactaaatgtgagagtattccctagatttggccaccagtcttatctcgtcctagtagaatctcaagcattttcccagcaatatttccagtcaatggagaagtgggtagctggtgcctggtggttgtttagggtaagcaccacagctggctcgaaagagtcagagagatttgtcaagtgattcttttcttatttatcgatcacatttttaaaactattatatatatcaacactcaacaactttatgaaaatctcataaagttggggctggggctggggctggggctctgggacattgagacatggggacagatttgaaaatctcatggtaaatttatgaacaaatttgagattgatcaaatgtatctatgtgcaaattgtggataaaaaattgtcagatgttctattttggagaagaaatgaaacaaatcatgttataatattggtgcatataccttttgtgcaaatatttaattaatttaccttttgtgtatatataagatgtgattaattgtccgtataaatttactactctctttgataaaaaattaaaacctatatgatttttgaattattttgtcttggggtgcgtgaccacgattttatgtttcaacaagtttataaaacacgatgggagttattgttttaatgctagatattgtagatcatttagcactcgaataaagacatgcatataggcttggatattcatacttttagacatatgtttttttgtttggttattatgatttgtattatcaaatatcaccctaaagatagtaaaaacagattactactacatgggtttataatacggggcctcctaccccgcgcgtgcgctccttgagattaactcgcgcgcgtgatcaacaatagggtagtgtttctcgcttttcttttctgttttttttctcactttttttttgaaaaaaataaccgcctgcacattttattccttttatttaggataggtatgaaaatttaagtcaatatttgaaaacttttaactcaaattttaaaactttcatctcaaaattcaaaatattcaatttaaatttgaaaactttcatctgaatttaaaattcagaacactcaacttaaatttttttaaaaactttcaactcaaactcaaaactctcacgtgaaaattggaggtgaaagattcaatttataaaatatagaaaaagaatcacgcatgtggagaaaaaatgaaagatttccaaaaaaaagaaaagaaagaagaaacagcgagaaaaagcgaaaaagaaaagaaaagaaagcgatagggtaatgggccgcgtgcgatatggtccagaaacacgcgttgatagcgcgtacgcgctgattaccaaattccttataatatcagtaataatatctacccgtgcaacacatgggtttacagcaataacaaattatagaacagaccggacgtcaacaccaaccgattccaaattcccaaatcttcttccttgtagctgccaagatcccaagaaggcaagaagtcaataacgtgccagaaacgccccttgttccctcgtgtccactcctgcccccagctttctccattccaccccatcctcgactcgcaagtacccagctaagatcagggagctcatctccaggagacggcaattaacaggtaacttctctagttctcctcgtctcttctgctccatctccggcgaccagtgattcttggtgtgccactacactactagtggtactccaacaagtctgacggccaatgccaactcaatcgctgcttttccccaaaggcgaatctatctgcatctggattaccaaggtatttttgggcttttcgcacatatgcacacatcttttactctgttgttctacaccggcgacctgtcgttaacttgttaatctgttcttgtacaaggacggctagtgaatagaagggggagagagagatggacggagcagcagttagtgctgccactggggtgatgggttccctccttgccaagctatctgccttgctgggagaggaatacaggcttctgaaaggtgtcaactctgacattaggttcttgagagatgagctgactgccatcaacaactttcttatcaacatgtcaaatatggaggagaacctgggtgagcaggagaaggagtggagaaacagggtccgagaaatcgaggattgcatcgatttattcatgcgcaaattcaatcatggggatgtggatgccaactttgtccgcaggacagcaaaaaagataggaatgttatggtcacgtcatgaaattgctagccagatccatcaacttaaggattgtgttaacgaagagagtgcccgtcgtttgaggtatagatttggtgaaagcaatgcccgcatagttgaaattgatcctggactaccagcactctatgtggaagcagagaaacttgttggcatccatggccctatggagaagatcattgatctgttgacaaaacaggatggatcctcacaacagctgaaagtggtttccattgtgggctttgggggccttggcaagactactcttgctaaccaagtacttaaaaaaatcaagcatcagtttgattgcacagctttagtatctatttcacggagtcctgacattaagaagatcttatttgttttgcttaaagatatgatcaacaaaaacaattctaatgatgagaagcacaaaaaagttgttgggatcaaggcagaaaaatcagatgatgagaaacaactaatcaataagctcagagaatacctaacaagtagaaggtgggcacaaaaataattggttctctttcatttactttcctgttaaagtcttcatcttaaatttttcaagtcgtttccatttgttgaggtccctttttcctttgctgtacaatttgatacaagccaattcaaaacccatgtaaatagaatcattactcatatttgtaattaattgttaaacttgataatataagactttgatgcacttgaccaaaatttcttaagaactgtttttgccttgtacatatttcttactaccattagaaattcaaccctcacaatgaaaatgttcatgttgttttggcatcatttggataatatatagtacttttctttgagaggatttgacaggtagctacttatacttttgcacatttagtattgaatttgttctccagaagcagtatactatgtttgcactgtatctcttcagtaaatttcatgttatttttaccaatatctgccttgttaaacttgactaattcactataacatctacataggtacttagtcgctgttgatgatatttgtgtaagatcaaagtgtgttttgattcttattctgtgatgaacaattggcatatgtgattattggttttgatatttggagattatcgtcgaagtggttttggagataatcaattttcaggtgatgattggattcactgttattttatgtgaccggtccgatcgggcggaggttgccggtcagaccggcgctatgtgtgcagtcagaccggctggcccgcggtctgaccggccgacactgtgtcggtttcggtttcgggttgtttatttggatatccgagtttatttcgtgattatgacttctaggtggatactatacgtatgtaatactattgtttgctgctaatgagtcaagttggagatagcttggtctcggaatatggtttctttgtttgttccatgtgtaggtgacttgatgtctcgggagagtatttgcggtgatggaccgggagtcggcttggggataagatgacgtctgtggtggtcagagatcatgcgggatacttaggctagaattgatgcacgtggttgatggagattccatatggcatatgatggaggtattgtgtgcatatgggatgcggagtcgaatttggaaggagtccaaatttggtacgattggttatgtaaagtttgtttcttgtactagagggtttcctaaggtgtttaggactcttagtatgagtttggttcgtggctttaggctgcctaccttatgtataaatagagggggagcgtgaggcttctcggaatcgcttttaagagcgtggagttgatagtttagttagggtttcgagtttagtcgagatttttgtaaggagtgttgttgttgcactttgtaaacacagagagaagcaataaagttgtcatctactttgagagttcttcgatttgtgtttcaccgggtttcggcggtctaaccggcaacacaccggcgatcagaccggcggcaaggcggcggtcagaccggcagcactagggcagtcagaccggcagcgtaagcaggcagcagcaggcagtctccgcgattcgaccgatcgatctacatcggtcagaccgacgttcatcaggcggtcagaccggcgcatccacttcggtcagaccgcgatccgtcgaatttgagggtaacttttatttccgctaaaagttttggtttttgggtatatcaaccattcaccccccctgtggttggcttagttcttgtgattcgatcctacaagtggtatcagagccttatttgcttctttggattttaatcgatctagagtttttgccatgcctgcttctaataagttttcaactaagcctcatgttttcgatcgaacggatttttctcattggtgtagttggatgcaatcttacattatggctgagaattatgatatttggaggaaagtttctcatccttatgtgattcctgaaggtattaatactgatgctgcaaaaactgagtttgaacaaaattgcaaagctcgcaatattcttttgagtgggatttctcgttcggattatgatcgtgttgctcatcttcaaactgctcatgagatttggattgctttgagtaattttcatcaaggaacaaataatattaaagaacttcgtcgtgatcttttcaaaaaggagtatattaaatttcagatgaaacctggagaagctttggatgactatctttctcggtttaataaaattttgaataatcttagatctgttgattcttcttatgatgctaattatccacaatctgagatttctcgtcactttttgaatggtcttgacatgtctatttgggagatgaaagttacatctattcaggagtctgttaatatgtctactttgactttggattcgctttacacaaaacttaaaacacatgagatgaatattcttactcgtaaagttggttctaagtctagtgctttagtttcttctttgacttctttggatgttggtacttcttcatcgaagtcttctgttcttcctttatttaatgccatgtccgatgatcaactcgaacagttcgaggaggaggacttggttttgttatctaacaaattttctcgagctatgaaaaatgttacgaacaggaaaagaggagaaccgaatcgttgttttgagtgtggagcacttgatcatcttcgctcgcattgtcctaagcttgggagaggaaagaaggaagatggtggtagagtcaaagatgatgacgtgaacaagaagaagaacatgaaggagaaagagaagaagaagcattgcatgcagtggttgatccaagaaatcataaaagcttttgatgaatcggaagatgaagatgagagcaaaggtaagcaagttgttgatctagcttttattgctcgtaatgcaagttctgatgttgatgaatctgatgatgataatgaagaaaagcttagttatgatcaattagaatatgctgcttataaatttgctaagaaacttcaaacatgttctattgtgcttgatgagaaggatcatacgattgagattcttaatgctgaaattgctagattaaaatctttgattcctaatgatgataactgtcaatcttgtgaagttttattttctgaaattaatgctttgcgagatgttaattctattaattgcaacaaattggaatttgagattgaaaaatctaaaaagttggagtcttcttttgctcttggatttgctttacatgctcgtatggttgatgagttgattttgacaaagaacgttttgaaaaaaatacaaagttgctttttgtgcgagttctttggtcaatgcttcatgtgcaaataaggcaaaacaaaacaatggtgctttgatttctcaagattgttcaaagtgtgttttgaatgaggtgaagttgaaagatgctttagagcgtgttaaacacatggaagagattgttaaacaagatgaggtgtcttcttgctcaacttgtagaaaacaaaaaggtcttttggatgcttgcaaaaattgtgctattcttactcaggaggtttcttatttgaaaagttctttgcaaagattttttgatggtaaaaagaacctcaacatgatttttgatcaatctaaagttagcacacataatcgtggtttaggctttgatccttatgctcatcatgctagacatcctcctactgttttgggtgttgctaggagaggtgaaattttgattgaaactgagcctaagaacactatgtttaaatctgctggcatcatgtcttctttgaatgcatcttcttcgaaatcaaatgttgtgaatgcaaaaccttctgttgatgcaaaaccatcaatttcaaaaccatctacttcacaaacttgtcgtgagaagtacacttgttcttttttggaaaagatggatatttggttgtttttgttttagacttgcccataaacagaaaaaggaaagagaaattgcttttgcaaaatgacgttagcaaaaatcgggttttaattcgaggaccacggttagaccgacactgaccagtcggtcagaccggtcagtggtcagaccacagttgaaccggcggtcagaccggttggcaggcccggtcagaccgcaggtacagcggcggttagaccggcctcggggcaattttgcgccaaattcaactcagacttttgtgaagcaaaaaggtaattagtctgattctgattttgtcagtgcatttgtacctactggttctactggtcgtgtgactcagtgttggattccaaaatttcttatttctaaccccaacacggaggcctcgacatcttctcgtttgtaggtatttttggcggtatactccccatgagtgttcaattttgagatgacgattgcttctcaaggtaacatcaatttacttttggattgacatatttttggttctactttcttaattattaattcttcatgtgctagtgtttgaggtagtagtttttgttaatacaagtgtatacatgtcaattcatgagaatcttggtgatatcattggcaattggatgtctttttcaaaatctttggtttcttcttgatttttgttcggggaaaattggaggttatattgagggggagttagtgcttattcgtgaatccttttggcatgttttgagggggagtttatacctcatggttttatcaagcaataatatgacaatgaaaaattgcaaaaagagagctttgttttatacatatggtattttcttgtgcatgctaacaatactttaaaggtttatttgtctctagcatagcttgtatggattctagtctttttatgagctttagattttgcttttaagggagatgatgcatgacacttaaattctacttgattaaagtaaatatgcaatgttgatgctagcatatggtttgatttataaatgctttatatatatatatatgctttattgacttgttattcctcaaatagctttaattgctcattgtgaaaaagagaataaaaaatataaaaatgaataccgaatccttggaaacagtcttgacgataaggacgtattcgatgtgagcaaaataatgggtgcc

SEQ ID NO: 73440 - DNA, 12079 bp, Oryza sativa
ttcaaaaagtttgacttgaaaaattaagacgacttgtaatatgaaatagaggtagtaatagcaagtctggtgtgtgggcatctcaggcagggaatacatgctgtagctgcaacaaatgacaaactccaccttaattaaatattggtttcctttcacctaaatggccaatctattaaacttttacaatctagttctcaaaaggaattgatggtttttggagcagggcagcatggcatttgccaaaaatgactgcacaatatatagcttgttcattttaaactctatgatttattaaccagatcacattttctcaatgctaaccaggtacttggtcattgttgatgatatttggagcgcaaaagcatgggaagttgtcaaatgtgctctcccagagaacaatttatgcagtagagtaatttcaacgacaagaaatgcagatgttgcaacatcatgctgctcctgtttagcaggatatatccataacatgcagcccttaactgagcaggactctcagaagctattttttaagaggatttttggggacaagtcagcatgccctccttaccttgaacaagtctcccatggaatcattagcaagtgccatggattgccattagctcttatcagtatagctagcctgctagctggaaaatcacgtctgaaggagcaatgggagcaagtgtacaattctattggttttgcatttagtcaacaaggaattagagatatactgctgcttagctactatgatcttccgattcatctgaaaacttgcttgcgatatcttagtgtatttccagaggattacgagattgatagagaagagctaatatggagatggatagctgaaggcttcatcagtgaagtgaaaggtcaaacactggatcaagttgctgagaattacttcaatgatcttgtaaacagaagcatgatccatccagttgacatcaagtacgatggcagggcagatgcttgtaaactgcatgatatggtactcgaccttataatttccctgtcaacacaggacaatttcaccaccatagtagaaggggaacaatataaatgtcctcctaataagattcgtaggctctcaatacattcaaaatgtctggaagatgaagtaatgcaggagattatgacaaattgctcacaagttcgttccatcagcttctacggattgcaagatcaggaaattagtcttctcccaactcttaattctttgagattactagcttttgaaaactattggcaccgacatggtaacaaaaacattaaatatcttggaaggtttttccagctgacatatttgaagatcaaatctatcactgagcttccagagcaaatcggagacctgcgaaatctactgacactagacatacgtagcagtagggttgaaaaattgccatcaacaataggttgtttgaaaaatctggtgcgtctacttgtagattataatgtggaattgcccaatgagattggagatctacaagccttgcagcagctgtcacgtgcttccgtagtatttgttgaacagctgaagcggttgacaaacctaagggcgattgacatagacctgcgtggtagcgaacaacttggtgatcatgatacggcaaggtatatggaagctttgaagtcatctcttgctgtgatgggtaagcttcaaatattgcaaatatcctatggtaatgatacggtgataggagaaaaactcatggatttattatgctactcaccatgcgtccgaaagcttgtcatagataattgcatattcagtcggctatcaaagcagctggggttgcttgttaacctcaggcatcttgaaataggggttcgcaacattaagcaggacgatctctgcgttcttggaagcatacccactctgctcttcgtcaggttatttgtaaaaaatgaacctgatgaaaggcttgccatcggcagccatcaattccgatgcctcaagcagttcatcttcaaaaaccacggaggtgggctggagatgttgtttatgcaggaagcaatgcctgagctccgatggttgtctcttgaattcagagcgcgactaacagactgcaagatgggttttgagttcgacttcaagcaccttgcaagcctggagcacctcgaagtctcaatcaattgccatttcgccacctggagtggggtggaggctgcagaagctgcggtcaggaatgcagccagtgcccacccaggatgtcccacagtagaaatcaatagagtctgggaaagttacatggtagataatgagcaaggaggaggcgtgacatatgatcaataactgaaattgcagtttgcaacaacaccttatgtgagattccacttctactgctgcttataatttgcctgagactgaggctaaactgctagccacatgatcactattgatgcatggtaactaagtaatcagagcttccaactcagaatcatcatcatttggttttgtctaattactactggtatgtcaatactggagtagatcttccagattttgatttgtaaacacattgagctttaagatttcaaatgtgggtagcctgactgtcaatgagcacatcttgcttgagttgcactttactcaacgagtcgacgtacactgaaagtctgcaagacattattaatcacttctacaattactaaacttgtctaaatggatcaagacaagaaaatatgcactaatgatttattgctgcaacaattgtaaccgacaaaaaagaaaagatatatcttagagcttacaatggaacactggagcagttggtaacactttatatgacaatatcgattatcagggcagaatgaatatcttgcctgcaaatggagcgtcatgggtgttatcacagtattcagttgtgatgattgttgctcaatgttctttgtttcttatgtatggtacaagtcaaggtaaactagaccaaggtttaatttagtgctttctacttttaattggtgcgccacctgttgcatgttcctattgttgtcattcaacaaagacaaaaatgataaaaatgataattatctccgtaggttcgtttgggtcctagggggctgtcgaagtcaatcttactgaaagctgttcaacgtgtgacaaagagtgtaaaattatgatctttaaaaattttcctccctccgttcctgtatacatcatatttaaaatttaaccacttctattttaaaaacaaatttggagctatttaaaaatataacatattatccaagtatgttcgtgttaatataactgtacaattttggtttaacgaactacaataatttaaaattaattgttggtaaaagttcaaacctaactggttaatagttaatggtgacaagtaatgagagccttccgctgtgttcagaaaaaggttaacattatttttcagaacttctaaaggaaaaacatgatgttacgtggaaaataggtgacaatgccatgtgtgactatgaggtaaagcaaagggaggtgaatagagaactaataaatgattgaattggatggataagtagtttcttgatccaacggttgctatctttataccaatgtgatctgatggtttaaaattgttgatgatatggattcttgcatatctttctttatatgagtaaatgcgttttagtgggaatcaactatgtagtaagataggattcattagagaaatatttgtttgaaaatacattttctaaaaagaatttcttctgtggtaatacttttaaaacttatttgttaaaatattgaatttattcttaaatagataattcacggtaataatcctttcaataatatgaatcaaacggcccaaaactgaatagtccggattcttttgtgtcgttcaaccagaagaaaggttggtttgcgtttcttttttttagttattatatttggactttcttgctctagtcaatctaaaaagaaaataatctctactatttaaaaaatcgggattggtgatggtgaagccaacgtagaggtgtgatccaacctggaaaggtacatcgacacgaaaaaaaaaacggcggacgctcctccgcaacgcgagaaaaaaaaagaaaaaaccccgcacgcctccacaccattgccaccccccaatccatcacccaccgctgccgccgccgactcctccctcctctctcatcgcgccttcccctactcgtaccactgccgaaaccctagacccgcaccgccctcgaccgccacccctccaccgtcatcgcatcccgcctcctccccgagtccggcgacaactattcccaaggttggtgtactccccatcctcttggtcctaggtctctaaatctgcatattcacatgttagtctcatccgtatggtagtttttttttttttttggtttcattgccgtcattggatgaaatacttcacatcttgttgacatttatagtcaatctttcactgtaaaattgtgggtaagaaatggtgtgcctctgataattctttggtgtcaatttttctatgtgattgcttatatctaccaaactgacttaaccttttatttcaaaagatttaatctgtaggacaaaagttcagggtgtccaagcaaagctgacaggacaccatgcataatcgagatcaaattattatttgcatgtgtgacaaaatacttgctctttaattttctttccacccactatagcatacatcagtgatataattgaaatcaaatttttatgtgcatgtgtgtgatattatgggtaccccatacccatacggcatggttatccgactagtcataggggataacttatatctatggaatatgtaatagatcatgactcgggtattacgtttccttatatattacagaacagggtttgataatattgtaaagtagatttaggaaaccgataccgtattggttaaggtttctatcttgtaatcctgcccccgcaccctatataaggtgggcaggaggccctctagggggcatgacacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaattaacttcatgagtcgccgacttcgttttcgcttcgggagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaatttccgacgggacgtcagtcgtcaacttgatcgtttgacatgctgagtccatcatctgatgatgtcaaatctcctggcgatattcaattactaatctaaattggagtcgacatggaatctgagccaatcaataggagcaattttcacgcagggaagtgcagcactcatgcatgtattgcatgtctgtcacaagctaccgatatgatctcctgtccacccattaacacatatatacggaggacactgagaaaaaagctaagtgcctttatttttcctctttatgtgatattttccattgagcaatttttttatatccactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcctccgtcgccgccgattggtgcttccgcctacacggctggcctattatgccgccactgttgggcgtctatgacttcaccgccggcccgcctccgtcgccgccgagtggtgcctccgcctacacggctggcctattatgccgccgctgttaggcgtctacgacttcaccgccggcctgcctccgttgccgccgagtggtgcctccgcctacacggctggcctattatgccgccgctgttgggcgtctacgacttcaccgccggcctgcctccgttgccgccgagtggtgcctccgcctacacggctggcctattatgccgctgctgttgggcgtctacgacttcaccgccggcctgcctccgtcgccgccgagtggtgcctccgcctacacggctggcctattatgccgccgctgttgggcgtctacgacttcaccgccggcttgcctccgttgccgccgagtggtgcctccgcctacacggctggcctattatgccgccgcttttgggcgtctacgacttcaccgccggcctgcctccgtcgccgccgattggtgcttccgcttacacggctggcctattatgccgccgctgttgggcgtctacgacctcaccgccggcctgcctccgtcgccgccgagtggtgtcctcgccgatacggttggttggtcataccaccgttcatgggcgtccacgtcttcgccgaccggctggccttcgccgccgccgactggtgtttttgcctatacggttggcggacttcgccgctgttaatgggcttcatcatctacaccactggcttggttccactggcgccgactggtgtttttgtcaccattgatggactgcttcgttcccacatcggctacttttgctgtcaccgagggaatattacaaagctaagtcatcatttattttattctttatatgatattttgtcttttccttcgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccaatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcatcaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgctgccgactggtgtttccgcctgcacggctggcctttaatgccgccgttgttgggcgtctacgtcttcaccgaccggcttgccttcgccgccgccgactggtgtttccgcctgcacggctggcctttaatgccgccgttgttgggcgtctacgtcttcaccgactggcttgccttcgctgccgccgactggtgtttccgcctgcacggctggcctattatgccgccgttgttgggcgtctacgtcttcaccgaccggccgcctcgtcagccgccgactggtgtttccgcctgcacggctggcctattatgccgccgttgttgggcgtctacgtctttatcgaccggcttgccttcgctgccgccgactggtgtttccgcctgcacggctggcctattatgccgccgttgttgggcgtctacgtcttcaccgaccggccgcctcgtccaccgccgactggtgtttccgcctgcatagctggcctgttatgacgccgactgatgctatcttcttcacggttggctacgtcgccgtcaccgctaatatgcgtcatcatcttcaacgcaagctgtctacgtctgccgccgactggcgcttttatcgtcacaattgcgcgtcttcactaccagtttgctttttcacctcatcacggcaatgcaactttgtcatcatggatttctacttggacatcttcaacacttatcttcaatcaagcaatgactactcgatgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttacttcggagcagacaatctacttcaacaacatcaaatatttcggtttagacgagttggacaacagcatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccaatcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttgataaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatctatactacacccggcggattcaaatccccaaacaggagtagggtattacctctcattgagagggcctgacctgtctaaatcctttgtctctgcatccatccactttaggtctcgtacgctacccccttttattattgccgaattcatgtttcgacaatgtgtgacaaaaagaagttattatctgcacgcgtttctcaattttagatagcaggcctaatcttttatcgagctaggagaagccttgagtgccctggttaggaacaacctggagctatggttgatgaatcatgaataaagagttttcggttctgttgtagctgccagaatggaaaatgcctgaccatagctctgaagatgagtacatcttttgcaagtcttgatctgtgcacctcttcaactgatgaccagcatgaaaaaaatatgattatgattaggctttttgcaagtcttggatttgtgcactttttaattagggatggatggcaatatgccaatatgattgccgtagcttgaggctttgaggttgatgaagggtacagtgcttcttcctgacttttttttttttttcaaaatagctttctcagtgcctttttgtttgcttatgaatttatagcatctgtgtagagttaatgattttatatgtcataaaccagttctttcatgaccgaaataaaaatctaactctgaagctacaattttatcatcgttttttgtgaacctaaagagacaattacctacagatttgtatcaggaaaaacaatctcagtatccttaaaattagctaggtattcagtatgaaatttatatgtgaacaggatcatatgttcagattaatttcgtttaagtatacatactgatattaatttgatgatctactaataagttcgaatgccttagaagaaaataattatgccttttatttattcttctgacacagtccaagtctgtttggagaaggaaacatgctaggaaacaaagtgtggtcatggtccgccgcaagaaaagaggtgcatttcgtactatatatacttcttttctctattggatcatttagtgtgaaaatccaacattttttttggctctaagtgaacagatgtttttttgaagggctcgggtcatgaaaattgaactgtgattatccaatggttattgttattactgttgcaaccggacgccatttgatgttatgcttggacggatgaacacattcagatttattattacttggagacaagatgtcaaatatatgttctggtcatccatgggaactgtttgggagggttgtgtttgcacacgcttttgcttg

SEQ ID NO: 73441 - DNA, 5201 bp, Oryza sativa
ggttttttttttttggcccaaaaaagaattttgctggcggccgatttaacaatgccgccagtgataattcattttcgctggcggccatcttaagccaaccgccagcgaaaatgcatatttgctagcggctggcttaagacgaccgccggcgaaaatgaattatcgctggcggtcgataaccgctagcgaaaatattgatcttcactggcctttgctctgtgccggctctaaattccgtcagcaaaaacccaaaatggccgccacgaaagatggttttcgttgtggtgggaggaaggagacggggcgctccgcgtcggccgacgccacccgccgggaggcagacggaaacaatcatgtcataactttcgcagtaaatcaccattatacgataattcatttaccgacgaaaacgtcacttacaacgtagtagtaactcaattactgcattatgcgaatcacctcatccagaaacaacaacacatttaccacaaactcggtcaccataggtactaaacgagtaacccatttattagctatggcaaacaatttaactacccagtaaatcgattaccaaaagcctggctgtgacaaggtatccctattaacccacagaaattgatttacctccagcggagtatcttcaacaactaccccgaattcaaatatatctaatctatatagtaacgaacgagctgagggcaaccgaacacggattttgcggactctgggcgcaacgtgcggtgctcggaacaatattgcacgcgcaagcgctaccattaacataactcctttcagcccgatctaactcttttaccactcatccgatcaccaattcaccactaccccttctccgtacatcgatagaaaaattagtacaatttcatgtacaaataattggggtctgtcttgaaccccacgacttattgaacctagactaaaaatgatctttagtcacggttggtaacaccaaccgggactaaagatcaaaaagtacctctcaacttttaaatagggactaaagatgctttttagtcctggtttttattaaaaccgagattattgtgaaatttgaccgaccgaccaaagatggtttctccaccagtgtgtgcttttgacacatgtataaatgttctatatagatatttgcaaaaaaaaaatattgatatttcaaaattttaaagttcaaggaagttacaaagacttgaaaaatctgaatacatgaaaacctaatctaaaacaacattttatttgttagtggagagtaagtcatagtgcatttctgtttcgtaggtatgactgcaaccaaccgtccgaatgggattctgttgtataacatccccttttgaaatacatcaactccataccaagttcacataaaatactgatttttttaaaagaaaattcaaactttttaaattttatttttaaaggaagactatctcaaaagagacctaggatgtagaagatcataacatgagcgattcggcagattctcattttcaaactagaaccaggtttaggaataaaatttgggagagtatattaaaaactaaaagttactaaaaaggttttttaaaaaaatctaaaattccatcaaatttcagatgggccggattactcgtgggcccacatgtcagccacacgccacctcgcacgtgcgtcacgtgacgggctcctcggcccattacctcgcgtaccctcgcacccgtctcccgcagacagatccgcctcgattcttcgccgccgcgacgagctccctccatggcgccgccgcccgccgccgcgacctcctcgtcgtcctcctacaccgacacctcgggctcctcctcggactcgtcctcgtcctcggggagcgaccgacgccgacgccgcgcccgccaccgcagcggccaccggaaggatgccgcggcggcggcggcgtcctcgtcgtcggcgctgaaggcgcgcaaggaccggaggtcacgccacaagcggcgccggagggagcggcggcggtccccgtccgacgacgacagctacaggcgaggctctccccctcctcctcctcctcctcatccttcctttctaggtttcttgtgctagggttaggcccagatcgatctcgtgatctgtgaggtaggggatacggcgatgttggtggtggattacatccagatcaacggtttgacgggattcgatgggtggattagcatcggtgaatgaattttgctcgttagctcctctgatagttcatcttgacccatgattgacgctacatcaggagtggtattaaggggataacgaattagttgcacaaggacgtgaagaattttcggttgttttacaactaacaaaggatttatttgttcagtttggtttggtcgtgccttacttgagcaacgagagccctaaccgtgagaaaaattttaggatttcacttcaacttgatacttcatccgtttcataatgtaagactttctagcattgtccatattcatgtagatgctaatgaatctagacatatatgtgtgcctagattcattagcatatgtatgaatgtggacaatgctagaaagtcttacattatgaaatggagggagtagtaatgagcactgaatgctagctcgaatctacatggtttggagaatttctgtgatgtactttttcaatgtgtaacaatcgcaacagtagtaggacaaagcctcattccttcctagtttaatagtcagtgatcggttctatcagcagtaggacaaggatttcttagatatgatttgagctcactattgaagatgagtgttcgcatctccatttaaaattccttttcagtcagttaaatattctgtaagcctgagagggtggcaatccatggcatttaccggagctatgatgctttgttcttttgaattcaatttatctgtgattaggagctatcatggcatcaagtttaggcagctaaagcatagttcagaatctaggtaccagggaaattttgaaacaaaaaatgccatagtcttgcattacattgttacggcttgaatcattcaattggatgacattgatcggcatagcaacaagtttttccctagttttagccttcaagctgtcttggctttctctgctacactgaaaaaaatagagatattttgcttcttgcgaaacttgtattcctgtttgctttatgccaccactgttattttgaagtttctggtgctttttgtagtagctcaagctcttacgacagtgaacatgagggcaaatcatgcaagcacaagaagagcagatcatcaagaaggtactgccccatcaatgcattcatatttgatttctcatttagattttttctccatgcgtcgaatatgtggcctcattgtatttacttacctgacagtctagggagagggagcgaagcaaggataggcattctaaacgagacaagagcaaacataaagaggtaaaaatcctatttattcagaaaatacctttttcttggtttaacttttcagtgaattgaatctgtgttgcatgtaataatcactctctagaaatcagcaagtgttggttgcatacttgcgtttgattgctgttacagtgccatgctatatctattaatagaaatctacagggtcatgtcttatgaagtagatgtgtagacttaaaatatatgtggtttacatttaaatacaagaggtccttatatatcttgctgcctgtttctgggttggctctttgacattggagctgggattcgtgaacgggtgacaacatggtggattggcttgctggttggcttgttggttgattggttggttttgttctcttcaatgcgggagctctacacagaagaaagatagtgaacgtactagtggccctgtgcagctctccaaggtatattagatacttggctttacatttttcttttctatttgttttatttaacatatgaaacattctttattctgtaaatcagtttcttggacgtgacaaggatgaaggtgttcaaaggagtgcaatctctggtaaaaaggtgagaatagtctcttgacctcttcaatgtacaccttttgaattgtacaatagagggggggaggggggggtgcctgttgaaataaaaaatcttctgatcaaagtaaggttatgaaatatgaacaattttacagtatccaaactgttccatcggttgttaaattcaataaaacagaatgggctacctcgcatatgccccccctcataacaaattattttaggaaagcaaaagatttgatgcatttgcattgacagataatgatgaaacttgagaaatccaaggaagacaagcaggcagagagcaagcgcaatgaattgttgaagtttctgaatgcaagttatgattgacagtttgttggaagtgctgtcatttgctgccttttggatttgtcttgatactaccgcttagtccaccagtgctgttggttatatttacaagttttttgttccctgttattctagttatggcatgaccgtctgtgttcatgccagcacttagatagttgtcgcatcaccgttgtcactaaaaactattacatttgatcctgggctgataatgttttcaattttcatgttattactagcatatgcatttgagtgtttcccgatattttttactcaagtgtaaatttctccctttgctgtttctgtatggttaagctttttttcactagggattagctgctcgtttagctgtttactgataggaaagacttccaattggtcttctcacatgaaatcgcactcgtttagattcatgaaaattattagtcgttgaaattatggctgagtggtaaacacggtctatttgagttgttcaacgtatggctcgtatctctcgatgacctttttgcaacagggcaccttcaaatattgacaacttggcattgagggtgcggttgactacatcaaagtccagacttgtaggccttctggaatcataccaaacattgcaaagagcatataattccgcagaaaatttcagatcattttgaaaccttcgagtcgatcagttcaaccatatttttttaaaaaaaaaaatcgcaaagaaacgattatacgatcgcttgccattggtagtctggtagagaccctcatcacttgagtttgtgccgctgattatggctgacaatttcacttgcgtttcttcttgttcttttagggagggtgtttttttttttggggggggggggggg

SEQ ID NO: 73442 - DNA, 1119 bp, Oryza sativa
ttgataggttgtttgcttcttcccgggctcaaaattgaaaacgaggaagttcacaaccaaaacgcttgtatcctgacacaggacgatgaatcgaactgaattcgagacgaacacaccaagaaggcgagacggcagcaggacaagcagcagagcaaagaaaccaggcgagaagggagacagatactgaccaagaaccggagctcgccgtcgccgtcgccatcgccggcgagcaggacgaccacgaagctcacctcacctttttatttttttttactaaatcaccgggggtagagaatccctacctgaatatattattgagccaaatgatcttacacggggcaggcttcacctacgcaagcgcagaagctctagattatatgagaatagagtacacgtggaatacaaaagaggagagaccaaataaagaaaaacctcccaggagataactattgatgaccaagaagctcacctcaccttgatcctcctgccaaaagcccaaaggtttcggtgtgactgtggtggttgtagtgcggtgaggacggtggtggtggtggtgagatggagagagagaaggtgacgtgacgtggggtgcacgtacggtaacggtacggcaatgccaaagcttggatcactccggaaaagggattaaccgaggtggtggtggtgatgtgtacgaggaggaagaaggaggaggcgtcgcgtagaatggaatcgatagcaaaaatggagatcgagtattatcagagtggttggtggttaggcatgcacgtcaggatttcaagatagcgtcagagagtatcatctgtcgaatcatcaggcattcaaccattttaggctttgccgttcaccgcaccttggctgtatatccccacggtctctctcaactatacactatacgaggccggcagccaccgatggtccatcaattcttcacacactttattttcggatcagagatattgaactaatcagactgtaataccaattatagagtcataaatagtcttttcttaaaaaaaactaaacaatgaggtgagggctctcccacttatatattaggtctcttgcctttctacaactcaatatgggactatttcaacaagaaatactctatacatg

SEQ ID NO: 73443 - DNA, 659 bp, Oryza sativa
aaatctgagttgatttcctcatctccttcgcctagaaattcatcagcaaatgaacagggctgtgaaggagacaacattgggaagctaaaagtggaatgtgatgtgagcttgccacagcatgcagggccatcaaatgaagttgagaagtcatctctgagaagagtgaaaaaagtggtgtaggtttggttggaaaggagctgcaccgggaggatgttaatatgctgtcttaaacaacttgttgtcacagggtgacaagggcacaacatctgctggatcgtcccctctaccagaaatagattctaaagcgaagactgaaaatcgtgaagtagaggacaccgataaatgttcacatccaccttcacgtggtgatgatggtgtaaagtcaaatgccaaacaacctattggtttcaagattgatacaaactcaaatataaaatcatctactacgagtgaatataggtctgcatttactgtcgaggtaaagttgaagatggttgtacaaccagttctgatgtgggctccacattaggtgatcaatgtaagctggctgtttcaaatagaaaaatgctccctgccgaggaaccattatgtggtggtgacaaacaagctcatggtttgttaaagccaacagatcaaaagcatcttctgggtctaccata

SEQ ID NO: 73444 - DNA, 655 bp, Oryza sativa
catttgcaagctgcaccagcattttatcagccttcaatatgctatattactgggtctcttgctgagttgataacttcaacgtgttattgacatgcattacagcatttttcctcaaaatagaattttctgtgatagtgtgatggcttaatatgtcctgtttcaattccagaccatttgggtgatgttgtgtatgttgagcttccagaagttggttccacagtatcacaaggaacgaactttggtgcggttgaaagtgtgaaagcaaccagtgatatcaatgcaccagtatctggagagattattcaagtaaatgatgaactaagtgaaaaaccaggatttgtgagtcgcaattgctacccttgctagactaatttttgagtaatcactgctatgttcagttgacaatttgcttctgcaattttacacagataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgcctctcctacacattatattattctggat

SEQ ID NO: 73445 - DNA, 742 bp, Oryza sativa
attcctgcagcccctccgggtgattttttttcctttagtgggacccaccttaattacacacattgtggtggtttctaaaactatggactcccatgtgtgggtaccacatctatggactagtttgccaaatacattggtgttgccctaattgaaagaggaaaaaggtagtacaagggcatatataaatatatgatgtctaatcatcggtggatcgatcgatcgcccgtcgaattgatcatgcagctcgagagaattgcggacacgtttagactttggggacttgtaaaaattaaagcgcatgacagccgaaaagctagcaaacagctagcggccattgtcacactaaaaccatgtgaggttaattaatttattagttatatgcactcctcgcatctcatcttataagtcgtttgatttttctattagtaaaattattttaaattcgatcaaaattttatagaaaatatagtattattttaaaaaacatattattaaaatataataatattagatttaataaaactaattaaatattttaggtgattctaaatttttctataaatttagataaacttaataaagttaacgaagggagtatagtacaagcatgacaagctaactagctagttagggcacgtatagtctacagactgccctgatactggttaagttatctgattaacatatttatataacattctacctactttctttgtcttaattggatagattaacttatcta

SEQ ID NO: 73446 - DNA, 12675 bp, Oryza sativa
caagctctctcaaactaaatccaccacgcttgatgaattcaacttcctgaaaatacacataatgttaaggaattgcatttaatcttaacatgatgataaatgggcagtacatattgctttcaatatcttaataaaggatacataggaactgacagaatattgagatcccacaagtggttcaaatatcaagacacaaagatcatcttcattgtcatctccattgctcgttgtcttcttgtgagggttcaacgttatctgacgtgcagctacactggaacagacgcacttgattaaaacataataaatattaggaacttggcagacattggatctatgacgtggataaagatcattatgctatttgcagggagattgtatcagaaacactgatgataggaataactaggaaagtgggagcgggggctgcagggttaaggctttgaaattagaggaatccataaagacatggataaagaaacattactacttatagctacaactaagttacatctagacagatagaaatcatgggccagagatctaatttgtgcagcctagaagcagagaatgaacatacatacataacaaagatggccacaagaaaacgtacacaatacagatcaaagctgaaacagtactgtttgtggttgcgatgaataggacaagatcaccagataatggttatggtgaagtgaataacagccagtttcttttgctaacctgttccaagcacgcagtagcatctcagagccgccaccaccttgttctgcctcaagtccgatatgtgttacgagatcaacaataaggtctgataagctacaagttgatggtacattaaatttaacgaccacctatcagaaaaagaaacaagttgagtcagagaaaattaacaataattatcaaatgagcgactgaagattacacattgttgtagatgctttgccaatggcagagagataagctatgcaactgccagaactgtaatcagaataggcatgtcaaatccacaaccttcattgttgtgatctagaagcaaccacgcacaattacaattttttttaaaaaaaaaatcatacatcacattatccttgcactgatactcagacttaactaactcaaattttagtgtgtctacttcagtagtcacgacaatacatcccaaatccatatatcattaatcactgaatcaattgctccaatcacacaaagttccaaaccaactctaaagcctagtggcccaatttgatataaagtgtaaaattaactcagatttataaaaccgctgaaaaaaaaaagatattttccagcactaacaagcaacagtgatatggcctaaatgtttgggagaggaggacaaccttttggcccttcactgccacatcaaattgcgggtatgacccgtgtggcatccctcggctctgaatgagctctattatcctcttcctctccttatgggccagatcctcccccaccgccacatcagagctcacagccgcatcagggttcacaggtttcacagccgcatcagagcttacagccgagtctacaacgccctgtaacacaaaatcaaactcagcccgtgcaaaatctcacctccaaaatgccgccactaaaatttcaaacaggaaaaataaacaccacctcattggcatcggcgtaggccaccggcagagacgcgagagcggcggccgcgccggcggcgaggaagccggccgtagtgaacgccgaagcctcacgcgcccccggggcacctggtaccccattcaaaaaccctaaacgtgatcccagcgcgtgggaaggcgacgcggcggcgggacggttctggagaggcggcggtgaggaggtagtggaagccgccgcctcggcctgcagcggccggaggaggcgggccagcgggaggcggcggcggagaagcatggccatgccggcggcggaggcgtggctgggtttgcgatttcgaagctcgtgtcggctcgctcgagaggctaccggagagttcgcgccgcggcccgcggggttgttttggcgttgcgtttttgcccccccgcccacgaaagaacaaagcgtaacgcagaaatacgccttcatgtgattctccaatttgctcgctctcgctccgagttccaagcaggcccaaaatgggcttaaactatatgggccgaatcaacaggcccagaactataacgggccacaagcctgcagttcacgagcccttacaaaggcgcacacacatacactatctcaacgagcacctcagctagcgtatcttaaaattgacgaggtcaccaaagatattttagtggtacgtcgactacaactaaaagaataattaatcgtaaatgcgagcacatatgttaagtataagacttaaaatctaggtgaacagtattacagtacaccacaaaaaactcaactagttgagctatactcacttcgcaacctgatagtttattcaagagtttatttgcaggccatttggccttagtttgcaacttttacatgcctctaaaatgatgtgattcgtctattgtatctctatcactctcgttctaaaaagaatcaagagtgcaaatatttcttttcctcttatagctaactttagctgccggcatgcatcatcaatagtacgagtacgtgtatagtattgctacgatatatatcaagatgaattagcgtaatctgcatcaagaagaaacaagctgcttgaagttaatgggcgaggcgaagcccatctgcggcggcgcggagtagatggcggcggcgcccttcctggaggtggcctgcgtcccgtgcaccccgtcccagaacaggtacccgttgcggttgccgcagtaggtggagttgggcgccccgcacccgacctgcgcgttgagccggccgccgccgcagcacgcgctgttcaccaccttgaaccccgcggcggccgggttcgccgtgaggtaggacaccacgttgtacgagctgccgacggagtacctcatccccgggagagcaccggagccggcgagcctggccatcgccgacctgagcccggagttgaaccccctggcgaggtcgttggcggcgtcgacgcacctggtggcgcccgcctgcgaggtgacccgcaccgacggcacgcacccgatgggcggcacgtcgatgatgccgaaccgcctggcgcccaggctgtacagcgcctggacgtgccgcgtgtagttggacagcaggtcggcgtagaaggacggcacctggctcgccgtccggttgctctgcctcaggaacgcgaacaggtcgttgccgccgtcgctgatgaggaagagagacttggacagcagatcgtcgatcgccgacgccgacgccgacgagctgttgccatcgccgccgccgttcgacatcatctttgacttggtggccgcgaagtacacgatttgctttgtcagcgtgacgacggttgtcccctgatcgatcgacgagtacacgaagataatcagacacacatgtaccaagatcggtcgcattcattcaactatacactcactcaaatactatattaaccaattattgagtacaagaaaaggctaccagtagtaaattccttgcacagtttctacaagaagatgaaattttcttgctgtatccaagcatgtccttacagtggtatcgagaatgccggatcctccagaagcgtaattggcgccgcggtagcctcgcatgagctgacggctcgtctgcggcgtcagcgacaggtaagccggcgggctcctcttgaatcccaccagtttcgctgaaccaattgttcatccatgcacacacatcgtgagttccattattagcagaaattttacattgctccaaacaatttgaggcgaaatatgcacggaccgatgaagtcggcgacgttgtagccattgctgaaccttccggtgggcctcgagtgcgggaagtcgatgccgtaggggagctgcagcggcgagttccccggcaggtactggttgttcccgacgtccaccgtcgagtcgccgaacacgtacaccgccggcaccaggtgcacctcctccctctggccggcggccgccgccgccgccgagatatgcacgccggcgctgagaacaaatgctaccaccagtatcgtcactttcagcctcatcatagcgcctgcagaggtaggctgtagctatccaagcgagaacaagaatctactgtttatgtgtggattcagataggtgggattggttcctttgttcttcagcgagctgctacgtagcaactgggtaatattactaagaactttactgccaaaaggatgaattgcaactcaaggtagctagcagggtgcagggaatatgtgcttggaatggctgtggggcaaactgcaggtgaccacagtgaagaagaagagaggcacgctgctatcaatttatacacacacaaagtggtacacgtatcgtatccgttcataacaacggcaagcggccgctgcatgcgcttccgcttcccacgatttataaaacaacatctactttgaagaaactatggtaaaaattacgtattaaaattgatgtaccataaaaatatagatttagtatcaaatttgttatgaaactatagattcaacacaaattaaaacaacatactccctccgtttcacaatataagtcattttatcatttcctatattcatattaatgttaatgaatctatatatatatatatatatatatatatatatatatatatatatatatatatatatatatatatatatatatatatatatataaaatactagaatgacttacattgtgaaacggagagagtatttagtaaaaacaaattacggaactaaagatctagtgtaaatttaaccaggaaatataacattcaatataacagtggtgctaatgataaaattttagttatacgatatttggtcttaaatatataattatatgataacattttagttttgtgatacatggttttaaattttgtagttttataatagtttaaacaaagtaccatgattttttatactaggtggcgagaatataagatgaggccttgggactggagatttggtttcaagccccatcgcatagatttttcttcctcccattcgcatgcacaccatacccatatcgatcagtgagacatgtatgcatagcccggcctgtgcgaggctagcttgaccatcaagggatcgtcacttgttaattttttttcgtgatttattgtcaattagccacacttcccccacctgctagctcgctttgcaattgcaagtggttaactggtgacagcgacatatatcaaaaccatgaccatttgtctctgatcgaaagaggagtccttgatacttcctccgtattttaatatatgacgctgttaatttttttgacaaacgtttaacttttcgtcttattcaaaaaatttatgtaattataatttattttattgtgacttgatttatcatcaaatgttctttaagcatgacataagtatttttatatttgcataaaatttttgaataagacgagtggtcaaacgttggttaaaaagtcaacgatatcatatattaaaatatgaagggagtacttaataggaatttaatcggtgatcagttactagctactacagtactaccacatgagagcaagttcaatagtatagtcaactactagctccaattcatttatagccaatctaatagctcattcatacaatagttacatactactccctccgtttcataatgtaagtcattctagcatttcccacatctatatatctagattcactaatttccatataaatgtgagaaatgttagaatgacttatattatgaaacgaaggaagtacactattaatacctggtcccacctatcatacacacactgtctcttagagttcgtgctacagctggctataaatctgtagcccgctgcctttctctcttctaatttatgttcttaaaatatgtttacaactggcttatagtctgttattggacctgctctgaagaagaacaaacaagacaacctcgaaaaagcggaacatgagtactacattcggagttgatctttgcatggcatgcaagcaacagaggagctagtattggctacgtacatacgtacagtacttacctaacggcgtattgggctattgcctcctgaatgcgtgctaagcactccaaatacctgtacgtgtgtacatgtgtgaatatcataagatagtcgtatatatcctacagttccatgcatatggtcaatttttcgtgcaagtctggccgtcggagcaaacacagtcagaaatatatcgatcattgaattgtactctaaggcgcatctctcagagcatacgtaatttattctgtagcaatgcgtccacacgtgcttgcataacagcatatgtgtatcgatggtgactaaactataaagtgataaggcagtcgaattatatttgaccactactcataagtcataatcacaactcatggctaataactataacaagtattttaggaactactaagatagtactgtttgatggagtatccgcttggaacagatgatgatttcactagctaccgatgaagaatcacgcaacgagtgccatgagcgccaccggcccatgccatgcgcccatgcctcgatcgttgccgttactttctataaccaaccgatatgcaaatgcagtacagcaataatcgatcgatcgatcggaaaagggaaaaaggctagagcctttgggcaagtgcctaaatggactagtggtcatccatcgcacgatagataacatagaccaatctgttgcttgcgtgcttccgtattgtcgatagaataaggatcagatcaggatatatcacgattcacaatgtggtagaccggtagttggcgaggtgatcgagcgcccccacacgcaagaaggttttatggtcgtcaccggcgtgatggtgccatttggcggtgagcactaccggtcgcaacacacaatcacaaattcgcaatgccatggcgtgtacgtgtctcgttctcccataccgttgtccttccaggcccttgctgcacatgcacgcgcgcactgctgctctgctctctgccggcctcgcataaacggagagacacgcacctatgacgtcacgatgcgcggaacccttacgtgcgtgcggccttacgctgccttcatggaggattgggcgtttgggcatggtgcggtatgtagcgtgcggcggcggtggcggagctagaaaggctagaagcatcaagctagcatggcaagttcgttggggattgggggcttcgaccgcgcgcgcgctcgtgcgaaaggatggcaacttggcattttggcaagcgcggggctcgcgtgtgtcgggtgccgactgccgaggaagttgtgctcgcgcggcgcgcgggcgcgttggacgaggattcgaggaacggaggcgtagggcgagccggcgccgatccgtccgactgagtcgtcgtcatcgtcagcgttttcacaggtgggcctaaatgataaggccgacatggccatatggccgataaggccgtcgtgcctcgtgcgtgacaaccttgttgggcccgtttctcctcagtttggtcttcgaaagcccgcatcacttgggccaagtttgcactcggtcaggcgcaggagacgcccaacccactcgatcgtccggtgccccaccgccggcggcagcgacctccgtccaagtgccaccgccggcgccggtggcctcgcagatgcaaacgcacgggaacgggacagatcgccgttgtacaaagtacaaatggcgccgccgccattgcgagcgaagggaggaaaagggcggcccgcgagctacgtgcttacgttggctctgtcgattattccagactccaaacaattgtgttatctgactccccgaccactgcttccttcgtttagggcacccgcaatagttatctacaggttctttacaagagatccatatcagcatatttttctacttgaaaaaataggaaagagattaaataaagagagagagtaaaactatctactaacatggagatagtctataaagaaaaacgagtcaataaatgagagaactatagatatacatgtagacatactattgaggtggtttactattaatatagtatattgctgagatgtacatgttttatagagagcaccttactttatcattgcgggtgctcttaggctaacataaaccaatgttttcttctcgttcctacctgcgtcgacgtgtgacacccaaatcatcggattcagtaacggaaaccataaactttaccctaaaaaaccacgagttcacacatcccaagaggtaggcaaggcagcggccacacgaatcgcgcaaaagatggccacgctggtatgccttgcatgctctcacggttacgtgccgagattctcttctgccacgttgcaaaaagagacgcgacctgtcttccctcttcagagttcagtccccaacattttttatgggacagataccagcaggcagcagttgcagttcctcaccaaaacgccatccccatcctccctgccatcctccctgccgtgagtgccttcttgcgtcgagtttgagcaaagttgaatacagtatctgctgtgttttttaggacaagttgatactgtggaggagatgaagaggttacttgttcgtgggctgttttcttctccatccaggggtttgttgggcaaatctcctgtcaggcctgcactttgcaacgatgctcttctctccagggtgagttatcttgtcctcccgcttcctgatttactttttggatctcatgccttctccatcattgtattactgtcgccaaatactccataaaaaaatactgtgatttgttcataagagggcatatttctaagctactgctcaaagccgagaggccaaaatgttcagttaacaactcagatttacggttccagtctaattgatgagtactacaactcgatttgtagttgcagtcactacgcggttgaaaatttgcaatctaatttatgacgatgtcaatttttgtagtatcgactagtgtgtttataatgttccattttcttgtaatattgtcagttcctctcaacggggaaagatgagaacacagtgaccgaaatcggagagaaggcaagatcaacagcggaacaattcctcaaggtggccaaggagaagactgacgaggtaagcgagaaaacaaaggaaacgatgcacgaaacaaaggaagcagtggtcggggagtcagatgacgagaaggagaagttcaagcagagggttgaggaggggaggtaccatcagaattaagtggctagtgctcaattatactccatcttgtagcttcagacttcagtgatggcctctgtcaaaagtcctagaacctgcagattgtccagtactactaggcttggcatgtactaggtagtatatgttgtttgtttcctcctgttcaatgatctgttgtagaatgaataaggtcaactttgaacttcatagtgaacttttgatgccactacttgtcattttcgcagaataaataagatgaacctttgtgaagctagtgaatgctgaattggatgtgcagtttgcaagaatttaactggccatctagtaaccaaaagggtataggcaaaaagagaaaaggatcggatggggatgacctatggctgtgagcatcaaatggcgatggctcaagaatttggtctgaactttgttgaaacaacgtttcagaggagagctggcaacgtctgggacgctggatcttaaaatatttgtaatactaatatagatttgcaagtagtgcaataaaacaagttaggaactgcaatcagctcatcatgcaggaagtacatggaaaaaggaaaccccaatgcttacgctgggaaatgaagatgagtgaactccacatcagctagcacctagataatagccatatcagtgggaacagatgttgtcctgtttgcttgtcttttctgcaatatgaatttcactatcagttttttcagggaaatttaagtagttaaacacatcacatagacagatcgattagtagtacatggtttctcttttcataagatcagtacatgagttatggtggtgaaattttcagctggtatcgactggtaaggtaaccattgacactgaagaatgttcttcttttttttgtttttccagctccctttaggagttttcggtgagaaattagtgttgttgaggttaaacttatccagggatcaacttacctacctacctaccatatgtccttttcctgttagtttctccatcccaatagtgctattgccccattatgaactttgaaaagtaagcatatatatgttcgtctaattcgaaacattttagtgctgttgttgtacagtactgatttggtattcaaatcctaagtatatactatccatctaattcaaaactgtactaaagtgctgaactgctgatgttgtacagtactgatctggtattcaaagcagtactggaattctgatgcggtaccattcatagtttttccttgacaaaaatatgtcatgtcgatttcactcgttatctgctttctgtgttccaccggaaatccacatcaccggcgccgacccatcgacagtcgaccacaggtgaaggcgaccgaaggtcaggtactcagccactcaggtgggagcaggttaggccggatggtttagcctcaggcaaagattcagttttgaagtgtcctcgcaaatcatcaagctacatcttgcagaacagatgaaagtgaaaatgatcacgacgcatcctatcttttgggtgatactacggtgttgtaagttgtaaccgatcaacatcaaaatttatcatatcaaccgagagcgatgcgctaaaaaacaacgaatcaatcgatattgattcacatgtccatctacatgaaggtactccctccgttgcacaatataagttatttagcatttctcacatttatattgatgtaggtagacagtctagatttattaacatcaatataaatatgagaaatgctagaatgacttatattgtgaaacggagaaagttactgtacaaaatccagcaaataagctggcatgccccaactattattatacacacatgcataagcacaaccctacgaataaaactgcgtctacctaatcaaccaaccaaatcgttggtctgacagtaaaaacagcctagtacccagcgatccccgattcctcgtcagcctgctgcttcttgccgccgccggcgttcttcttctggcatttgtccttgatccactggaacccgtgcgccgtgccctccttcaccttcctcagccccgtcgccgccgccgccttggtcttctccacgccgccctgcttcttgccgccgccgtggccgtcccgccgcgccgccgcccgcgggctcgggtcgccgccatagtcccactggtcggcccacgacgtgccgaacgagctgctccgctccatccagaaactaaacgaagatcgatcgatcgatctaacgcggtatcgcctcgagtaatcgatcgatcagggaaagaaaactgtgttgctctcctctcctcgcgaaaaattgtgaggtcgcagtttttatagtataggtgtgcacccgcgcgcgtcccgtgtacaggtcatccgcgaagaattttcggtgcacgcgttgcgtttgtacgtgaggtggatggagagcagttgcgattctggatgtgtccggagattggcggttgggttctgtggtttctcgcgcggctgccggccgtatgacagttttgaccggaaagcttccagcaatggagagaccgactggtggggccagcagtatgcctggcccacatttctgtggcgtgcggatatctggcgttgcgttgaagagtctctggagtctagaatgcgttactactttgaggtgcgagaatcggtcgcacgacatttttttaggtggtcgtccgatttgatctgatcaatagaagggctgcctgtttgacaaatctggaacgaggaaaaactcaacaagtggaacgttttttgaatgtctgtgtttggaattgcttttgtgatttctttgtttaataaggtgcataccacttgaccaatctctaaaccactggataacgtcaacaaaagcaacatgtgaaagtttcatgtgtccagtcatgacggctgaaaattttaactggctcagggaagataaattgtatatctataaatatacatatgtttacattgcatgtaattataccaaatgggtacttatagaaaattattgtgttataagaataaatctaagccattcgggtgagaccgaattatgacggtttagatcaaacaatagtgcattgtagatgcaacatgataattattaattcttgaattttaaattcattagacaaagaatttttttaaagcgtagaaaaaactaaataatcttgaataaaaataactcgataattaattaaatcataaaaaagtgtaattgacaatctaggctaagtatacaatttattagttctaaatttcagagctattaatttaataaaaacaataaattgtgactcaaacgtgaatacgtttttaattcttaattcataatttactgtagcgcccgttccgtcgtggcgcctagcgggaaaatgtaatttctaaaaaaaccctaattgcgaaaattgtttcttcgcttgcgggctgcag

SEQ ID NO: 73447 - DNA, 2120 bp, Oryza sativa
tgtgtcatgtatgaatatgaccttttcgtgagctatcacgctacaacggtagaacatctaaattatgaagagctacctccattattgattttgaaaggactggacatatctagatttcaaaatgtctttaaatcattttctataaaacgttcagttaatagctacaaccaaaattgtctaaaaataccctaaaaatatgaaaatattggttatagtttttacacgccgaatatatttgtagtttggctaatgatcacacaaaatctccatttttttcttttaaatctttttcgcgaacgcgcaaaaggattgcatgtcaatatattagaagaaaagagttatagtcactcgacgcaatcagccagaccggcttatgcagagggaaggggaaaaaaagcaaaaaagaagctggagcttaaaaaactgcggcggctaaatacaaactccaagcagcgggaaggggccgagcctctttacactcccaacaagtccccaaaagtggcaacgccagctaaagaccacagatggctctctgagcatgtgtttggtttgggcacaaggtgggatgagttggatccatccctgttttttggaatggcatgatcccattttctgtttggttgaaaggatggaacgaatcctatttttttgtttggtttgaaggatatgatgggttggaatgatcctatgccttatttggatagagggatgaaggtgggatttctggagtgtacacattgtaaaataacatttagacatgaaaattacactatttgaaaattaaataccgttaatatcgctacatttttaatcagtatacatcaattcttgtatcaatccgttcatagaaaataacacatggccatcatctactgtcaagaaatttacctaaaaaaacaacacatttttgaactaattatactgctgttggttcaattgctactgactaattgacttcattcatacttactgataatactatgatagcgatcaagcgcttcggagatgagaattgacaaatatcagtctctctgatcaataccaattattggatagagaaatttacagaaggatagcagagtagcgaccggcaagagaagaggcatcattagctccctgctcgtgcgctcccaccgccgccttgcccctgcttgcgccgttggctcacccttgctcacgcgctcccgccaccgcttcatccctgctcgcgccgctggctcgcccctgctcccgtcgccgcctcgcacgctggccgccgattcgcccctgctcccgccgctaaccctagaacgcagtcgtgaggaggagctgaaaagagcgaagggaaaaaaaagggtgggccgtgagggttaccgcgcctcacacgcgtgcggaggtgggatgaatacgtccaccagtttttggcggatgagttggtcccgaatattgaaggaatattctcttttggaaccatcctatctcatctagtctctcaaccaaacacatgtaaaaatgggatgatcctatcccatcccgggatatcccttcaaccaaacacatgctgagtagatggactccaaaaccactaagatcgaagagagcgcagagtcgaaaaccctagagtttcgtttaaatcaaaatacgccctacataaaaactgaaaggtgagtgattataagttatttgatctgtcaagctacctctcgctaatcattttcagcgtgagaatggaattcgtcatgaagctcaaacccaaccatgcaagaatggaatatccaggcataagatcgcattgataccaaaagaataaacatgattccatcaggttattccttgagagttttagttcttggggccattaccctcacaaattaattcacagttcgatccaagccgatcgatttgctcccaaattttaaatggtttgtttaaatttgaagtcgtaacgtgtgacgtctctctcccaggatgtggggcccacctgtagggagagctttcatgcatatgctctgccatattctccctcgtcaagcagagattccagcttacaaagagcagagaagcagagatgtctcctcctatcatttggaatgaccataatgcccttacctgaaaacccaatattttttttaaagaacatc

SEQ ID NO: 73448 - DNA, 1938 bp, Oryza sativa
ccgtgctccgtagcgcccgctcgtcgccggcctcgctcgcgtagctccgcccaatccgacgctaggaacgaattcccggagtcgcgtagatgctctagctcgcccgaatcggtctcccgtcgcgccgtcgccgtttcccccttctctcgccgccggttgccgccgccgcaatctgccgccgtcgagcatcccccggcgaatccgagccgttggctcgtttcccctcgtcccgtgcaacctcccggtgtgctcgctttcgcctgtatcgccgtggttcgctccgccgctcgccgccgccgtccgccgtccgttccggccgacgtcgtcgtctacctcccgccggcccgcgtggcagccatgtaggcgccacgtcggcgccacctcggccgcgaccgggtcaagctgaccccggtccgccgcttccctctgccctccccgtgcgcgtggtccacggtgagccgtgaggctgcgcgtgggcccgccgtacccgcatcctccgcgagccacgcacatgcaccgcgccccgctccacaccctagcgccgcgccgcgtgctccctccgcacggtgagccgagccgctgacaagcgggtcccactcgggaccacgcgagatggacccggtccaccggctccctctctgccccccccccccgcgccctattgggccgtgtcctctcgggccggccggcccatttagctcggccgagccgccccttttctctcgggccgcgccctagccgcccgagggaagtttaattcccctccctctttcttttcttttttccaaaatggtttaattaaatcttttttcctttagaccaaaaatccaataatcttagaaattcaatatcttctcaaccgtacatctgtttgactccgttcaacttccaaaatttctcaaatctcgagatctaccaaatggcacgcttagaggtcaataatagggctttattttcgccgttgttgagtcgtctcattcgtgtgtagcttcggagcccgaagaccctgagtgcgcagatttcgaggatcaagctcaagatctcgagcaaggcaagtcacctttgatcatcttgcacctatagtttaaatctaagtatttcttttttgcaagtattgcatgaataggtttaacacaagtatttcggccgcggcttgtgagatagcatgtcggtcccaatcctaattgctgcaattaccctccttgaattattgaacacttaaaccccctttgtcgactgatgtgcttcgatgcacgggccttcgagcacgggcatcggaacacctcccctcgaatttaaaatatccaacgatgggtaaaacttgaggttttacaaaagacttggaaaacccgacacatggatcggtgcttgcgaactaaatgaatttctaaaatcgcggaccggggaacataccgggcgtacggtttcccgctcttgcacctaaggaccgtttccttggaatttcatccgaacataaggcaagtgcgaccacatgggtgtaatgggacgcccctggctgagtaattagctaatcaggggagccatgatgccaagagacatgtggattcaacggggtggtgtcggggagaacccccgggcttcctggcacagtatggtctgggacctaacctggtgttggtctgggacccctctcattggcatatggtaaacctgtgtcggctttcgaaatgccttgtcatgaaagcctcaaggtctccagacgtggccgttctgcacgggctgggtgatccgggttagtaatgtcgtgtgggtaaagtgtaccccctctgcagaggttattaaactgttcgaacagtcgtgcccacggtagtgggcggatgtgaggtgattcctagcgtagttttgtttgactactgctttgtgaaattgatgtcgtgaaatgggatcgaggtttggaaaatctgccgctgatgtgat

SEQ ID NO: 73449 - DNA, 3196 bp, Oryza sativa
cccacgctggcttgtggttggcatggttaatgtttcacaacagtagctcgcgaaccggtctttaattgtcatgagcgcgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagaaaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattgtgacttcatatgaatttattatgaattttacaagattaaatcggattaaaacacttatatggattttaattgaattatgacgcaataatgaattatttttgaaaaggaaaagggaattattgcgtcatcaaaggcggtccgggagcacgggacggtctaaggaaacgaacggccgagatcgattctatccaaaacgggcggccgagatcaacttgatctaccgcggttcacgggacaaggcgacgatgacgtcagcggtgacgtcatcaccggcgacggttcggcctcgcgcgctcgccggcgaatgacggcgcaacgacgcaaacagaggacaccaacgggtagaggacaacacagcgaactcaccggtgaccaaaaccacggcggaagagcaacggacggcgccggtgacgaggaagaagaggcgacggtcttcgggtcgacggtgacggcggtgctccggcggtcttctgcggcggcgaagaggtggacggggacggcgacgacctcgcgatcccgatggtggcgacggcgaccgacgacggtggctgcaacggcggcgcggcgcggctgaaccgacggcaacgacagcgacggctagggctacgcggaggcggcgctagacgggacggcgggctaaggcaaaggtggcggcggataaaggagagctcgggggtgcttataaaggggctagcgagcggcgacggaggcccacagcgaccggcggcgagaaggaaagctagggttggagggagaaaagtcgatccgaatcgagctcaaatccgtcgatttccaaacgaaattgaccgaagtttctataagagaaaaggaagaggagatcgaggagattatttcccctcaaacgatttcaccggaaacagaaaggatcgaccggattggaaagcggcggcggctagggtttcggccggcagcggcgcgaggaggaagacgggcccgacaggtggggcccacctgtcagcgggagagagagaggagagcggcggctcggttgcggactgggccgacttgggccggggagagagagagaaagagagaggttttgggccggctttcggcccaaagccaaaaggaggatttaaaaacattttctatttaaattattcatgaaatgatattccattgattaaaaatacttccttggctcaaataaatcccagaaaaatctaggaactatagaatcaagtaaagtatttaataaaattttatctaacccaattttatattgagatttagcaaattaaaattagatcttctcttttaagatcatttctaattattccttttaaacaacaatttataatttaaggatttttaaacaagaaaagctcttaacaattataattagatcattattgatcaaataattactgaactgttctttgtatcatttatgaattgagctctgaaaaatccgagaaaatttcagagagttgactttatcatggagaatttaataaaaattaaatccatccatgctttatatttaggaaattttatttcccacatttaacttcacttgtaaattgatgaacatttaatataaattctaataataatttattaaataatttataaatcctgaaacaaaaaatcaggatatgacaactacccactgtactcagcaagtcataccggaagaggaggtatgatgcaggatataaccaaaggaagctaggggttcttttgcataaagcagtcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacagtgaatctggttgatcgcccataaccgcgggcacggctattcgaatagttttactctggccagaggtgtacaactgtacccacaagacacgattccacacatgtcgccatgccccaaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaactgaacacctcggccgacccaactccattacgcccacccttgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcactcacagcccgccattcagaatattttaattaactgacacccttcgggtggcaccaatctaaagctatgccagtagtcagagtctatgaaataatgtgatcccccatttgtgtactagttgaactaagcagggctaagcatttcctaagccaacatctagtcattttgatacccaagttatcaatggcataagg

SEQ ID NO: 73450 - DNA, 8387 bp, Oryza sativa
tgggcgtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctggcgaggagatcggcgctgagcaattgggggatcagatttcatcaatacgtattcctgaacgagatgcttccacagttagctaactcaacatgaagatgaaattatgttttgaccttgggttgaagatttcagatacatacctgcggaggcggattgaatgcgttgtatggtacaactggcagttgatgtgaatagctgacgacaatagcgttcgagaatatcctgtacatcctctccttcaggatcttaaaatccagagaatctgggtcttcacagtttggatcatgcttgccgtcaaactcaaatgctgtgcgagatctttctttgattggagctaatcggcacttaatgaaatgccgagtgatttgctctccttgcaagccttgttctttgagttttaacatgcgttccatcaactccaaggcttggactgcttcatctccgattggaagagagttccaggtatcttggtacaccggaggaagacaagagtacccgggaagagcaggttcaggattctgaacatagaaccagtttgcatgccaccctttgtttgaagtcttgaagggcatagagaaatacttttggctcagagttcccctcagctggaatcctgcccccccgactacgcacggtttgctcttgtgcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttgaggtcggaagagcgaagccgccgtagaagaaatgcgagaagaccacaatctcatgtgtatcgggggtcggaaaagcctcaccgcacgctggccgccacccgatgatctccttggcagggagaacgccgtgcgccaccatctccttcaggttctcctccgttacgtcggacggcgcccattggccttcgaagttttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcgcagctctgtactgtagcaaggagtggggaaaatggcgagagttccggcggggaagacgaagcgtcgtttggatctcgggttttcttgttaagggtatcggaggtgagaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtaccttttttaggctacaaaagctgtctgggttaacttggaatgacttgtttttatcatagtcatttcctcggtatgttatatgcctgttttcattatggtaaatagtcatagcctaggctattagacttattcattaccatgatttttatgatatttggtgggtaatctttagagtcttatattcggatgcctgtcaagtgtgttcattcgtgaactttttagagtgttaaccactcggattccttttattgtgactaaaaagcagtcggctagaatgcctctttgggtgccgcgtatgcttttgtcatatgatgcatgattgtgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattgtctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgagacttagtcggtcacgactgtatttgatctgtatctgtgtattccgttaaggatatagattatcttttgtaacctggactccttcccatatataaggggggtccgggcgcctctaggggcatatgttgattttcccaaatcatacaatcaataatacactcggcggattcatccccggacaggagtagggtgttacttcttttataagaaggcctgaacctgtataaatcctttgtctccaaacccatacacttttccagcttgatagccacccccttttattattgccgaaatctagtttcgacagttaccgagttggcgctcggtcacttgggggagggggaaaaatcaggcgctccccccctcccgacgcgcacgtacccctgctagcgtgtacatctcagagctcgcctagccgctcagtttcttgaagagcctgacgaccttgtgcttgctagtggccccatcgaaggcaagcccagcgctggaccactcgaatgggaaccacaacatcatgatgttgtggaactgcgcgccgctgaggatcggtagcggtgattccacctccgccgctagcccaatgagagagatgactccgtgtaataatgccgcaacgatgcactgacatgtggggcctgtcgtatgccacgtcagcgaacctagggttaaatttggtctatactgctttaggaccttttttacacggtttgtaatagttgaggggtagggatttctggtattgggaattgggaacctcagacagactaagtgtaaagttcagggatgtcaagtgaacttacatgaaaagggatgacgaattgcattgccacgaagcggacgacacggtgcgtgcgattcatcatcctcgctgctccagtgctttgggagtcgcgctccatcctacaacatcggagtgctaatccgtgcgtgttacccgtgcatgcggtgaaagacgcgatacgaacgattcttcaatttttataatatactccctaataatatttacaacacaccaaattagtttcattaaatctataattgaatgtatttttataatatatttatattgggttaaaaattttattacatttttctacaaacttatcaaacttggagcagtttgacattgaccaaagtcaaaagtatataaacatgtaaagataaagattacccgtatatcgacatcgtatcgaaataagatggcataccaaattttggctagaaatatcttcaatttttctactagcagagattggattgccacgttggcgctaagtgtataccatgccatgtaggacccaaacgttccggattgagtccgggggtaattgtctagtatcaataatttgaggtttaaaatgtccggctttatggtttagggggtaattcatactttttccttaaacaaactatgataatatatgcaacctgtttatttaaaaagaacttactttttttaagtagtactagtcaaaatggcatctgaccgtatcaaacataaaaatgcatttttagacgtattaaaataccaattcacgaaaaacaaatacactactctctccggttgataatacttgtcgttttggacaaggacacggtcttcaaaaaataactttgaccattattttctattataatatgtataaaagtgttgacaaatatatgattttattaaagtactttttaagactactctatacatgtagtcatcatatttgaaagccatatattttaaaaatgattcataatcaaagattctaaaacgacaagtattatcagtccggagggagtactattatctccgtttcatattataagccgttttgatttttttagttaaacttatttagctttgactaagtttataaaaaaatatagtaatatttttaaacacaaaataaatatattatcattaaatattgattttagtgaaactaatttgatgttgtagatattgctaaatttttctataaatttaattaaatttaaagaaaagtttaactataaaaaagtgaaagtgacataatatgaaatatgagagagagagagagagtaggtacttttcgtgtatttttatttccacacgggatgttccgtgtgcgagttaattcaactcttcggaagaccaccctccctcccctcacaaatagacacacacatccacgactcccccgtgcgcacgggcccacctgtcaggagacaacacgtgggcccaccccacgccattgaacccttctattggatgcccggaaaatacgtgcgccccaccaactgactcacatctttccccctccccctcgccccccgcaacgcacgttcctttccgaccgatccaccgatcggaaaccacgccctaaccccagcaaaccccaacgcccccctccgccctgccaccctccgccgccgccgccttcgccggcgaccaccccgccgccctccccggggggacccatctcctccgccgtcccctcgccgcctgcaccccggcggtgcctcggcgtcctgctctgccgcctcctcgccggtgagcgccatcctcctccttcctcatccctctcgcgcgttgcgttaagcctcgtcttctctgggtagatctggaagcttttctcttagtttggcttagccttctctggtaataatggcgatttgtttgttttttcccccaaaaataaggggttccatgcccccacacccgcgttaggtgcgccgctcgattaaatgctgtaatttctgcatcctttcttggttggaatgggtgccctaggaagggtaaattttggtcatgccaaatttgatgattctacaccgagagatgcggaatgcgcatgtggattgcacctgtatggctgtatgcgattgaaatgagaggaattgtgcagctctcaaaatgctataggctagaaaaatcataccataccatgcatacatttgttttaagactacgtgattagcgtggaattgagggtggcggatgtacttgcttactctgggtgaaattggtgttgctcaatcgaaattccacatgttggcattatgatatgcatgctacattgttatttacaatgtaagatggagacatggtcgttattgatacatcgggtttgttttgagatcctgggcaccataaaagcttttgctagccaatccatttagcaccagatgacccatgctctttacttacaaaattactatcactgtgggagtcaccgggtaagcatgacctatggccatgggtttggggaagggaaaaaaattgttttgaaatatatttgatgatgggccttacctgtattttgtcaatctcaaactagaaactaacatcttattagcctgtagcattatcttaaagtaatcccctgtagaattctataaaatataacctagtgtgacgctagacatagggcctgttcactttgatgccactttcaaccttaccaaattttggtaaagttgccaaaaaagtggctacatttagtttgctgtcaaattttggtaactatataagaaatcctaccaaaattttggcatagttgccaaaattttggcaatgcccaaatttggtaaggttttttttggcatcaaagtgaacaggcccataatcaatatacgttttcttagaatgctcgtaaactatatgggagaaacagactggtttcaaggcctattagcacatgttatgcagtttctttcgtaaaactggccatatttataattcatttactgaacatattactacaatcattttctgtaataattgttttgtaactccattaaatcttctgtggcagtgtgcataatacatattcggaaaggcaaatatggctacaaaactccgtcaaccgtcaactgatgcagaaaaaacagaggttggagaaatagacacaagggctccttttgaatccgtcaaagctgcagtaagcttatttggggaagttcgattttcatctgacaaatcagctgcaaggaagccaaagcctcctcaggcagaggtaggtacttatattaaacatttttttcatattagattaataatagtacttcaatgtgtgcatgcatatatctttatgaaggttgaacataccgatttgtgtggaatgttatgcgtgcctactattacatggaatacttataagtacagcaatgttgcagaccttgatgttcttaagccttgttgattccagaactgctaacttcaaatcttacgcaacaaaatgctgtgaccttcaagtgtgttatactgatgccaatatgccataatgttgataaccattttcaaatgtctaagtagtttcatgtagcacttatttgaagctaagtaacacagatcttggaacgatgctgtgttcctcgtccagtgaactttgtcccgaaacaaggaacgggaacaacacaagatgacgtaccgaacgtggatggatcacatcctaacataaggaggtatgaggaaggcaaatctgagaggggttgggtttagggatggggaatgcaccagggtcacagccgcaacgggcgagcactgttattgctccctcgctgcttgctgccatcgcacctgagtgcatggaggaacgccaccgctgttgcgctgaggaggacgggggagtgctgctgctgttgtgccgaagggggttgggggagcgttgtcgccactgacctgagggaggacaggaagcaccgctgtagtcgtgctgcggggcttggggaagtgcggttgccgctgtcgcgccgaggggcatgggggagtgccatctccatcgtcgctatcacgctgagtggctgagaacgatgggatggattctttccatcgatgggataagactgtgagtggataagggattcatcttatttcatttttgctcttggactctgaatattatgaacagttctttattgaattgatttctttcatataagccataaaatttcatatatattcatttaagcttattgtatgcataacaatggaatgctcatatttataagcccttggcttctaatttctgatattgttccggactatcatcccggaaactaatggaacgcattccatactttgaacaaacgttttgaagaggtatttcccccttcataccatatttttcaaaatccctgttccgggatctttttatgacttaggtttgaagccacgcctttgttttttttaatgaaatttgtcatatcagcaaactatttcctgcatgttccagtgaataccacaagatacttgttttttatatgctctaactcttttcatttgcatttactttcctgttcattcctatttcttttttgcaagaaataggtgtgttcccactgttagaaatttcaggctgttccccagcctatttgctgtctttaattaaacagattattattaaattaatgcacattctccatttatgagtcttttcacagcagaaatttgatttgcatttctgaaagaatagtagttttgccttctacttttactttgattatttgtcttggtagttgttgtacctggtccacatctgatgaactacactttagaagagagcataattgagtgacttgttggcagaaacagagaaagaattagcgatgattcaccatatgatactactagaagtctaagtttttgtttgtattttttttttggggggggggggggtgtggggactgacatgcattcataccattaaaaaagttcagtcctgtaagctcaagttttgctggatttaattttcaccttcgttttcgactccaaatagtgccactcctggagattggttgtcccatgcttccttccatgtgcctatttgaatattgcatcatagttgccatggccataatcacataaacgcaatgcagaaacattagttccagcttaagacaggagtatcaaatttgttatatggtataagctttgaacgtaaacccagatacaaatctttcactcactgaaaagttaaaacatcaggtactgggttttttctggattggaattgtatcaagataggactaatttgatcaaagtatcaccccagtctcactcctacaagtagtgatgtcc

SEQ ID NO: 73451 - DNA, 1432 bp, Oryza sativa
acgtgaacggagtgtgttaagaaggtcattcttttcattttggattagaacaaagtcaaaacgcatgtggcaattagtatatacctaccaaggtaatcttacaccatataaaccatgcccaacctatagcggttataatccactattcaaaatgtaaggatcgatggacaatttgtcatatcattgttaattcaatctaaccttgtcacgaaaacaatacgctctgcgtaacatgaagttaaaattttcatatttgaaggccgggtcagggaaatatcaattattaagttaaaaacattaagcattcctgcctcaatgaaattcatatatgcttaatagtccacgttaaatcccagcatatcggtttcatttgttttcacctaaagtcacaaaatatagttgttggccctaaacttgccgttaatatgcagtatctacccaagctacaacactgctccctgtagcattcccacggtcggtggtatctggtactgaattgtagcagtatagtagtacaggagagaaaaataaagtcatacatcatcgtgtgtgacaagttgaaacatcggggcgatacaaatctgaatgaaaatgtcatgcaagtttaaacataatgcctctgtaaggataaatcctagtacattgttgaaattaattatcatcaccgtctactatggttgcatttacaactttacgatgtgtgcctacattcagttctaagctactatggctactcgacgtgaacggagtgtgttaagcaggtcaatcttttcatttcgatcagaacaaagtcaaaacgcatttggcaaatagtatataccctataacgtaatcctacaccatataaaacacgcccaacctatagcggttataaatccactattcaaaatgtaagtatcgatgggaccatttgccatatcattgttaattcaatcttaccttgtcaccggagcaagacgctccgcgtaacatgaagttaaaattttcatatttgaaggcctggtcgcggaaatatcaatttagaagttaaaaacattaagcattgctgcctcaataaaattcatatatgcgtaatagtccacgttaattcccatgcatatcggtttcatttgttttcacccaaagtcacaaaatatagctgctgctctatcctgagagtgagtaggtaggcattttgttctttactgttatcgttgatcaccgccgtgatacaatcggtcaatggtttgatgctagcaaggggctattttcatttatgttctgcctcctaaatgttctttcattcttacacctagtaccgtgagaaaaatctagctagttctataggcaaatcgttgtcaatacgtgctagctgaactgttatgagaaccaaggtttcttaagtcacgatttggttccctttcgtgattttttctttctaacgtgtttttta

SEQ ID NO: 73452 - DNA, 1086 bp, Oryza sativa
tccattagttaagacattccgtgacaaaaatcttattatagcctttaagaacgtcatcgattttatgaccactttggagaaaaatctgaaagattagcttgcatttattttgtcgaggagttaaaaaacacgttagaaagataaaatcacaaaagaaaatgaaatcgtgacttagaagacattgtttctcataacagttcagctaacacgtattggcaacaatttgcctatagaactagctagatttttctcacggtcctagatgtaagaatgaaatgtcatttaggaggcagaacataaatgaaaatagccccttgctagcatcaaaccatggaccgattgtatcacggcggtcatcaacgataccagtaaaaaacgaaatgcctacctattcactctcaggatagagcagcagctatattttgtgactttaggtgaaaacaaatgaaaccgatatgcatgggatttaatgtggactattaagcatatatgaattttatttaggcagcaatgcttaatgtttttaacttataaattgatatttccgcgacccagccttcaaatatgaaaatttaacttcatgttacgcggagcgtcttgtttcggtgacaaggtaagattgaattaacaatgatatggcaaatggtcccatcgatacttacattttgaatagtggatttataaccgctataggttgggcatgttttatatggtgtaggattacgttatagggtatatactatttgccaaatgcgttttgactctgttctgatcgaaatgaaaagattgacctgcttaacacactccgttcacgtcgtgtagccatagtagcttagaaccgaatgtagggacacattgtaaagttgtaaatacaaccatagtagacggtgatcataattaatttcaacaatgtactaggatttatccttacagaggtattatgtttaaatgagatatgtagtaagtgcctttacgacgacatgtctaatactacaatagtttagactttctgtgacaaaaatcttattatagcctttaagaacgtcatcgattttatgaccactttggagaaaaatctgaaagatt

SEQ ID NO: 73453 - DNA, 966 bp, Oryza sativa
gtcttttggcatttcaactcctcgacttccacgatatgaccaagagtccaacatatcatttgctagcttgaagctataaagcataccatatggaatatcgcttggaatgcctaatttttatctcccttgttggggttaaaacaactagtaccaccagttttttaattatctaatttaacctaaccaccaaaaaaaatcagagggttaaaatagcaccatctaccattacatgttaccaattgaaaatcattcttgagctaagcgagatatcttgttcaacaatccaatatatccagagaaatcattcacttctatgtaaaaaaaaccgtactactattactgaatcttatttataagatcaagtgactattaagtctcgagtgcaattatcgtgaaaagcttacttttaagtaagtcttcaattctattccataaatcaaattaaacttacataaaatacatttatagtcaagatatcacatatagccaaaaaccttaaatatatattggtggccaagcgacaccacccattttagtgatatgtatcatgcgagtatgtgacagacctcttacgtaactattgtcatatgttttgattgcacgatgtcgtcttttggcatttcaactcctcgactttcgcgatatgaccaaaagttcaagatatcatttgctagcttgaagctatatagcataccatatagaatatcgctttgaatgcctatttgtagtatcattattggggttaaaacaactagtacgatcagtattttcgttatctaatttaatcaaaacaaaaaaaatatgtttgagaaggtcaaaatagcaacatctaaatgtattattattattattattattattattattattattattattattattattattgttgttgttgttgttgttgttgttgttgttattattattgttattgttattgttattgttattgttgttgttatt

SEQ ID NO: 73454 - DNA, 716 bp, Oryza sativa
cccaatatatacgtatcatcattattgttctaattatatttttataaagttattaagaatataactatataaaagtaaataaatctaataattttatctatatattggatttttaataactttctgaatctattaatgatttaagagctcaaggtttgactctgtgtagtatacaccattagagcttacttggaaacgaaggaattcgacattggtaaatactacagcattgattgattgtttgcacggtcccaaggtgattcctttggctaaaaaggtcttaaagataggaggtgcaccatgtaccaccagcactaacgaaacaaaagtatgagctcttgtactacgcatcacaagcaaagcaacagtgaaaggtcaccttgacttacaacagtgaacgacgaaatcgaaaaaggtaagaaaccaaagctgtggaaagcatgaaggtgaaatggaagtgtgacgcaagatgggattccctgattgatgtcatgtatgcttatgtcacgttaatataatgatttaatttattccataaataaatcatgacattacagatgaaaactagcatgaacgcatcattagatctacatatgtaaactattcagtgtaacataaacagatcaaatatgcgcaacatattgaacacgtaccgatgtgacagaaagaccggctgcttggtccaaacttttcgcaggtgtctacgaaggcacgaa

SEQ ID NO: 73455 - DNA, 688 bp, Oryza sativa
ccgtgaatctgatggttagttttgaacttgttgaacaaattggtgaccttcttgaagctcgtggcaagttcatgccccttgccctttatcatgaaggtgtcgatggcatcttcgatgtcgtaagacagctccctgacatcgctggcccagatcttcgccagcttatcaagtttatctgcaggcgtctcagccaccttgtggagggctgcggtcatacttgtcagctctttctcaagttcttcgatctctcccttgacacccttttgtagcttgtattcgcctaccagcagctccccaagcttggggagtagggtgttcattgcccctgtggcaacgttcatattgacctatctatcttcaagtgagctcttgctcgaaaatctggggttgaatgcctgcacgggtcacacagctgcacttaatcgatcaggaatgaccaagcaacacaaaaacatgggagaaaacatctggataagagaaaaagaactccatccatatctagcatgtcaaatcgaaactagaatactagattgagcaggcaacaaagtaacaaccgagtggctatctcacctaatcggtcgaagcaagctttgctactaattgttatcaaggcccacgctatcaccaatttcaccatgagtagcgtaagcgctggctgcagcgacctctcaacgctgcagtcctactc

SEQ ID NO: 73456 - DNA, 683 bp, Oryza sativa
tcatcacatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattctttgcatataccaattgaaagtgtagagcatttcattgcagtctggtacaaggatcacttgctcagaacataactgtttcgatgcctcatgtttgcaaatgttggattttaatctgaagatgacaacattggtctaggagttgccaaacataaggatggcactgcagcaatgcagagacaccatcgtcagtacatcttgggtatgaaaattgacgattattgcgggtatctaacatggcttgtaagcatgctagacttggtaagggctccatggtgtatgatccgaggatattaacactgcacagatgatgatatgagagcaagtttagtccttgtagacaagaggcttgttgacccaacggatg

SEQ ID NO: 73457 - DNA, 694 bp, Oryza sativa
aattccagatcaatagaacttgcaatatcttgacgatgcatatgtgtaatagacatgaaatatttttcgcatgaatattaacacgcactgttttaagatatcaaacataaattatttaccttctcgatccaggatccaagaggtagaaggatatacagtgcatgctatatggtacatgccttcatgctgaagctgactagaagtgtcaatacaatgacaatttattcacacagatacgttcacaatttggtggtagatatatacatgaatgatactgttcagtccaggctggggccgccgctcatggactcagtgcttgtgcttcggcttttttactatcatcacggtgcagtgcgcatgatgagaacagtagtcactcacgcttccaagaacagctctgcagggaagttcaggcatgccagtaagaccaatgtaggtgaataacatgaagtagggaacggaaaaagatgattgggagtaaagttgatgcatcagccagtaatgttgcatgagttcataagattagcttttgttactgtcttccatgaaagaccaaacaaaattaagttgcaggcagcacgattggtcatttgtaggtcgatacaatgaaacaacaatgcattgtaatctgcctgttctaaaaaaaatctagtctagtccaggtcataataaatcgtgttaatccacttttgaa

SEQ ID NO: 73458 - DNA, 12823 bp, Oryza sativa
atctcaggagctccagttttcatgtggaagttgtcatcaatatcgtgaatttcttcaataaaaaaagtgacttcacaaacaatttcataggaaaaccatttgtggaaatagacctatttcataagcacattatctctttgaatttgtatttcgcaggcagcctcagccatcttcataaaagcgtctagaaatttaatcgtatgctcccataaaaaaatcattttcaaggatgaacttggacaagcatatgttcaaaagtttatccctagaagcatatataaaaactatatattttgtatgtataaatggtgtctatatctatatttatatatacactaaaataaaaaacgggaggttcactttttattagagtaaattgcataggcgctaaatttgtacacctatgttgtctacataccaaaactctcgaaatgcatatttatattcagaaatttatcccggacgtcatcatagatctcctctgaacttatcccagacttgtatgtcccaatgagggtcgggcccatatgtcagctgtggagattatggataccccatatctatatgacagttataatttagtcggatatacggtaccaaatatagatagaatatctttacgaggactcgggttagtttctaacttgtatgtcaaagaaatacccgagatcttagtcggttacgattgtattttacctgtaatcgcatattccgttagggatatggactgtattttgtaatatggatcccttcccctatataaggaggggtccgggttcctctcgggacgatttttttccctagatcatacaatcaataatctactcggcggaatcatccccggacaggagtagggtattacttcttgaataagaaggcctgaacctgtataaaattccttgtctccaaacctatccacttttctagcttgatagctaccccttttagtattgccgaaatcttgtttcgacagttggcgcaccaggtgtcacgcccggaatttctatccaaaattccaaacgcttacatgtgtgtgaaccctcgtccaggaatcagccgaggcacacaataacaaattgataatagagtacaattattactcaaactattaagcatataaaatatcattacagaggtagatagttcctctcaatcaataaagatctaagcagcggaaaaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaggataacaaaggatggcatagtggggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattatagcatcatttaccatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggctggcacggttaatgtttcacaaccgaaactcgtgaaccggtcttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaaaagtgagctaatgtttctaagcagggctaagcaattatatctaatatctagttgaaccaatatataaagctcaactagtcaagttataattacccaaggtatcaagaaataaagtaaacaagaacaaaaggggctataacaaagaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttatatcgatttaaattgaattatgacgcaataatgaattatttttgaaaaggaaaagaaggtttattgcgtcagcgggctagggtttcggtggaccgggcgcacgggcggcggttcacgcgaacggacggccgagatcgaaccaatccaagatggacggccgagatcgatcgggtccacggcggctcacggcggacgaccccgatgacgtcagcggtgacgtcaccgacagccgcggcggctcggcggagcggacggctcgggcggcgcacgctcgccggcgaacggcggcactccggcacaaacggaggacaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgcgacggcgaacacgacggcggccttcccgagcgacggcgacggctgaagcgacggcggcgcacggctggagcgacggcgacgacggcggcgctagggcacacggtgctagagcttttccggcgacgagaggcgaaggcgaaggtggcggcgggtagaggagaccacggggagccttttaaagggactcggaggtggcggcgaaggcccacggcgacggcaacggcgaaggaaagctcggcttggagagagagagagcccgatctgattcgaactcgaatcccttgatttccaaaccgatttagccgatgattccaaaggagaaaaggtagaggagatcccgaggatcatttcccctctattgattcggccggagaaggaaagggacggccgaatttggaaaggaacggcggcggcggctcggcggcggcgcgctagggtttcggcccgaggaagacgacgggcctgacaggtgggacccacctgtcagcgaccgaacgcacgcgcgcggcgcgggcggctgcggactaggccggactgggccgaggagagagagaaggcggattttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattattttctagaaattccatttaaacaacaatttatataatttgaatttttagggtgtgacaccaggtaggggcagcgtcaagtttttgccgacaaagtgcgatgggttccgtctccggcgtcgacgacctcgccttccctcctgggcaggcgttccggttcagcagcctcaacttcatcacgaacgaattcggcaagatctctctccttgactcggattcgaaccagtcggggagagatcaagtccccacgccgttcggtattctgaactcggccgagaactacttcaagatcatctctcccaagtcggctttaaaccactcggacgagatccaatctactcctcagcgaccagatcaagatgacgggtcctatccctcaatcctgatgagacttcctaatgatttggccgctgtcttcacagccaagacatctcccactcaaagatctaggcgagctccggcttcggccccgatccaatctagatccagagaggttggcgttatactccaacctcttgggacagtcttgacggaagagttggacggctaccttagctcccctggcgtaagttctcgaccaaccgaaatcctcgactacgacgacttcggctaccaccacgaccacgacgacttcgacgatagctataaggatagctacacgcctctctttttcggcgtattcatggctgacaacgaaacggaggaacagcaccgagctcgagaagtggaggaagagcgcgcacgacaagaaactgaacgtcgccgacaggaggaagaacgacaacgacaagagcgagaacgactacagcgtgagcaacaagatcgcgagcgagttgcaaaggaggctgaagatcgacggtagcgcgccttggaatccgggcgacgagcgagagagctcatcgggcaacaagacgtcgatggaacaacggtttttcgcaccccccagcagaacgcggttgcagcaatcactctcctcgacaccctccccaaggaagacgcactcaatcaagttgatcatgttgtcaacatcttgaaccagacgaagaccatgatcgctgcttcggttctagccaactccgcaagcactcgcacgccgactggtagccgggttccccatctccgatctcatgattatcatcagccaagcctcagcatcatcggtacaggatccgtcgcaggagcagggaccacgacgaatgatattttcactcgcctcccgaacgtcacggggaacgccgagtcgaacggcttcgctctccacctcgccaacgccccgtcgatctttgcgacacgatcaactagcgccatgcagcacgaggtcaccgtcattcaccagatcgctacgacgacgacgtggatggagtagctgccttcactaatgacctgcgtcgagtggattggccagccggcttcaagccgactggaatcgagaagtatgacggcaccactaatccggagtcttggctcactgtctacggactcacaatccgcgcagcaggaggagacagcaaggccatggcaaactatctacctgtggccctagcggattccgcccgatcctggctccatggactaccccgtggcacgatcggatcatgggcggaacttcgtgatcacttcatcgccaacttccaaggcacctttgaacgccccggcacacagtttgatctctacaacgtcattcagaagtctggagaatcccttcgagattacatccgacgcttctccgagcaacgcaacaagatctccgacatcaccgacgacgtcatcatcgccgcctttactaaaagcattcgccacgaggacctagtcggcaagttcggacgcaaacctcccaagacggttaagcagatgtttgaaaaagccaacgagtatgccaaagccgaagatgctattaccgcgtccaaacagtcgggcaccacttggaaaccgaagaaagacacgccggctgcaggagggagtggaagtaacaaccacaaggatcgcaagcgtaagcccggagaacttgtggcaacagcctctccatcttcccgacaacgttcccgcgtcaacaccttcgacaagataataaactcccaatgtccgcatcatcccaactccaaccatgcggccaaagattgcttcgtctacaagcaatttgcggaacaatatgccaagaacgcgcgtaagccttcagacagagatcaaggcacatcaaagaagaaagatgacgaagacgatgccccgactggttttcaggactctcgcaaagaactcaatcacatcttcggcggacccctggcttatgaatctaagagaaagcagaagctaacagaacgggagatcaatgcggtttagcctaacacaccccaataccttcggtggtcagagatagcaatcaagttcgactgctcggatcatcccgaccgagtggtccacccggggcggtaccccctggtactagacccagtggttcgcaatgtcaagctccgaagaactctcatcgatggtggtagcgcactcaacatccttttcgctaagaccctggacgatatgcagattcctcacatggaattaaagccgagtaatgcacccttccacggtgttatcccaggattgtcagctacaccactcggccagatcactcttccggttacctttggcacttgggagaattttcgcaccgaaaatgtttgtttcgaagtcgcttatttcgagacagcgtaccatgctatactcggatgaccggctctagccaaattcatggccgtcccacactacacctacatgatgattgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaatagcggaagactagggcgacgaccacaggcgcttgacgacaggcacgagctagacaccaaagccttcatcttccaggggctcctcttctgggtttgggcaaaattgagcaagactgagtacaaccaccgtactcaacaagacacacccacaagtgcagaataaatgcaagggagtacaagggggttaaaatataaagggttagggtttgcagtaaacagcattaaaagacagttagttgctcaaagctattttgtaaacacgatcctagagctatacaatattattaatcaaggccgtgaacccacacgaacctgccttaacccaaggcctacgatgattcagaccgaactggcaacccgaccctaggtcccagctcgtcccaagccaacccaggccaaccattctacattttggttgttaagcaggttttaagaattaaaaatactaacttgggtacattgctcggcttgcccataaccgagggcgcggctattcgaatagattatactctgatcagaggtgtacatctttacccacaagacacatcttcctcatatgtaaccacatgccacataccaccacggtatacggacggaagacgtgacatagtttccaacccatcctagccatagataagagtaccgacccaaccccacctacggccggaacctccgggacaggtaggcaggactgagcccctagcagcaggacaccggccctgtgccatgacatctcgactactgagccgcagctcgtgtagccttcatttgttctagagatgtccatcgacccccgacttcgtccatctccatccgtgtacttttgtttataaccagactgagccacaaactaagccttacccactagacatgtggaagtacggtagtgctttgcaacagaggcctgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaactagcgaagcatctacctaaaatcatactagtggtaccatgagtagataacaataataatatcaataacaataataataaggtcataacaaaggtaaataggtatggctaaataaaacagtgataacgcgggaatttaagtaaagcgataatgcaatattttaaatcaaaataattttataaactgggattcaatatgctcaaggatgatgtgacttgccttgctcgctttcccaaacgtcggcttcaacctccacgaagagcggatcttccgaagctgcagcgtctacacgaccaacggaaaagaaatggcttttactctaataaactccatataaccagcaggaacaaagcacaaaaatgggttattgacttcataaggaaaaattagagacttgaacggtccaattccgagttcaaatggccaagttatggccatttgaagtttatatgctctttaaatgaatatttgcgaatttcttcatttaaattttaatttaaaaagggtttattgcgtcagcccagggggaggggcgcgcggactgggtccacgggagtggggcccacgcggcagcctcacggtccacggtggaccgggcgcacccggctcgcaccggccggcgccgtgggccccacacgtcagccgcacacgagggcgcgggcggctgacggctgggccccacgcggcagccactcggcgcgcacgagggcggccacgccggcgcggtcggcgggaggtggcacgcccgcgccccgatggtcgccgccggcgaccaccggcgcggcggagcggcggccgagagaggggagggaagggggaaaggaggcgacggtccacggctcaccccggggcgacggcggcgacggagggggcagtcggagtggagggaggcggcggcgcggctcgggtcgacggggtcgacggcgttccggcggtcggcgaccgaaacggagagctggacgaggtcggcgaggatgcggcgaagccgaaggaggcggcgccgaggtgggaggcggtccggggcgacgacggcggcggaccggagctcggcggcgacggcggagagacaaagcgatgtcgcgggctcgaatccggcgaggaggaagggcggcgagaggcggaaacggacggaggaggtgcggggagggtttaaattgggttggaagggggagagagcggccggaggggaaggaacccggtgcgggaggtccggccgccatcaatggcgctggcgagatttgaacgcgagagagagagggaaaaatatggggaaagggagaggggatcacggggagtaattccccccactttattgcacgtggggacggcgggaggcggcgggattcgcggctgcggcggcactagggcgcgggggaggcggcgggagcggcgggaggaaggggatgacgggtgggccccacccgtcagcgagggtggcgggcgggcccgcccgtcagcggcgcgctcgcggggagagggcggatgggccgcggggagaggagagagagagagagagcgggggggagagatgggccgggccggcccaagggagggaagggggactttttagggtttttctttttataaaacctttttaactttgtttatttcttaacaattattatttgtgctctgaaaattccactaaaatttagttacgtattttaggcttctaggaaatatacaaaaatcctctaagcattatttgacttttaactttgcacattttatttgttggagactttcacatggattttaattattctaggcataatttagaggatatattttagggtcgttttaggacgtgacaatgatgaagatgcctgctcctcgaggagtcatatcactatggagcgacatcaagcaagccgtcacatgtgacaaagaaagttgcgagatggcccaaacccgcgagatcacccttgctcgtgaagagatccgactgactacgactatggcaagtgaaggagaagtgcctgcgaccaagctgtcaaagaccaaagaaggcaacgacaaaactaagaagattccactagatccctccgatcctaccaaaactgttgtaataggagctgagttagattgtaaataggaaagcgcgctcattacctttcttcagaataataaagatatttttgcgtggaaatcatccgatatgcctggtattcctagagaggtgattgagcactccttatatgtcaaggaagatgccaaacctatcaaacaacgactccgccattttgcacaagataggaaagatgcgatcaaagaggaattaaccaagctgttagcagcaggcttcatcaaagaggtcctccatcccgactggctggctaatccagtcctagttcggaagaagatcgggcagtggcgcatgtgtgtcgattacaccaacctcaacaagtcttgccctaaagatcctttcgggttacctcgcattgaccaggtggttgactcaacggccggctgtgagttactcagtttcttggactgctactcggggtatcatcagatctgactgaaagaatccgactgcttgaaaacctcgtttattacgccctttggggcctactgctacatcaccatgccctttggattgaagaacgcaggagcaacctatcaacgcatgattcaaatatatttttcaactcagatcggccgcaatgttgaagcttacgttgatgatgtagttgtcaagaccaagcagaaggatgacttgattgcagatttagaagaaacttttgcaagcatccatgttttcaggatgaaactaaaccctgaaaagtgcatcttcggagtaacgtcagggaagttgctcggatttatggtatctcaaagaggcatacaggccaacccggagaaaatcaacgccatcctcaacatgaaaccgccgagctcccagaaagatgtccaaaatctgactggttgcatggcggcgctcagccggttcgtctcacgactcggcgagcgggggatgccctttttcaagctgctgaagaaaaccgacaatttctagtggggacccgaagcacaaaaagccttagaagacttcaagaaacttctcactactccacaagttttggcctcgccacatccacaagagccgctactgttatatgtgtcggcgacctcccaggttgtgagcacggtcctagttgtcgagcgtgaagaggaaggccatattcaacaagttcaacgaccaatttatttcgttagcgaggttttggcctactccaagacaagatatcctcaggttcaaaagttattgtatggtgtcttaattaccgtcaggaaattatctcactactttcaaagtcactcggtcatggtggtcacatcgtttccactcggggatatacttcataaccacgaagcaaacggacggattgcgaagtgggccttagaattgatgtctttggacatatctttcaagccacgaacttcgatcaagtcacaagctttagctgattttctcgccgagtggaccgagtgccaagaagacatgccagaggaaaagatggaatattggactatgcattttgatgggtcgaagaggcttacaggcactggagctggggttgttctaatttccccgaccggagaaagattgagctacgtattgtggatacatttttctgcgtcccataacatggcggaatatgaggcgctgctccatcgattaaggattgcaatctctctaggcattcgccgactaatcatccgtggagattctcagttggttattaatcaagtcatgaaagagtggtcttgtctaaatgataatatgaccgcttatcgacaagaggtacgtaagttggaagataaattcgatggacttgagctcacccatgtcctcggacataataatgaagcagcaaacagactgtccaattttggttcaaaacgggaagcagccccttcagatgtgttcgtcgaacatctttacgaaccgaccgtgcccagaaaagaaacaattgaagccatggatactcaaggcgtaagcatgattgaagccgactggagagaacctctcataagatttttgactaaacaagaactccctcaagacaaaaatgaagccgagcagatttccaggcgcagcagactctacgtcatgcacgagaccgagttgtacaagaaatgtccttcaggaattttgcagcgctgtgtatctttggaagagggaagacaattgctgaaagatattcattcaggcatctgtggtaatcatgctgctgcatgaaccattgttggcaaagcctatcggcagggtttcttctggcccacagctgtttccgacgccgacaaaattgtgcgaacatgtgagggttgtcaattctttgcccgacaagctcatttaccagctcaggagttgcaaaccatcctgctgtcttagctgttcgcagtttgggggcttgatatggtcggtccatttaaaaagcagtcggtggttacactcatctctttgaaatattgaacaccttcgtcaattttgtgcttaggcatttcgtttgtatctttcctctttgactgctaacttcaagtttttccttgaagttttcagtcggggggctactataataataatggaacatgatttttatcaattcaatttgcttacttgatttatcattgccatgcttgattttttggcttacacaatgaggactgaaagttttttaagaacttttgcgagttttagactcaataaggtttgacaaaagcttttaagaaatcagaggctaactttgaaatatctagcacagcataaattcatcagtattgtacaaattgatcttccatcatcatcagagggctgcagga

SEQ ID NO: 73459 - DNA, 5186 bp, Oryza sativa
cactccccacatcggcggccaaataggggccattcccggccgtttccgcccctccttcgaccataaaaacctgcccccgagtcccctctctcgtttcacccatttgccgtcccctcccgtgccttctaccgagcccgggccgctcgccgctagcgccgccgcttgccgctgtctccggccgcacgctgtcgtagctagagccgtcgcctcgccgctcaatcacctccgccagcttcgccgacgcgagagctacctcggacgccgcttctttgccgcgaatcaccaccggagctccgatttccccgcgtcgccggtgtgctcgccattggttccatttccggccggccattttggtcgcgcggtcggcctctccatccctaactcctctcctcaccttctttaggtgttgccaccgcccatccgccgcccgtgtcgccggtcgtcggcgccgcctttgtttccccgcgccggccgccaccgcctcctcggtgaggaccggtctccctcccttcctctctctctctttgtcgcgacgcccgccgtttagcgccgccgctgtccgccgctcgccgtcgtgcgccgccgctcgccgccggtggccgcgccgagccgccgcgcgccatggccgggccggacatgccgtgcccgagcgccatgcccgggctggcctcggtgccggccgtccccagccgcctgatcggccctcggccgatcgtggccgtccatcccgtggcccgcgtggccagccacgtggtgccacgtggtacaccaccaccccggccccgtggacccggtccacggcagaccacccctttgagccgctgacccgtgggccccgcctgtcggcgccgccccctggatgacgtcagccctgggacttattgcgcaataaatacattaaggcttttcttttatagtaataaacacagtttatcttctaaaattcataagtaattcatccgagctccgtttaagtccattcaagtctcagtaaatcaagaaaaatgcaaagaatccattaaaaatacttttgtttcctgtttcagtagtcttatagcatgttttgcttgtgtgctttgtttgtcgcgtagatttcggccgtttcgtcgatccgcggtttctcgaagacgttgctgaggtctcatcagtgcaagagcaaggcaagtcatgcaatacgtttgatcatattgtacccaatttacaaatatcccgcatttctattaaatgttgcatccttttacaatgtaatgtgggatgggtcctattactcagccatttattgtttaccatatgccattgataacttgggtatttaaaatgactagatgttggcttaggaaatgcttagccatgcttagttcaactagtacacaaatggggatcactttattacatagactctgtctattggcataactttagattggtgccaccgcaatggtgttagttaattaaaatacactgtatggtgggctgtgggtgcatggttttgctggtcgcacccatggcagttaaagaccggttcacgggaaaccctgggagacctaccgtgcttaccacaagcgggagtgggtaactgcttgatctgaagtatagctcgaccctttcctaggcaccggtggcgagggtgggcgtgatggagttgggtcagccggggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatactttggagcatggcgacatgtgtgggatcgtgtcttgtgggtacagttgtacacctctggccagagtaaaactattcgaatagccgtgcccgcggttatgggcgatcaaccagattcaccgtgattagtctcacccctagtctagcttaatgaactggtgtagttcaggtggttggttgggcctgttgcaacgtggtgtagcgttggacagtgattggttaatattgattaattactacagctattttactgctttcaactactgctttgaaatgtctgctttatgcaaaagaacccctagcttcctttggttatatcctgcatcatacctcctcttccggtatgacttgctgagtacagtgggtagtactcagtcttgctctcttttcccccacaccagagttgaagtttttctcagttggagatgtcttgaagaggtgggtttcgtcgctgccgtcaagggttgcctatggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggacaggggtttaatacacattcagcttagaaattctggttcgtgaatttctgggcgtgacaaacgtgaatgaacgaacgtgaacgaacgaacgaacgtaaacgagaacgtgaacgtgaacgaacaaacaaacgtgaacgagaatgtgaacgtgaacgaacgaacgaacgtgaacgagaacgtgaacgaacgtgaacgagaacgtgaacgaacgaacgaacgtgaacgaacatgaacatgaacgaacgtgaacttaacgttgtatttgaacgtacataaacgaacgaacgtgcgtgaacgaaaagtgaacttaacaagaacgcgaacattatttaacatacgttaacgtgaacgcacgtgaacgaacgaacgtaggtgaatgaaacgtgaacttaacgagaacgcgaacgtgaacgatcatgaacgaaacatgaacttaacgagaacgcgaacgtgaaatacaatatatgttactttgcgtttatcctaatacatctttttgtatgttgcagaaaagacgttgtcgtcgtcgtccctcaagtcggagtggtagctagccctcgaaggaattcgcgcaggcaagtgatgtaaatatatgattgttagatttttaatgcaattaagactattagatttaatatacgacacttagacttagcatagttgataattacagttttaatacaatattatttgagttttagtataagattattatagttttaatataagattattagatttgtaattagacttagcatatacgacagttagacttagcatatatgacttagcatatatgattgttagcatataagattgttaaagcaaaaatgacctatagacttagcaactatttcttgtatgaacagatggctgatcgcgatgaggaacagatattgtacgatacaatcgcggagggaagcagccagtactggaacgaagaagaggggaacgaggatccaaaccagtacttgaacgaggaagggaacgtggagagggatgcggaggggaaccaggaggggcacgtggagagggatgtggaggggaacctggaggaggaggctagtggaagtcaaccctccgcaggacagaagagggcacgcgggcaacgaggtgccgtgaagaagcttgagggtcggcacatcataacggaagtggacgaagacggccgacctagtgccccggcggaagcagccaagaactacgtacgacacagcggttgggttgtgcgggataacatgcctgttagtacggtgtactagcgcagaacaagggcactcggagatcatgagaactttgtcccagattcggagaaagagatgctgtggacaataatgctcgagacattcacccttcccacgggtacataggacaaagtgaaaaggtggactctaaagaaaatggcagaacagtttcaaagcttcaagggagatctgtaccaaaaatatatcctgaagggacagacaccgaacttcgacacattcccaaagctaagggatcactgggacgagttcgttgcatataagacaagtcaacaagggcaggcgatgttggaaagaaacaaagaaaatgccgctaagaagaagtaccatcaccacttggggtcaggcggctatagcgtcgcgatgccgaagtgggaggagatggaggcaagcttgcttgagaggggtatcaaaccggccactgctaaatggccagatcgatcgaagttctggtactatgctcacggtggaacgctcaacccagttgatggctccctggtcttcagcgatcagatacgcgaggctgcgcgtcgactaacggacgcagtggaagcctcttctcagggcacgttccgacctgacagcgagaaggacgagctgtcactcgccctgcagactccagagcatccaggacgaacacgagggaaaggggtgattccttggaagattgggttcagggaggacatccacacgtacaggattcggatgaggagcaagagagataccgaggcgaagattgtagatcttgagtacagggtatcgagctacgagctcagcatgcaagaggaggtggcaaggaaggttgatgaacgcatggccgcacatcggtcccatgatccccagccgaccattcctcctgcaatggtgagcccttcaggaaatcgtagcagctgcgcctcaacggggcaggtaggatcacagagcatggacgccatgcaaacccaggacgaaaccacctgccccgttgatgacatcactcagcggataccatgtgagctgcatattcccttaaagaacttatcaataaaggtaagctcgtagtttatagattttagatttgtccattctgcaagttgctgcttatatatgttgattactaataaacaacctctcaccacgtgaaggtggcgtcgggcatggccatcccaatggacccttcaggtacttaccactgcaggccgattccagcaggatactccaaggtcgaagttcagttggtcgaaggcgcgtacgaggacctcgagttggattaccctagaggagacggtgagacgcatctacgagacacaagccacgccattatactatggcgcaagtggtacatcatccttcctgggcgacaagcggcgtctcgtgcaccatctcctccggcactgccatctcctcctcatgctcctacaccgtctcctcctcatgctccagcaccgtctccacctcaggctcctgcaccgactcctcctcaggctcctgcaccgactcctccgcaagct

SEQ ID NO: 73460 - DNA, 3431 bp, Oryza sativa
ttcgtggacctaaataaaacctcccgacaagtttaaggaccgctggtgtattttactctaaaaaaaagagagagaaaaacttcaacctagcttttgagttaacagtgtaagagtggcttatgaatattaagaaaagcaatggaaaaagacacatgtttgagactttttagcttataagtccaaaacgtacttaagtatgttagtacttattaatttaaattttcttaattaattaaggtaattaaaaaattgagatacataagtatggatcatggtgcttattaattgctaattttgaactttttaaattaatgaaatagaaaatatcagttcaagacattaataaaataaaactacagcaaccgaagacaattaggacaggacatgtattttttattttttttcaattaggagtaaaaaaatattattacttccttagacttacaaagaaaaatttatgttttactttcaacaaattttaacaaacatgtattttacatataactaatattttttaatattaataattgtagcacatgcaatgcacaggttgacgcttctaaggcatgtgatgctataaatactcccaggtcaccagtaacactctataataaattatagaaaattttaattagataatatatatttaaaaggtaatctgttcctcccaatctacggggtatacaatggaaaatttgtaaatgttcaccaaaaaagccaaaagtacacaagtaaactattgggaaaaaatatacagcttattactgttcaccaaaaaaaggaaaaaaacatattgatgataaaaagataaatcccaaaaaacttacgcatgtaagtactacaatgaaaaaatcaacgatctgaaaataggattttctataattttgagataaatatatattactccaaaacacacaattcaactagaggaccttgtccatctttttttaattcatctaattgccgtattccttcaattaaatgaattattaacgactaataataattatattgtaatgctaaatacatgacaacatatggaaccaacatataataattaatgatatgataatttttcaaataattgtataacatattttgtgatgtcaaatatcacctgacaaatatacaatactactttaaatctacttgtctaaaaaataaaacaatagaatttagttgtgtttttccaagtaaatttgatttaattttagtttgtgtgggattaagattctctacattttcaaaactatttggtatttccagctaatgatcctgctataatattaccccttaatctatcacgagtatattggtcaataggtatgttttttctataccaaatagttttggcaacaaattaactactcatgatatacttttcttagagttgaagatgttaggcataattgttgatgtatgtcatgtacctcactaatgtgattataagtgtacttgaacaaattagttattgcacatattttctaaagaaaataaatctaccttcttttcaaatgatgaagaagattataaataattgcttatagatattacttagatatgatataatataaagctaataggttaatgattataaaagcaagtaatgccaaaaaaacaatttctgaagaaatcgaggtatatattctccggttaatatttcgcttttagtgtctcaaatttagcatacgacgcatgctcgcgcattcgcgcgggctaccttcctagttattatatacttaaaagtccactgaacttcctacaaacgctcttaagccgacatgtgtcctcctacgaacgctcctatgccgccacatggcattctaataaataaaaaaattcattaaatccggtggacccattatttaaaactattagatctatctttgagaaaaatccaccgctaaaactgggccccactaagtacctgtacgtggatggatgtatatatgtaatgtacgtgttatgaaacaacagggtgatctcatccatataaaaggatggatcgcaaccgaaggcaaccgtgcctcttccctaggcgcttcttggcaacagatgcaatggttcccaaccatcgtgtctccggttgccaccccttctccatctataaattgtaccgcattgatcaataaagaaatctgctcattcattccctctacattcttgtgttcaattctctctctcgctcaatcaattctattcacaatacgttatcagcactttcgctctcgcgaaggagttcgcgaagtttaagaaggaagaacatcactttttgatctacaggaaaagcgaatagaaaaacaacggaaggtacgatgcctacctttcattggatcatggatgcccgttctcggcctccctcgccatcagcgcgcacgccagcttcgctatcttcttcgtcgatcgatgaggaggacgcgttggggatcccgcggaggcagggctagggttgtggccgccgccactaccctcgccgccgtgtgactgcaactccagttgtggttcccccgcctgtccttgtcgcacctcctcctccgcctccggttgccgaagcacctcgccggatccttgtgcagggggtacagtactgtgcccaccatggatggacggcggtggtgacactgcctggcaagccgtgtgatctctcactggagatggagtcgctgccggccccgttcgtcgccgctccatcaccaccaaccgctccttcctcacctctatcaacgtcgcagccgacgccaagctttcgacgctcccccactcccgtgccaccaggatttggtcgtaccggaaccatggcggcgcgcacgggggagccgcctctctttacaccgtctccaactcgtggccacgtcggagccgccgctgcacgccgtcccggcctccgccatacattcattgccgttccccatggctccccgagccgcatggtacccaatggcatggggggggaacggtgttagggtctggccggtctccaactccgatgaggagtcgggaccgtcggcctaaagccggccggcatgccgccggccgacgagagggacgcggcggcggcggatagtggacggtggcggtgggaggtggcggtggaagcaaggcggcagcggaaatggagggggtagcggcggcgctatcactgaaggtggagacggcggtggaatcggcggcggtggcgtcggcagcgcccccgcggcggcgtcggcggcgccccccagcggtggaataggcggcgcacctcaacggcgtcaacggcgcacctcggcggcgtcggtggtgcctcacggcggcgtcgatagcggcgaactggcggcggtcagcgacgaaatgacggcggtgggcggcggcgtgtgcagcgaaaaggcggcggcggcggcggtgaaattgtgggggcagttagggttaaccctaacacccccctccccgacgcc

SEQ ID NO: 73461 - DNA, 10448 bp, Oryza sativa
tgattaataacactgtgtaactctaggatcgtctttatataatggctttgggcaactaagtgacttttaaatgctgttttctacaaaacttaacccctatattattaccccttgtaccctcttgcattaatcatgcatctgccggtgtgacttgctgagtactgtggttgtactcattcttgctcaatcttcccccccccttcagtaagagaagctttggagaagaagtcttaggtggagtcctggcttataccccagttgagcgcctgtgaagatggagccgtaggcccactagtccgctgctggttattttttaattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacagtcacactgagatataaagtgagtgacgagtcataacattatctatcttgctaaccatcaagtatctgtgatgggcaataaacttactttgacgatggtatgcagggacatctgtggaggcacatcacgtaacatccaaacgacatgactcactctgatcctaatagaatatccaaccaaaacaaacactctaaagcaaccgataaggaattcaaagaaaacccatccatcgcatctataaatagacaagcacaatgtaaacccccttcatccttctcacaactcaaacattacagcgaaagcataacaactagaatcccaccacaacgaagatcattttcttctttgctctccttgctattgctgcatgcagcgcctctgcgcagtttgatgctgttactcaagtttacaggcaatatcagctgcagccgcgtctcatgtgtcacgaccggaaataacccaacgggcgttccttacgtgagtgcattattccttgtcccaggaggcaaggtacaccaaaagttgatacagttcagagttcaacaagcggaagcgtaaatagttaatttattacatgggcagcgaaggcccagcacacacaaagacaaacgagaaacagcggaagactagggcgacgaccacaggcgcttgacggtaggcacgagctagacaccaaaaccttcatcttccagagactcctcttctgggtttgggaaaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtccaagctcgtcccaagccaacccaggccaaccattccacattttagttgttaagcaggttttaagaattaaaacactaacttgggtacattgctcggcttgcccataaccgagggcgcggctattcgaatagattatactctgatcaaaggtgtacatctttacccacaagacacatcttcctcacgtgcaaccacgtggcacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacgctagtactttgcaacagaggcccgaagaccggtccttatatggccgaggtgctactatcaaaaccatgcaccccgagcccagcctaaaaccattgttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggtccacggtggaccgggcgcacccgggctcacaccggccggcgccgtgggtcccacgcgtcagccgcacccgaggacgcgggcggctgacagccgggccccacgcggcagccgcacggtgcgcccgaaggcggccacgccggcgcagcggcgggaggcggcgcgccctcacccctatggtcgccggcggcggccataggcacggcggagcggcggccgagagaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcgccggggatgcggtggagccgaaggtggcgacgccgaggcgggaggtggtccggggcgacgacggcggcggaccggagctcggcggtgacggcggagagagagaacgacggcgcgagctcgattccgacggggagagagggcggcgagtggcggaaacggtggagggaggcacggggaaggtttatataggattgggagggggagggagctgccggacgagggggaaacgggcgcggaagatccggtcgccattgatggcgccggcgaggttaggggagaggtttccaaacgaatccgagggagagagggagggaaaaatggggggaaagagggagggaatcacggggaatatttccccccactttattgcgcgcgtggatggcgggaggcggcgggattcgcggcggcggcggcgctagggcacgggcgaggcggcgggagcggcgggaggaaggggatgacgggtgggccccacccgtcagcgagggtggcgggcgggcccgcccgtcagcggcacgcgcgcggggaggaggccgaatgggccgcggaggagaggagagagagggagagagatgggccgagccggcccaagagggggaggagggggaaaaggactttttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcggggatgtattttagagtcgttttgggacgcgacatcatgctgcagcaacagatgcttagcccaagcggtgagttcgtaaggcagcagtgcagcacagtggcaacccccttcttccaatcacccgtgtttcaactgagaaactgccaagtcatgcagcagcagtgctgccaacagctcaggatgatcgcgcaacagtctcactgccaggccattagcagtgttcaggcgattgtgcagcagctacagctacaacagtttgctggcgtctacttcgatcagactcaagctcaagcccaagctatgttggccctaaacttgccgtcaatatgcggtatctacccaagctacaacactgctccctatagcattcccaccgtcggtagtatctggtactgaattgtagcagtatagtagtacaggagagaaaaataaagtcatgcatcatcgtgtgtgacaagttgaaacatcggggcgatacaaatcttaataaaaatgtcatgcaaatttaaacataatgcctctgtaaggataaatcctagtacattgttgaaattaattatcatcaccgcctactatggttgcatttacaactttacgatgtgttcctacatttggttctaagctactatggctactcgacgtgaacggagtgtgttaagcaggtcaatcttttcatttcgatcagaacaaagtcaaaacgcatgtggcaaatagtatataccctacaacgtaatcctacaccataggcaaatcattgccaatacgtgctagccgaactgttgtgagaagcaatgcctcctaagtcacgattccgttccctttcgtgattttttctttctaacgtgttttttaactcctcggcaaaataaacgcaagctaatctttcagatttttctccaaagtggtcataaaatcaatgacggcaaaataaacattgttgaaattaattatcatcaccatctactatggttgcatttacaactttacgatgtgtgcctgcattcggttctaagctactatggctacttgtcgcgcccggaaaaataccttttccagaacgctagtgtgttaatccccgtcccaggaaaagccggggtacaccacacaaacatgatataaaagacacatctttatatatcgataatatttacattatcacaaaggcgcttcaggcctgacaatcaaaaataaacagcagcggactagcgggcctacggttccatcttcacaggcgctcaactggggtataagccaggactccaccaaggacatcttctccaaagcttatcttactgaaggagggaaagatagagtaagaatgagtacaaccacagtactcagcaagccacactgggagatgcatgattaatgcaagggggtacaaggggataataataatatggttggattttgcactaaagagcatttaaaagacacttagtcgctcaaagctattttgtaaacacgatcctagagctacacaatattattaatcaagactgtgaaccctcacgaacctgccttaacccaaagcctacgatgattcggaccgaactggcaacccgacctcggtcccagctcgtcccaagccaacccaggccaaccattccatattttagttgttaagaaaattttaagaatgaaaccactaacttgggtacattgccaggcttgcccatatccgagggcacggctgttcgaatagattatactctgatcagaggtgtacatctttacccacaagacacgcctttactctgcattccattgcaattggaacccataaaaaaaacgtgacataaccctttacccatcctagccgtgaacaaaagcaccgacccaaccctgcctacggccgatatcccgggacaggcaggccaggattgagcccctagcaacaggatctagaccgggtgcgccacacgcataggggtgagaccacccgtgtactagtccagtgccatggcatttcgactaacagacaccagcccatgtagccttcatttgcctaaacatctcgattaccgatccgcagctcgcgtagccttcatttgcctcagagatatccatcgtcgcaacgacttcatccatctctatccgtgtccttttgttcaggactagactgagcaccgagttaagccttacccattagacatgtggttagtacagtagtgctttgcaacagaggcccgaccttaatccttatattggccggggtgctacttcccacaactggcatgcacccaaaccccaccggaaaacaggttttaggggttttgaaagaggaagagaggggtatgtcatattccaccataagccaaccgttccatagtatccaagtgatataagaattcccaaagtctaaagttataataccacctattgttgcctaattaatcagcgaagcatctacctaaattcatactagtggaaccataaatatagtacccactagttgaggttttatttgcctagggtaagcaaggtgataataacaattgcaataataaggctataacaaggattaataggtaatgctaaataaaacagtggtaacgcgggaatttaaataaagcagtaatgcaataattcaaatcaaaataattttataaattgggattcaatatgctgaaggatgatgcgacttgccttgctcagagagaacggccttccgaaccttcggcgacgaccgcgaaccacgcttcgggaacctccggaacgacaggagctacgcgaagcacacaagcagagctaaaccctataaagaagcaacaacaatacataaaaagaaagcacagggttctttaggttataacaaacattaggagatttgaatggttccattcaaagttcgtatgaccaagatatgatcatccgaagtttaatgttgttgcatggagatttacggattattgtaattaggttttgcaactaaaatatgtgtaagctctagcctggaaaagacaggaaggctgcgctgttgacatccggaccccacatgtcaacctaagagaccacagtggaccgggtacacaaagacggtccacgggtcgacggaagcggaccccatgtgtcaaccgaggcgagtggccatcaaacggactccaccagacaccacgcgggctgcacacgtggaaaccatgcggctaccgagcgggcacacaaacacggtcaccacacgcaccacgaacgactaccgacactggtacacgggtaccggggttgacaaccgcacaacgggcacggggcgacaccgaaaggacgaggacgaggcagcgagaggaggcacccttaccaccacgcgatgaggcgtgggaacaacgatggcgaatgggcacggcggagacggctcggggacgatggaggcgaaaggggagggaacgacttcagcggcaatccttggacgaaggcgagacgcggccggcgcaacgcttgacgacgcggagccgaggacgaagacgacgacggggctgcagcaaccttgacgaaacgcgggcggtgaacacgatcggctcgacggagggacgaacgccacgacgaccgggaacgacgagaggacgacgatgggaaccggcgaggaggcgacgacgaatgccggcgggttcggccgaaggggaggcgatgccgaggacgacgtggaacacgccactgcgataccggaggaggagacggcgacgtcggccggcgcacgggcgacgaatagcagtcggccagagacggggaggtactggacgccgatgaggaggccactccggcgagcttcgggcgaggaggaggtgatgccggagatgaggacggcgtcgcagaggcgagggaggtggtggcgacgtcggccggtgcaaaggcgaggcggcacaggcggttggaggcggagcagtggcggcaacaccaccgttgccggcggggacgcacctctaggggtttccgcgtgaaacggaggcgacgccggtggaggggaggcagctgcgacgccgagggaggagacggcgcggccgaccagcacgcgggcgaggcggtaggggcggctggagatggccggcggcacgggagagtgaggaggacggcggggagaggtggtgaagccacgggagagcgcgggagggggtaaaaattagagaacggatctagggggttccattttataggataggggagggagccgggcacgagagaggtgggaacggcggcggaatttgtggccggcggccggggaagacgcgtccgttcccgacgattgagggcgccattcaagggggaaaatgggggaaaccaaagaggattgattagggaataaaagcccccaatcaatttggagttaaagcccttgattcgagcggatttggaggaggatgagggatagatttgaacgggagagatgagaggagaccgacggctggaggtgggagacgggtccgacaggtgggacccacctgcaaggcgcggtcaacgcacgtgggcgcgcgcgtgacaggcgcgtgcggcgcggcctggggaggctcggctgggctgggacacggcccaggtaggagggggcagggcggcctgcgccgggcagaccgggaggggagggaggattggaaggagtgggtcgggaggaggaggagaggcccgggagaggagggaaagagagggaggagagggagactttgggctaggctcggcccaaaggaggaaggagggattatttttagtttttctttttagtaaactttgataatggctgttgttgtttaataattatttccagtattctgaaaattcaagtaaaatttgagggctccttttagaccaaggagaatttaacgaaaattcttcgggctacattcgaaattttcttgtacgcattttaatgtttgccaattttttttcaaattttaattaattctattattccttttagagaatgatttttatttcgggatgaatttatcaggacgtgacactactcaacgtgaacggagtgtgttaagaaggtcaatcttttcatttcgattagaacaaagtcaaaacgcatgtggcaaatagtatataccctacaacgtaatcctacaccatataaaacatgcccaacctatagcggttataaatccactattcaaaatgtaagtatcgatgggacaatttgtcatatcattgttaattcaatcttaccttgtcaccgaaacaatacgctctgcgtaacatgaagttaaaattttcatatttgaaggcctggtcacggaaatatcaatttataagttaaaaacattaagcattactgcctcaatgaaattcatatatgcttaatagtccacgttaaatcccatgcatatcggtttcatttgttttcacctaaagtcacaaaatatagttgttgttcttaaaggtcataatatctacccaagctacaacactgctccctatagcattcccaccgtcggtggtatctggtactgaattgtagcagtatagtagtataggagagaaaaataaagtcatgcatcatcgtgtgtgacaagttgaaacatcggggtgatacaaatctgaataaaaatgtcatgcaagtttaaacataatgcctctgtaaggataaatcctagtacattgttgaaattaattatcatcaccgtctactatggttgcatttacaactttacgatgtgtgcctacattcggttctaagctactatggctactcgacgtgaacggagtgtgttaagcaggtcaatcttttcatttcgatcagaacaaagtcaaaacgcatgtggcaaatagtatataccctacaatgtaatcctacaccatataaaacatgcccaacctatagcggttataaatccactattcaaaatgtaagtatcgatgggaccatttgccatatcattgttaattcaatcttaccttgtcaccgaaacaagacgctccgcgtaacatgaagttagaattttcaaatttggaggctgggtcgcggaaatatcaatttataatttaaaaacattaagcattactgcctcaataaaattcatatatgcttaatagtccacgttaaatcccatgcatatcggtttcatttgttttaacctaaagtcagaaaatatagctgctggtctatcctgagagtgaataggtaggcatttcgttctttactggtatcgttgatgaccgccgtgatacaatcggaccatggtttgatgctagcaaggggctattttcatttatgttctgcctcctaaatgtcctttcattcttacatctagtaccatgacaaaaatctagctagttctataggcaaatcgttgccaatacgtgctagccgaactgttgtgagaagcaatgcctcctaagtcacgatttcattcccttcgtgattttttctttctaacgtgtttttttaactcctcgacaaaataaatgcaagctaatctttcagatttttctccaaagtggtcataaaat

SEQ ID NO: 73462 - DNA, 664 bp, Oryza sativa
tcattctttaggggacttccttttcttattgccacagagtagacgcatatgacctactaccattttcagcacattaggaaaaccgatgaccttcacattgttgattagtgaagaaacttaatgggtcgactattttgcgcgattgagatcgttaccgaagcacgaaacggttttttgtgtcactgcatgtgctctgctcacttcacctgtcttctagtacgtgtgaatttcgaaagcagatgtcacccgaagaagtttgagcttaacatccaactcgattccgttttgctacagtacaacttgcagcgatgcagtagctcttcattagatggatctttcagctttcaggctgcaacctgtttcatccttatgccctgtggatacgaagcaaaccccatgtatgatggagacgtgcattgaagtctcgattttactgcaggtctctgaggtgctataccgctgcgagtgataaattactattgccatgcgactctagcggtagtaccgtaactctagtaacattgtaccgtcgtcagaactcagaatctagtatctggcatcctagctacaactctcataatccaatacagatacagtactttctacaggggaaaaaaacaaaatatcgtatcttttccttaggggagacggaatcgaactctta

SEQ ID NO: 73463 - DNA, 975 bp, Oryza sativa
gcgggccaccccgtccacccatctcccgtgggattccgacgtcggaacccactctgcaccatgcgccggtgagcaccgccatggccgccgcttccggccggcgtcctcgccccttccatcttcctctctctctaaccccattcatcatgttcgctaggtggttccggagctcgtcccgttgccgtcatcgccctccgtcgctcgcgtcgtcaatcgccgtcggtgagacacctcctccccctcctctttctctcccgcgctgcttagccgccgcgccgccgcctagccgcttagctgccgccctctgcccccggccggtcgctgccggtcgccgccgctgcgtcgagccgcgtcgccgcgcgccatggtcgctgggccggtttgagccgtgcccgtgcgcgccggctgcgagccgcctccgccgtccgatctatcgggcggtagatcggggccatctaaccccaccgcccgtgtggctgccacgtggccgccgcgtgtgcgccacgtcagcgccacgtgtgcaccacgtggtgcactgcctctttcccggtccgtggacccagtccacctcggaccgccacccgagtcactgccatgtgggccccgcatgtcggcgccgccccctctctctccctaggaatttaattattgcgcaataaatcaattaaggatttttctgtttatagtaaaaacatagtgaatcttctaaaattcatatctaattcatccgagctccgtttaagcccattcaagtctcagtaaatcaagaaaaatgcatagaatccattaaaaatggttttgttctctgtttcagtagtcttatagcctgtttgtattgttaactttgtatgttgcttagattccggctctcttgtcgctccagtgtactttgaaatagtcgccgaggttcctcctgcaccagagcaaggcaagtcatgcttgtcacttaaacatgttgatcctatattgcaaatg

SEQ ID NO: 73464 - DNA, 14133 bp, Oryza sativa
gggggatacccctaatcggcgcggcgaccagagccactcccacctagtatagtcctagtactactagtactatttgtctagtagtactactgctgctgccctacacagtggcgcgctttagtactacggtactactggtacagtactactttactctactactactaatattatacaaacttgtatacaatatgtacaaactttgtatgtgacatgtacaaactttatattacgatatgtacaaactttgtatacgtacgtattaaaaaatcgaaaaaacaaaaaaaatcacgtatataaagtttgtatacgtatgaatataaaatttgtatacacgtatataaagtttgtatacatgaatacaaagtttgtatacgtacgtatacagagtttatatatatattaaaaacccaaataaccggaagaaccggggaaaaccgaagaaaaaccaaaaactagaggaaaaccgaagaaaaaccaaaaaaaaccggacacgcgtaagttctccgtcgccctcctgccgcccggcccggcccgcccccctctgtgtgcgccatgtggccgtgccgcgcgggggagcgggcgcgcggctagtcgccaattaggcgtttcgcggcgggggtggcattggggaatcaggatcctgactttggtaagtaaaggcagagatgcacagtaacgtgactttgaaagattcgtagccatctagattgcaaaggacagtccagattaaaaccgagaatgctaattgacgcgcgccgctgccaaaagcccaaaaaaaacccatactctatttatttcctgttttttttcttttttttttgagcagccacgttttttttcttttttcatctcaacttttaaaaactttcaactcagatttgaaatctttcaaactcagatttaaaaactttcaactcaaaattttaaaactttcaactcgaaatttgaaatgtttgaagttaaattttgaaaactttcaacttttcatctcaatttttaaaaactttcaattgaaatttgaaactttcaattcagatttgaaaactttcaactcagatttgaaatctttcaacttagatttgaaatctttcaaactcagatttaaaaaatttcaactcaaaacttgaaaactttcaactcgaaatttgaaatttttgaagtcaaattttgaaaacattcaacttttcatctcaatttttaaaaactttcaactgaaatttgaaactttcaattcagatttaaaatctttcaactcagatttaaaaaatttcaactcaaaacttgaaaactatcaactcgaaattataaatttttgaagttaaattttgaaaactttcaacttttcatctcaatttttaaaaactttcaactgaaatttgaaactttcaattcagatttggaaactttcaattcaaattttaaaaacttttaaatcaaaataaaaaaaacttctaactcggatttgaaaactttcagatcgatattttgaaaaactttaaaatcgtattttgaaaattttcaaaatcaattgttttcattttttttattgggaaattactgtagcattttcactaaacaccatgattaacgctaattgtcaggattagtgacgtagtcacgcacgtcgttatctgttgaggaggcggaggcccgcgtgcgcgcgagttagcatcctcgcgcgtgcacgctagccatgcccgattaaaacagcacagtaccaataaacagtaaaccgtacttgtgctacagtattttctcctgttcagtactttgcgggggagagggataagttcttccttaactcgtcgaatccgattttcgctgatacgtaatatgcgactagttggttattaatttttgttgaaagttatatgttttgctaatatgtaatatgcgactagttggttattaatttttgttgaaagttatatgttttgctaatatgtaatatgcgactagttggttattaatttttgttgaaagttatatgttttcaggatggagactcaacgttgtatcttttatttccgagattttgatttaaaaactgactaattatactccctctatcacataatataatataagatacaaccaaactcaacacggtcttcaaaactattatttgatttataatttctcatattgagtatgagtaatagagttcctctactcctacaaacacttgtaagatgccatgtgatgctctaataaataggagaaaatttaagaaaaaatatatgggaaaaacaaaacatctagccatcgatttgcacttaaaccgttgaatccattattttcaatcatcaaactagatttatttaggtaagccctcgctcctaaaaactaggtaatctctccctatgcacgtacatacacaagagatgtaaaaacaaaaaagaagagtgcatatatggtccatcccatcaggtagttttttttttgttttttttctttgtagccctaaggtttctctcaaattatgtatatatgtagcgaccactttttgtgagtttaacgaagaagccacgctgacatggtgctgcttcatgccaccctcaccaattttcttgaatgtactttttgaaatagcaatgtaaaaggtaatcataggcagtcatataaatgtgtgcacaccaccctatgaatgcacatacacacaccctacctcctatgagagaaaaatatttgtccaaaaaattatgaaaagtatgtacatctgagagactaccattcaccaaaaaaaaaacttacatacatacattcagtaaaaaatgtcgtatggaaccatattttatcttttttacttatgtcgttctcatataaattgtgttaattaattgtgttaacaattagtacaaataattttgataatatagagtatttctttgtatattaccatgaacatgttaaggtgaattagatgtataataaaagaaaaataatcaaaacacatattctattttcaaaggatgatgataggtaagtttacatataaccgaaacaaagtgatttttatttgaatatgatagacattatcatttagtgtatcaaaatccatagtctatttcatggtataaatatttccttcttttacggtaaggttatgaggtaatctatggtcctttatgatgatatatgactttttagtagatttttttaaaaaataaattacccgcgcatatgcgcaggttccttcctagtttcctcctaaaagaaacaacggtagtgcaaatgcagcccaccaacccgcgtaaaccaaaacccgatgctcaagtccgtgttcccaatgctgccccaatatggcaaaattctaaaagtagcaatattatgagatggagaaaataataaatatgaatatgatgagtcattttagagttatattgtatcaactaatgttagtgtttacacccaacaccgctggagaaaggcttcgtagtcccggtttgtaactccctatagtcccgggttgcaaactggtattacgaatctgggactaaagatcgctatctttaatcccggttagtaacaccaatcgggactaaaaatggcagtgtcacgtgactggtactgccatctttagtcctggctgggaccaacaaccgggactaaaggtccttttcttcctttttttttaatttgcttgcaagttatcagataatcacaattcattcacagcacaagcaaattatattatcagatcatcgtaaatttattcacagaaacattcacatatcaaaaacatccaaaactctagaacaaatcataaaaaaaaaatcaagaaacattctagaacaaatgaacatcgccgatgtcgcccggccgttggtcgccctcccatctcgccgccggctcatctcccatcccgctgcttcccttctagccggatctagcagaggggagggcgaggccactgtcccgcgcctgtccgccgccagccttccatctcgccgcgtcccttccggttagatttggcggaggggagggccactgccgcagccaccgtcggaccactaccgccgctgcttccaccatcgggccgcgaccaccgccgctttcgccacccagccacggtcgccgccgcttccgtcgagggaactagagagaatgagagagagatagagagagcgagaaagaatgagagaaagatagagagagccagagagatagagagagcagaggccacgtggaagatagacgaggaaatcgagagagaggcgtgggagataaaataaggaggtggaagagagatatttagtcctggttggtgataccaaccaggacaaaaagtcgttgggggcctgacacgacctaacaactattgaacccggagtgaaattatctttagtcccggtaaaattggttgggctttttaaccaggacaaaacaaagatgtttagtcccgattcctatttgaaccgggactaatgtgctttttggccaaccgacgaaagaccatttttccagtagtgcaaattcaacacctagattcgaattaggaaaatatttccaaaatttggagagtaccggtttccttcacgaagccagtctaaccgccatgtgtgggcttgtttgaccggcgatttgtggctggtcagaccgacagagtccaatcccaagtttgtttttatcggatctcgggatttcttatttgggaggatatgtttcgggtttctattagtttctactcgagttggacgtgaaggaggacctggcagcaagacccgttcaattgaaaagaatctacacacaatccaacctagccaattgaattgcttttttaatattgcatctagttttcacctagtcctagcctaattcgtctatctttatcaatttgcgatgtaaatcgtctgctttcgctacgagagtgtgaaatccctttgtaagtttatcccgtaaaccttatgttcgtccacgagacgggtgtttatcgcttgtttcttctaaatcgggcctgctagcccggttaatctaccaaaacccgtcttgatttagtttttgctagattgaggtggttggcgactccataccactgtaagatgtttaggtgtcccaattattgtcttcatgccaaaaaaaatgctaacaattagtattgctcgagttttggcataacctccctatcaaaatatagcagcctaataccgtatggagcacattttataccacgaatatggacattacgttgtatcctgttctaattagttgctatatattgagatagagggagtggttgggatggtgaagttgctatagagatagttttggtttgccaaattacgctaccaagagacgatagtgttcgccttgcgtgagaatttatccggtttcaaaagttaataacaagaaattattcatttaaatttagggcaaaaattagtagtagtagtagtagtctaagtagtagagtgctacaaattccagttccctcccgaaaacaaaagaaggcccaagctgcagcacaggcgcattcccctacagaaacccaataatgctaaggtcaaccttcccgctcgtctcccacctcccatcccgcaaaccacccccaatccgcccacgcccaccacctgttcggccctatgcctcttccgccgcctcgcctcctcctcctcctccgccgccggcgtccgcttacgtccacctccccttctgccgcaagcgctgccactactgcgacttccccatcgtcgccctcggcacctcctcgcccccgacatccccacacggcggggacggcgacgacccgaggatcgccgactacgtccgcctcctcctccgcgaggtcgccgccacgcgccccgtgtccgacgacggggtgcccctcgagaccgtcttcttcggtggcggcacgccgtcgctggtcccgccgaggctcgtcgccgcggtgctcgacgcgctgcggaccaggttcgggctgtcggcgtccccggaggtgtccatcgagatggaccccgggacgttcgacgccgccaagctgagggagctggtggggctgggcgtcaaccgggtgtccctcggcgtgcaggcgttccaggaggacctgctccgtgcgtgcggccgcgcgcacggcctgcgggaggtgcacgacgcggtcggcatcgtgacggcgtgcgaggggctgcagaactggagcatggacctcatctcgtcgctgcccaaccagacagaggagatgtgggaggagagcttgaggtgcacggtggatgcccgtcccacgcatgtgtctgtctatgacttgcagatcgagcagggaactaagtttgggcaactgtaagtgtttattgccaattcatgaatctaatcccatgtttttgagtaaccgattggaaatttcggatatattctggccacatttctgttaatcacttcatgttctgattctgttatggggtttggttggtatggcaatatgggctatgaactaggaatggaaattaaataatttagaatcattataattctattgggaagaagtttgtattactattttgcacttgtttgtgttgtttttaagttcaatgctctgctcagaactcactatgatgataaacaattattgtaactggaatacgctaaaaggtaaaggtttaagcatgaaattgttattgttgtctctggccttgtctcatccaattatgggaaaaatatgtctcattaatttgtgatatgttaatttgcactgacctttttatgggaaggtactgattctcttatgtcagatttgaaacgccagatcagcttttgcctttacatgactacagattgagtcaaaccctcttttatgattttttaaattaaacaaaaactatgatagttaaaatctctgttgttttaagttcggtgctctgctcagaactcactagtatgataaacaattattgtagtcaatacaccaaaaggtaaagagtttaagcatgaaattgttatggtcgtctctggtatgtctcatctgattatgggtaatatcccaatacagattctcttatgttagatttgaaaccccaagtcagccttctcctttacatgaatacagattaaggaaaaccctcatttatgatttttatttaaacaacaactgtgaaagttaaaatccttcacatcactaaaacaatattcctcaagtacattttcaccatgctatagcattggcaggacaattcattgaacttaaataatgcagcatgatattattaaaagactgtaacttattttgaagtttaaagctgtaacttcatcctgtatatgtgcctgacaggtgggtcgaacctatcagacttaccctaaaccctgttcttgacaaagtagcaactgtaagtgtttattgccaaatcatgaatcacatcctatgtttttcagtaaccgattggagatttgggatatattatggccacatgccacatttgtgttaatcacttcattttctgattcagttattatggggtttggttggtatggccatatgggctatgaactagagaatgaagaataaataactagaatcattatcattctattgggcagaagttcgtattactattttgcacttgtttgtgttgtttttaagttcaatgctctgctcagaactcactatgatggtaaacaattattgtagttagatataactgcaatatgctaaaaggtaaaagagttcaagcatgaaattgttatggtcgtctcaggcatgtctcatctaattatgggaaaaaaatgactcactaatttgtgatatgttaatttgcactgatcattttatgggaaggtactgattctcttatgttagatttgaaaccctgggtcagcctttgcctttacatgactacagattgaggcaaaatctcatttatgatttttaagtatacaaaaactaggatatttaaaatcttgcacatcactaaaacaatattcctcaagtaaaagtaaattttcaccttgctacaacattagcaggacaattcattgaacttcaacaatacaacatgattttatataaaaaaaactgtaaacttccttttgacattgaaagttgtaacttgatcccatatgtgtgtgtgacaggtgtgtccaacctatcaaacataccctaaaccctgttcttgacaaagtagcaacttttgataacatcatcaactgtttttgtagttttctgaattgtccagctaatgctataacaagccgataattgacaatatagttgtgttcttttgcgaaattttactcatattcctctaattctagctgtcattccaaccagtaggaattcagctccatgtacatggatgagttgattgaatgatcaatttacagcaatcctttttcataattaatgcttgcagatatacacctggtgtttatccgcttccaaatgagaaagattctgcaaacttctataagatagcttcgaaacgtctttctgaagcaggatataaccattatgaaatcagtagctattgcaagactgggtatgagtgcaagcacaatgtaacatattggcaaaaccggtcattctatgcatttggtcttggatccgctagctacatcaatggtatcaggttctccaggcccagaagaatgaaggaatatgcagagtgggttcagaaattggaaaatggagtgtggagccatgagtctggcaattctgggataaaggacatggcaatggacgtggtgatgctatcactgagaacagcatggggcctagatgtgcaaagtttcagtaaaaccttcggaaggagtctgacagagtcattgtgcaacacatttaggccttttgtggagagtgggcttgtaattgccatggatatggaacggcgagctttgcaaccaagtgaatttgagttggacttgcaacatgatggtgagaatggaagcagagttgccttcatccgtctgagtgacccagatggttttttgttgtccaatgagttgatttcacttgcatttggaattatttcaccataacaaggctacactttctttacatcggtatcgatctttttcattttattactttcatctgaccatactggtaactatctagtctgatcttagttttccaggtagatattagctaatcgctaaaatgcttagcatttctgttcaagtcagtgcaaactgaaactcatattggttgagagagaactgttacaccatttgcataaatgcaaatagatggttatctagtatgttcttattttgtttaactatatccatgactccatatcactcctcccttcgtgtatatatttctctgcattctcttattatcagttcatttcatacatatgagttaaatctagtagattgttgctatttgtttatttatttttgttcatacaagcatacaacaagtttactgtttgctttttgtatggcagttttgggtgcattggataaactattgacgatgaattaatttttgttttcttagggatgattgtttcagtacttggttatagtttttaggatttattttcctggtgtagatggaaaaatatttggggcaacaattttttgaactgaactgaattgagagcttcagttgtatctcttgatttcgtagtatttttccaggcctactatgtacgttaaatctaagcatttattgaaattggcagtgcatgctcctaaacatttttgtgcttttgatgtgtctgtcactattcaatagtttcgactactgcctcatgaatctcagttcatagacctaattctgtgtgctacttgtgctaagtatttttttttaaaatgatcacctttgaatgaaatgttgtgtctgtgctgatagtttgtgctagatttaaatggcaaatttcaaatactgttttaaattgtcatttggcaagctagttttcactcattgtgcctcatcacgaggagaagtcctcatgttcctctaagttatcgctcaatcctttctttacccctaagtatatcatgattttatacttaacaaaatatcatgattttgtacttacccgttttattagtcgactattagaatttttttagaatttaccatactgcccctctccataacaagaaatgctagcttcaacaaaaccataatccttcaaataaaaatattatcagttatgcaaaaaatcaaggggcataattttagtatttgttttgcctcatatgaaaccgatatctgattttttttaatcaacattatggaaaattgaagaaattactgacggaggtgatgttacacaaatcaccagatgttcagatattttcacctagaatatgaaaaacaaaatcagttttttatttctcagtgaattcgaaccaaatttgtttcccttaaaatttggttgatatcgataataaagttctaatcttgattttaaagtttgtttgaattttggaatctggtgatttgggtaatttcacttaaaaacacatcaactgaatcattttgttgtgaaggttttagttttcgaggaaatcttatcaattattattacaacatagggcaatataggcatttttataaagtctactggtctatgaacaggatggataggtgaagggtaaaaagagagactcatgatatatagagaatgagccaaactcagaagaataaatgaaaggaagcgagtaaaagatcgaagggtagtgtagatgccacatattgacggcaagttcaactcctcatgagctagagttcaagcttgggtctgatcaagatagccaccattaaactcaagctgcagcaggtgctgctgctgcagatggcttggtaagtggcaacgctactgtgctatctgcctgagctgctggcagcattgctggggcatgagtcatagggcgggttggtgtttgagtgactttaaggttaatcatttgaagaacgtcaaggtggcagtgcaagtgcactattcataaacgctaatatcttgcacggcaaatctgatgttttgcaaagcttgataactgttatgagctataattcaccctgagctttgcatgtcaaatattgataaagctagttaattggattatatccttttttggaactaaatttttaatgttgagtaagttgttgccttcactatgctttggatgcgaagtattgttttgacataagctttctaagttttaacactgaagttgccattcactttacacgtcaatgattgttttggagctcaattattagttgataatcttgtccgagtttctgctgatgggagccggggaggaatagccacattttgggatgatgaagccctccaacaaagcgatcttgatatcagaaccttctccctctcaatctgtctcactcagaagtcctcaaatacgaccttcctcctcaccaatgtttacggcccgatggaagatgcaactctgatgcagacatgctcttctcaaaccacaacctccaagcactctcttcatcatgctccagacatgctcttctcgaaccactgccccctgttgctctcaccaacaaagcagctcctgcgcaagccaactttcaggtttgagaatttctggccaagactattgggcttcctcgaagttgtccaaacggcctggtcccagccggttagcgcttcacacccggtcaagcgcctgagcacaaagctaaaaatgatggccaaggcactaagatcctggagtaaccgcattctaagtgacagtcgtgtccaatttcaccttgtcatcgagcttattctcaaattggacatcgcctaggaaaacataccgctctcacccttggagctctccctcaagaaagatctaaaactgcggatcctcggccttgccgtagttgaaaaggctaggaaaagacaatgttcaaagctaacatggctgaaagagggcaatgcaaataccaagtttttccacctaagagtcaaccaacaacatgggaagaatttcatccacagactccatcacggtaatgccattctggagactcatgaagctaaagagtgagccttgtatgaacatttctccaccatgatggggcattggttacaacgctcttgtaccctgaattggtaagaactccacctcccccaagtgacatcggaagatttagactctcctttctccgaagatgaagtttgggctgctatcaaacaaaagcctattgaaaaagcgcttgggccagatggtttcacaggcacctttttcagaagctactgggagatcatcaatttagacatcatggagctccttgataatttacactcattatcaggggggagttttggaagcataaatagggcaacactgattctcattcccaaaaagaatgacgcatgtacagtgggtgattacagaccaattagcttaattcactcctggcgaagatgctgacaaaaatctggcaatctgcttgtccagacaaatcaacatactgatctcgcaagcctagagtgcattcatcaaaatgagttgcatccaggacaacttcctctacgtctccaacttggcaaagaagatgcacagatccaagaagcccaccctctttttcaagcttgatatcgccaaggccttcaatttggtctcatgggaatacctattaacgctacttgacaagatgaggttcagcgccaaatggcacgactgggtggccctgattctgtcaacctcctcctccagtgtctcactaaacggaattgagggagaaaggatagaccatcctaggggtctaaggtaaggggacgccctatctccgtaccttttcatccttgcaatggaccccctacacagatttctcaagattataaccgtcgagggccacctaagcgagttcgcggaccgcagcgtgcgcttcagatgctccctgtatgctgacgacgcggcaatcttcatcaagccatcatgccaagacgtggacagcctaatctcgatcctgaacagtttcgggggtgccaccggactccaggtcaaccttcaaaaaggctcaatgattccaataagttgtggtgcaattgacctcgatgaagtcctacacaatttcactggtccatgtggaaccttccccatgcaatagctagggatgccactcaaagtaagcagacttcgaaaggtccacctctaatacttaattgaccaaatcaagacatggttaattagttggaagaagaagctcctctcgatcgaacaatcgcctgaacggtttagacattccgtgacaaaaaaatcttacgatagcctttaagaacgtcattcatttatgaccacgtttgagaataatttgaaagattagcttgcgtttattttgcctaggagttaaaaaacacgttagaaaaaaatcacgaaaggaaacgaaatcgtgactaaggagatattgtttctcataacagttcggctagcacgtattgacaaagatttgtctatagaactagctagatttttctcaaggtcctagatgtaagcacaaaaggaaatgtaggaggcagaacataaatgaaaatctcccattgctagctcatagtgcatctaggcccctaatgattttgtggattaataacaatgcgattagagaggactaacaatttaatttaagtcaatgtgaaagattgttagtccgtgacgatttgtagtgcaatgcatatctcgacgaatgtgactaaatcatgagttgcggcaatgagcaaaggttatattgtatattttcatttctttgcgtcattaggaaagccgtactattaagggggatgatgcattcacatatgatgagtgatgtgtgtgctccaaatctatttttgaaagtgtttctcctcagtttctgtattctagaaattttcggacttgtctggaacagatttttggaattttcgaaaatagacataactgaatttcgcttctggaaattttcggagtcgtccaaaattgatttacggaatttccgaaaatgaccgagaagccaaaatcagttctgtaaattttcggacttgtccgatactggtttttggaatttccgaatattgcagtgaaggcaaaagtgtttctgtaaatttttggagttgtctacaatcatattttggaatttccgaaaatgtgtatgcagccaaaaacgcttctagaaattttcggacatgtccgaaagtaatttttggaatttttgaaaatgtctagggggagattttggttctggatattttc

SEQ ID NO: 73465 - DNA, 5398 bp, Oryza sativa
ccacccaatttaccatttaatttttagtttttcatttactttcagcagtaattacattttagtccctatgttttatgtaatttagtggaaacagttcatcagttcttcacattattatgtaatggccctatagaccacttatgttatgtgttaattaacataggtgtttattcaaataccctgtttcactaaatttttttgttgtcttaataacatgccttttgcatattatttcaagacacgctctactttctcgctttattaatttacaaaattctataaattttgtattttgatttagcaaattctcttaattatgtacaacataattaatggaggatttaatgcatgttccacttcacactttgactcggaaattaatcacatgtcaatggagccctatactttggtcatatcgaccataacttaggcagcgagtatcttgcccatcatcaagtggtctacattttgagatgtttacccgatggagtcctacaaattggccgcactagtcataacctaggcagcgagcacctcgcccatctcacagaggtctacatctcacgatgattacccacatgtgttattttccgagaatatgttttgaaaaatgagattatttgaattttggttgagcacaaggtagtggagtcctattcaccagaatatatttgcctggagaccgtgttttaggtagcaagtataacttgcccactattaagagatctactccactgtttaattacttggagattatccacattgtgccacctaatttcgaattctaacttgaattgtcaagtttattaccggcatcttttcgaaacattacaaaatatgaagtcttacatttcgcattgagattacaaccttaatatcatgtttttattaatttacctctgtaaattgataatgttaaccatgattgtagggacatggcaacaaaagagttcaacgaactcgtcctcgatgggactaactattccatctgggcttccgatatcaaaatcaattttgcctctcgagggattttaagtacaattgaggaacctaatgatggggacctgccaattgagcacaggaagctcaatacagccctttttgttttgaggctctacattcacaaggatctcaaacatgaatacatgttagagacgagccctcacaccctttggaaagctctaaaagagcgttatgatcagcaaaaggaactcatttggcctgaggctaattatgagtggattcatttacgcctacaggactttaaaactgtggcagaatacaaccatgctgttcataacatttgctccaggttgaagttttgcgaacaagagccaacagaggcagagaagatagagaaaactctatcaactatgcttccagaggacaagatactgactcaacagtatcgcgctaacaatttccaaaaacattctctgcttatacatacattgactcaggcagaaagacaccatgagctttctttaaagaatgcccaacagcaccccccgggctctgctccactgcctgaagtgcacttcaatgtacagaataatgctgagaataagaaaggattcaagggaaattcttccaataatcctaagaatctgactggaaagcgcaaacgcaacaacaacaggcgcaaattcaagggtcgaaagaaaggaaaagggaaggataaggcaccacaacctcgtagcaatgttaacaagcattgcaacaggtgtggatctgacactcatgtcgctaaagactgccgcatcccgaaatatcttgttctattgtaccaaaaatcccttaaggacaaaaaaatcttctgagaacccaagatttgaagcccacttcaatcttacacatgaagagtgccctgaggttgcaagttctcactaggctcctgttgaaccggagagcaacctcaatgttctcccagaagatgtcgctccactctctgcgatggacgatatgttcatcgaatactgctcaacagacccacttagagatttactgtaatctcagtgcgtcccacttagagataaagctgctttaatctcagtgtgtttgagacattatattgatatcctatagtttgtcaaaacaatattggttgtaataagtagataagtactaacttccttatattataaggttataagacttgctagtcattagagtatgtactattaacctatgtaaacgtcatactatgtatttgatgttttcattattatatgtatgtatatattgtggataaagaattcttcactaagcaattcttctttcactatagatgtctaaggatatcactccgattggagaggaattatgtcttgtggacagtggtaccacaaactctatacttagggagatcaaatagtttcaaactctcaaaaagagagaaagcaaagttttgactatcgctgggtgcgatactgtaatagttggctcgggacaagcaactattacactcccaatgggtacacaaattacaatcgaggatgctttattgtatcctgattcaacccgtaccctactaagttatagagatatccgtcaaaatgggtttaacatagaaacccatatggataatcgagaagaattacttctcttaaccaatcaaaacggatatggcaaacgcatttgcgagaaaattccatctctcacatcgggattgtactatacatacattaagcccattgcacatgttgcgtacaaagtaatttttcaaaatgttgatgcattccacatttggcatgatcgacttgggaacctcgatatcgggatgatgagaaaaattattggcaactttattggtcatcatttgatcactgataaatttctcaaatcctctgatttcgtatgcactgcatgtgctactgggaaactgattttgagaccatcttatctcaaaattagagccgaaccacttaaattccttgaacgcattcaaggagatatctgtggccctattgtgccaagatctggaccgttcaggtactttatggttttgattgacgcatctactagatggtctcatatgtgtcttctatcgacacgaaaccatgcctttgccaaactaatgtctcaaattataaggctgaaagcaaattaccttgaacataggattcaatcaatccgtatggacaacgctgccgaatttacatctcatgctttcaatgattattgtatggcattgggaattcaggttcagcactctgttccatatgtccacacacaaaatggttttgctgaatcattgatcaaaagaattaagcttattgcccgaccattattgatgaattgcaaattaccttcgtcgtgttggggttatgcggttctgcacgctgctgaccatgtccaactacgactaactgcatatcatgaaacttccccaatgcagttagtacgtggaaatcctccaagtacttcccatttgcgtaagttcggatgtgctgtatacataccgatctcaccaccacagcgtactgctatgggcccacacaggaaagtggggatctatgtgggattcaaatctccgtcgatcataaagtatttagaacccttaacaggtgatctatttactgcccggttcgttgactctatctttgatgaggaacatttcccggcattagggggagacttcaagtaccagaaagaatgtcaggaaattgattgggatgcccagggtattctagccccagacccacgtactactgaaattgaacttcaagttcagaaaattatacatttgcaaaggcatgcaaataacctgccaaatgcatttaccaattataaaggtgtgactaaatctttcattcccgctcaaataaaaccactcaacttccactcactaaaaagagaggaagaagtatggccactcagcgagaaacaattgctaataagcaaagaaagacggtaaatgcaaaccaacctttagttggtacacaccaaattgatactgtatatcaagcagatcgtgatagtctgcaacctagctcggtggttgttgacggtcgttatcgatcaatttcaaccgtcaaaattaccaaaatagaggagaactagtgatgcttgcaatgcgtatgtttgttagaataataatattctactagtattaggtctactaaccttttgctgagaatgacaataaagtggaggaaaatcgacatcaacacaaacgataaatcaatcggacgatgtcgagaaccagacttatgtatgaatgggccaagaactcagaattgacacgatgaattgggccaaaattcacaagtctgtggagtgaagcaatagaggaagtcgccagccgaagatgggctggtttgggctagcccatggttcggccgaacccccatctccaccgttgaggccagggtttggcatggacgtccaagattacaccccaatgacggttggagggtacttcggacaattccccttccacaaccgtcatacctacctctatataaggagctcactctcttcactttaacacacacctcaagcaagagctctctcattcctctcaagtttagtttagtagtatctagctagtggaatagaattagaataggaatcaggagtccggaagccttcggaagagtttgggtatggctctagtagcttttctttcctcttttgtaagctttatacttttattagaatacttttctaaatacatttctggtattgaaatactttccgagtatatgagtaccaactttacattatgttcatgttatactgaatatactgctagcttatctgggagatgctttggttcgggtatagtgtttgcttatgcaattactctatgtcatgacgatgatattagagtagtatctggtagtttagacgtggtgtctagattacaggatatcattatttggggttatatattgcggatgagaggtgggtcgctgatggtgacagctcaatacgggtattcctccgcgcctatatataattctaagttaatttcctggggagggtattcctccgtatttagccccggttggatggtcatgacgggctatcataaggaactcggcagtcaggggtggcttctcgaagtaccaggagggcatcggatagagggtattagctagtatatcagttaactagaatgtatgtatatatgtatattagaagttaggaatagattttctttctcttttctttccacctagcttagattatttattatgaggatgagtagtaatgcttgtgtgtcactctactcttggattatcttaacccctgcttagaatatgattatcacaagtaatatataaattactagttgagttctctctacatgatcttcccacgggataaaataaatacgatacccttggaatactctcaggtgaaatgctacaatggtatatccgtgcgcttg

SEQ ID NO: 73466 - DNA, 11550 bp, Oryza sativa
tcctgcagcccggggaagcgagccgagcacaggaggagtggggaacggcggcggaaatggcggccggcagccatggaaagcggccggagttggcgcgtccattcccggcgattggggacgccattcaagggggaattaagggggaaagagagaggagggaaaggggattaattccccctaatcaattttggaattcccggtttgaatcgcgcggatttgagggaggaaatggctagggttcacggaggagagaggaggaggccgggcgggaggaggaagacgacctggcacgtgggccccacgcgggcgcgcggtcagcgcgcgcacgtgcgcggcacgggcgggagggcgcccctcggcttgggcccggaggcggcccaggaggagaggagggagaggcagcccgggagggagagggaggaggagggagtgggccgggagggggagggaaaaagaaagggaggagggaaggacttccgccgcgggccgggggagagagagggaggctttgggctagacttggcccaaaggaaaggaggattatttttaggttttctttttattaaactttgataattttttttgttgcttaataaatatttccggtgctctgaaaattcaagtaaaatttgagggctcattttagaccaaggagaatttaacaaaaattctccgggccatattcgaatttttcttgtacgtattttagtgtttgccaatttcttttcgaattttaatttattctattattccttttagggaatgatttttatttcgggatgaatttatcaggacatgacaaatccaccccccttacaagaatctcgtccccgagattcgaggtggctagcaagaagataggttgcgcggtcttctcttcttgtctgacttcttccgtcgcgtcttctataacaaacttgcctagcaaaacttctccactctggactgcttggctcgatctcctgttatagatggaatcttctcttcacctgacttttccctggttgcacctctagctgacttcgactgggctgcggcattggaagatggggcttcagttccagaacttcttataactcatatctttggagtcaacctcatacaagttaccacttcatgtcatgcgtcaacactagcttgtcattactaggataccatgtttgccatcataagaatatcatacttgtcatttacttctaacttgccaccaactacctcatattagctttcctggtctccaggtgctagctacttctgctatttgatgcaagggtcaataactttgcctttgaattatgtttctcaacagaaccaacttatcccactattatcttcatgttgtcattatttagcattcaacgtattcctttacaccttcgaccttgatgagttccttcccattggatcatctcccaagacatggcattgcctggtaaccggtgcttgcacttttcactccgtgtagcatctgataccgagttaaagatttcattccttgccttcaaagaaacacttttacctaggtcgtattgcttactcacgatttttttttctacctcaatgacaaggtgactgttgcagggtgattgctatcaggagtcttccttgagtgatgcagagcatgtttctgtttatcctttatcaatcatctttcggcctacttccttcctgctagagaacatatttgccaatatcttttatcaatcatctttcggcctatctctaacaggtggtactctttaatgtgggttgcggacacttctggtggcaatgaggtcctttggcctactgcctttcagtgaaaccttgaagtagttcatcaaaagctgtactgactgtcgttgcctttgatccgaaaaagacaaatctgaaactcttagtccaaacaaatgtctctctggttactcgcttgattttcttttccatcagcaggttggttattaactcgaggttagaacatggttcctctgaaatgagaccctaggtctcctttgacagtaaacacataatcccatatcagcatcttccgaaagagtcctcatagaacttgtttttgttacacatttctcccttattacatgaatacaaggccctaccttaaacaaaaagggaaggtgcttaacatcggtacattgcatcctcaacatgaatcatccataaacatagcaaactcactgtttataaacatgaatatatttatttattacatgattgctgcaaactcccgattacagtgataagtagcgaactgaaaatcacaaacatggatactcattctgattctggagagatatagctggcattgttctagtgactgcatccttgattggttctgtgatgatgtgataggactgcatattgctatcattcacaggagaagcttccttctgattgctgtttgaagcggatgacggtcttctgcttggtatcgccctccggaggttgattgccctttgctcggcctggagtaggtcggggagagacacaacttcttccatcgacgacaattctttgctgaggctgtcggtgcagagaatggttggtgctgaaggtattattgctatgatttattgcagagttaggtggagcaggaggaacattggtgctatggatgatatcgtcgatgttgctgttggagctgactagctgatgagacaatcgtagggttgttcgttggatttctacggtcttggtcaacaacacactgagttggcaatccttgggcacatggtttgtaccttcgcacagaaaacatgtcatcttgcgggtgggacactcccctggtggatggtcttcttcacaatgagggcagagtgtgagacacatgctagcaacgtgtccaatttctccacaacaggtgcatgcctttgattccatctcttcctcgccgagatgtcggggagactcatcttcatcatccgaggagacttgatctgacccttcactatcagatactctgccaccatggcttaggaggtgctgggtcaactgtcgtgcacctcgaaaggtatttcctctttgacgtctaggaatagttatccctactggaggccattcggtgttggtaatagtcatcttacgtacttcttcttcagttcgcatcggtgcttttctcttctgattcttactcttcttgcctttggcttgcttagtatgtgaccccacgtggtacgaaaggctaggaggaaagcatttcccgggattcaatggattctctccattgggctctctactttgcacactaggctgcaagcttgacttggtgcgaggaggctggtttagcgatgtctgccctgctaaaccaaaggaagaggcttgtttggcatatacccatggacaattcagggcatagtgtccttgttctctacaatcatgacaaaaggggacatgctcttctggcattggaagctcattgacctgggtggcaaatgctcgatcaaacacatactgattttggtcttgacttccaaccaatggtagctgtgaactcagcagcatgcttggaatggaccaagggtgtgcccttgttaactctcttgaggacagtggtggattgagttgaaaacttgagttagttgaggcatacccgctgacattctttcctttttctctgttaaacatctgttacagggattgaggtgagagaggaaacaagccaggaaagaatagaccagaactagagacaggaccttaaaggaactaactcttcttgttgatgtgttgtttgtttcacttattctgcaagttgattaagcaaacaacctagcatggttacatcacaacccaccgatgcaaaccacgcgctacacacacaagcaaggaaacacacgacaaacgagtctgccctagagggtggcttgggttctgcgacgggttctctaagatcttcactgcttcttcacagctagcttcactgcttcctccacttcgctagcggatcctgcagtcttccggagcttcggcagacaattgacgatatcttcttctccgcaaagctgaccatctagtactagttgaaatttgaagaaggaagaaagagtaaacattttgcaaatagcacaggggaaaggaggaaaaaggaactttcgcaaatagtttcatttataaaatatgtccttaggtattatccacttggcttatcctacagacgagatggctctgataccagcttgtcgcgaccgagaaaaatacattttcccgaacgctagtgtattaatccccgtcccagaaaaagccggggtacaccacacaaacatgatataaaagacacatctttattatatcgataatatttacattattacaaaggcacttaaggcctgacaataaaaaaataaccagcagcggactagcgggcctacggctgcatcttcacaggcgctcaactggggtataagccaggactccacctaagacttcttctccaaagcttctcttactgaagggggggggggaagattgagcaagaatgagtacaaccacagtactcagcaagccacaccggcagatgcatgattaatgcaagagggtacaaggggtaataatataggggttaagttttgtagaaaacagcatttaaaagtcacttagttacccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcacattttaagaattaaaacactaacttgggtacattgctaggcttgcccataaccgagggcgcggctattcgaataggttatactctgatcagaggtgtacatctttacccacaagatacatcttcctcacgtgtaaccacgtgccacataccaccacggtatacggacggaagacgtgacatagttcccaacccatcctagccataaacaagagtaccgacccaaccccacctacggccggaacctctgggacaggcaggcaggattgagcccctagcagcaggacaccagccctgtgccatgacatctcgactaccgggccacagctcgtgtagccttcatttgtcctagagatgtccatcgacccccgacttcgtccatctccatccgtgtacttttgtttataaccagactgagccacaaactaagccttacccgctagacatgtggaagtacggtagtgctttgcaacagaggcctgagcttaatccttatagtacccgaggaacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaaagttgcctaattaatcagcgaagcatctacctaaattcatactagtggaaccatgaatagagtacccactagttggggttttgtttatcctagggtgaacaagctaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacagggttctttaggttataagaaacattaggagacttgaacggatcgattcggagctcgtatgaccaagatatgatcatccgaagtttaatgctgttacatggagatttgcggattattataattaggttttgcaactataaaacatgtgtaagcgctagcctggaaaagacaggaaggctgtgccgttgacatgcggaccccacatgtcaacctaaaggaccacggtagaccgagtacacagagacggtccacgggtcgacagaagcagatcccgtgtgtcaactgaggcgagtggccgacaaacggactccactagacaccacacgggctgcacacgtggaaaccacgcggctaccgagcgggcacactaacacggtcaccacacgcacaagcgaacgactaccgacaccggtacacgggtaccggggtcgacaaccgcacaacgggcacgggcaacaccgaaaggacgaggacggggcagcgaaggagagatccttaccaccacgcgacgaggcgagggaacgacaacgacgaacgggcgcggcggagacggccaggaatgacggagatgaaaggcgaggggacgacttcggcggcgatccttggacgaaggcgagacgcggccggcgcaacgcttggcgacgcggaggcaaggacgaagacgacgacggggctgcagaggcacacttgacggacgcggacgacagacgagaatggcttgacggagggacgaacgccacgacaaccaggaatgacgagaggacgacgacaggaaccggcgaggaggtgatgagggcagacggcagcagctgcacagagacgaggacggcgcggaacacgccggtacgatgacgacgagggtggcggcgcagcgagacgacgagccggcgaggactaacgaccgaccggaggagtcgtcaacgaggatgaacggagacgacgacgatggagcgcggaggggttcggtcgaaggggaggcgaggccgagggcgaccttgccgctgcgatgccggaggtggagacggcgacgtcggccggtgcactggcacggcgaaaggggctgccggagtgggtgccgacgagaccgagggagaggcggcgcgcgcaacggcgttccgacgaaatacgggcgacgccgtggcttggccggggaagaggatggcgttccggtgccgggagaggtggtggcgacgtcggccggcgcacaggggacgcggcagaggcggctggaggcggaacagtggtggcaacgccactgttgccggcggggatgcacttccggaggtcttcgcgggaaacagagggcaggccggcgaagaggaggcggctgcgacgctggaggaggcgacggcacggccggccggcgtgctaacgcggcggcaggggcggctgaagacggccggtggcacgggagagaggggacgacggcggggaggtggctagggaccacgggagatcgcgggagggggctaaaacgatagaacggagcgaggggattccgttttatagcggagggaagcgagctgagcacgggaggagcggggaacggcggcggaaatggcggccggcgaccatggaaagcggccggagttggcgcgtccgttcccggcgattgggggcgccattcaagggggaattgagggggaaagagagacgagggaaaggggattaattccccctaatcaattttggaattcccggtttgaatcgcgcggatttgagggaggaaatggctagggttcacggaggagagaggaggaggctgggcgggaggaggacaacgacctggcgcgtgggccccacgcgggcgcgcggtcagcgctcgcacgtgcgcggcacgggcgggagggcgcctctcggcttgggcccggaggcggcccaggaggagaggagggagaggcagcccgggagggagagggaggaggagggagtgggccaggagggggagggaaaaagaaagggaggagggaaggacttcggccgcgggccgggggagagagagggaggctttgggctagacttggcccaaaggaaaaggaggattatttttaggttttctttttattaaactttgataattgtttttgttgcttaataaatatttccggtgctctgaaaattcaagtaaaatttgagggctcattttagagcaaggagaatttaacaaaaattctccgggccacattcgaatttttcttgtacgtattttagtgtttgccaatttcttttcgaattttaatttattctattattccttttagggaatgatttttatttcgggatgaatttatcaggacgtgacagtgacatggattgctgtccttttcaaactaattttgttatgtattgtaagctattgttttacaaatgcactttacatgtcaagggcgcgtggaactttaatgatatatctagacatatatttgtatgtgtaaagtgagttatgacaaatatattagttatcaataactgcatacgttcaaatgagatatgtagtaaagtgcctttacgacaatatgtctaatactacaacagtttagacattccgtgacaaaaatcttatgatagcctttaagaacgtcatcaattttatgaccactttggtgaaaaatctgaaagattagcttgcgtttattttgcagaggagttaaaaaaacacgttagaaacaaaaaatcacgaaagggaacgaaatcgtgacttaggaggcattgcttctcacaacagttcggctagcacgtattggcaacgatttgcctatagaactagctagatttttctcacggtactagatgtaagaacgaaaggacatttaggaggcagaacataagtgaaaatagccccttgctagcatcaaaccatggtccgattgtatcacagcggtcatcaacgataccagtaaagaacaaaatgcctacctattcactctcaggatagagcaacagctatattttgtgactttaggttaaaacaaatgaaactgatatgcatgggaattaacgtggactattaagcatatatgaattttattgaggcaataatgcttaatgtttttaacttataaattgatatttccgcgaccaggccttcaaatatgaaaattttaacttcaagttacgcggagcgtcttgtttcggtgacaagataagattgaattaacattgatatggcaaatggttcaatcgatacttacattttgaaaagtggatttataaccgcttgtcgaaacaagatttcggtaatactaaaagggggtggctatcaagctgcaaaagtggatgggtttaaagacaaggaattttatacaggttcaggccttcttaatcaagaagtaataccctactcctgtccgaggattgatccgccgagtatattattgatcgtgtgatctgggaaaaaaatcgtgcccctagaggcacccggacccctccttatataggggaaggggtccgtattacaaactacagtccatatccctaacggaatatgtagttacagataaaatacaatcgtaaccgactaggatctctgatatttccttgacatacaagtttagaatttaacccgagtccttctaaagatattctatctacacgtggcaccccattcccagtcggactatacatgccgtgtaggtagggggtatccataatctccacagtagcccctgagacctttacagtcgacgaaatagccttctgtcggagcgcaaaatgataatccaagtgcttcactttcttctgcattgatctccagagtaccaaaatcaaagactgtgaagggctaaaaataaataattaggtgcatcgaatagataaacctaattaggtgtagcccccgactaggtgagtagctaaaggctaaacacatagtcaaagtgcaaataacatccatccgagtggttttacaaccgaatcatccaaaatattatacaactaagcatatgcgacgtttaataaaacatccagccgactactttagctttaatataccaaaaatggaaatataaagaggcccgagtaaaaaatactctaaaggtccataaatcagcacatatgacaagaatctgagtaaaaactctcaaagatccatcaaatgtggtataaatatggcagcacggcaattaatgagtcgaaatagcctaggctatgactcatgccataatcaaaataagcatataacatgctgagagaatgactgttcaaaaaccaatcatctcaacgaaacccaaacagcctttgcagcctaaaaagacttacaagaagaagtataacacctttctgtcgggtacctttttatttgcatcgtagtaattccaaggaattatctaactgcatcaaaaaggattttaacagcattgggccatactattgtgagcgaaaattgccgaagcaaaaatgcctaagtccttacggatcacaacttagccacgccgataacaaaagggggttgaagtactgttttaggcccaggcccattagtactcccgataccctaataacaccaaaaaaccaaacgccgtttcgttttccccaccgaaactttcgccattttccccattcctcgctacagtgccaaaccactccggcggaactagggttctccgattcgctcaaatcccccttccaaaactccacagaaaccatccgcgcatccaccgcatcaatcccccatccatccccagccatttcgaaagcaaattgcatcatccaattcacatccatggtagaggagagagaaagcttcgagagccaatgggcgccctccgacgtcacggtggaaagcttgaaggaaatggtagcacatggtgttcttccagcgaaggagatcattggatggcgttcggcgtacgacgaagcattcccgaccccggacacacacgaggtcatggtgttctcctatttcttttacggtgggttctctcttccaacctcaagattcttccggtggattttggatttctatgggattagtttgcatcacctaaacccgaattccatagttcatattgccaacttcatacatgcctgcgaagcttttatgggcgtcaggccacattttgccctattctgctatatcttcttcctcaaaccccaaccgaacaagagcaagccatgcgtagttgggggtgctggatttcaactgaggggaactctgagccaaaagtatttgtccatgcccttcaaaacttcaaacaaaggctggcatgcaaattggttctatgtacaaaaccccgagcctgcactccccgagtactcctgtcttcctccagtttatcaggacacttggaactcacttctaatgggaaaggaagccgctcaggcgcttgccctgatggactgtatgctgaaactaaaggagcaaggtctgcaaggagaacagatcacccggcactttatcaagagctgactggccccaatcaaagaaagatctcgcacggcctttgaattcgacggcaagcatgaccctaaccgtgaagatcctgaatctcttgaatttaaggttatgaaggagagaatgtataaactcttctcaaatgcagtcgtagttagctattcacacttgctccagtggtgccatacaatgccttcaacccccctccagcggtatgcatttcaaatttcagcctttctcgaaagcatgcttttatcatctacaaagttgattgaaaacgtgaatcatc

SEQ ID NO: 73467 - DNA, 690 bp, Oryza sativa
aaagaaacttttctaaagataaaaggaaaacataatgtccttattggacactaaacatactttcctaaagattaaaggaaactaacaaatactggctaattaatagataaattgccatgccgcattcttcttgaactcggtcccttatggataagcttccttgaatagattaatttccttaaccggattctccaagaatccgactgctagcaacttgataattcccatcggtcgattccaagactctgaaaccgatactgactctaggccgatgatgacttcgggcttaccaaattttggtgttaacaatatccttatgtttctgaatctgaagaagatgatgtctccgaagtagcagcagcagccgaatgggcgagaaacaagaaggttttaacatgtagtcggtcaagaattcggggaaagatgagagatgattttgacatcaccaaggctgataaaatatttaatctactacttcggggaaagcagatccaacttcctactggccactcaatcccatcggttgatgaattagagaaaagaaaatattgtaattggcataacactgggtctcatactaccaatgactgcaagggtttcaggcagcagatccagtccgctattgaacaagggaagataaagtttgatgattcaaagaagccgatgaaggtgatgatcatccttttcctg

SEQ ID NO: 73468 - DNA, 2003 bp, Oryza sativa
  unsure (1)..(2003): unsure at all n locations
atcgcgcacaaggtgttcgactgacgggcgagggtggttgatggaatggattggtgaagcagagcttcggagttgcggggctatggttgttgatgatcgatgatgggcaaggaagggattggggtcctatttatagggccaaaagtaaaggatgagctcggacaccatcatcgccatggatgagctcaaggattggatatggcaaaggtggcagaggctgtgagggggcgggcaagatcaatttgagtggcgggaggccatgtttgaatacttacctgtgaaggattggcttgactgcgggtagaaatggctggcgacgtgttggcgccaatccgggcgtgacgcgtggcggcggcgagggttaaaacggccggctcgggtgtgattggtttgaattgtgagaggggaaaccaccttctatcttcaattcaaccttgcggcaagaattggcgcgattcatcccgggtagaatcaaaatcggactcggcggcagcgttggacgggagcgcacggcgtcgagctgtgatttcttgcggcagaggtcgtcctggctttgtcgtcgtcaagattggtgcggcggcggcggtctgagggcgtcggacggccgatggcgcgcgaaggcagtcgggcacgcacaagcgatctcgaggcctacgcgctgcggcgcagcgcgcggcaagataggacgctaggcagcgcgcgagaaggggaggagaaggccaactaaaccatggtttttgagtgggatgtggtccccaaggtccaaacctaaactttgtgcaaggttggatgggtgttgggctgttctagctgggctgggcatttcatcgagcaccttgagtgcaatgaacagtgttnttcaggacttttgaatattttatctagagagaattgaatttaaactatgaatttgaaaggttcactagggtttaaagtatataaattctcaacaatattaggataaactaggaaaataatctatagtttgaaatttgagagaatttgctcaatttcactaaggtttgaaaattagtagggttctaaagaagtaatacttgaaccatttaagaatcaaataaatttttagaacacactaaattaatgaaaagccagcatgatgcaatcaaattttagtttaaaatttgaggatgttacactatttttccagacgcctcttaagggacggcatgggaaaatatattttcgtaggaagcccccttaaaaattcccccagaagtctgagttaccgagttaccttctctttttccctcctagcactttaaaattttcaagtcattctaatcttctctcctctctctctctctntgaatctcacctcccctcctccacaaactcagtctgggcaaggaagcggcgcacggatgggcacgcgacggagttcggcagacagcgttcgtgcggcggcggagtgcaagtgacgggtgagtccctcctccgtgtgtggaaggcggtcggccgacgggcagcggacgggctcggcagagggtttttttcgtgatttttatttttgcgtgtagacaacataagcacccacacgtgaaagtagcgatttttgcgtgcgggtgacccccccccccggcgcacgcaacgatagcaattttcatagatcctctagtgcatgtgggttgttctaccgcacgcgaaaacctcttttggccatctgcaaaaatcaaaaatcacttttttgtactagtgacttttgttttggttccaattgttagataaattatattttacacaagtagatgccgatgtgggaatgatttgtagtccgcgtgtggaatcacttgaaagcttcctaatgtcaattttatgtgtatgggaatattttgatatcatttgttgtaatagttatattttacatgactaaccgtgcataagaaagcgcttaaaatggctcttgtgtcggttttgcacatgtgacaatgatttgtactacgtgtatcaaactgctcgaaaccccactagtgtatcctatctgt

SEQ ID NO: 73469 - DNA, 1342 bp, Oryza sativa
attgaggagcgcgaggatgtaatcaagaatcctgtacaaatggttgtgtttagcaggaaatggtaacttcagtcttctggtgggtatgttcttgagatttttttttgagaaaatggatcaaaacccggcctctacacccaaaaggatgtacacggccagggtatgctcttgagataatttctgcctttctggctagtttcctgctgttaaaagtaaaaccaatcattatcatgataacatatccatagaagaaaaagctcacctagaacaaacaatttcacccagctctccttggagatctattgccacaacctgagatatctgtcctgttctccataaaatgttggccttaggggtctattttggactttcagttctccataaaattcaacattaaatttaccgtaagagagataatttgactagattgtttagttgtgttcttcctgtcatagtttcagcttataaaatcattttatcatttactaattcgtcatgtgtatccctaaaaggctggttagtaggaaagcacttaaatgagaaagtttcgtaagaaaatatgctgcataccgatgttcgtatgatattttattcgtaatatgaacaatcttcttgtacgttatacactgcattcatgtaaatgttaagtcagataattcttgtttcaccatttagtctcaatggtttcgtgtggaaatactaatggcgagtgagtttggggcatcagtgctagacatcttctttggatgctccttgggttcctgaccactccataagtgtcatattgtatccagcacccttaagagctttccccttttgttactttctgtcttcctctcgcagccaagtgagccagaatgcctcttccctatcacctgtcacagagctctcccagcagcatcagtagaacctgtggcctcatatcacataagcaccatggatgctgcatgcctaccagaagtctatgaaaaatacttattggtaatccatttgataataggaaagttcactgagaatccatagcaacaaatcaaatatctagctcatggagtttcagcatcccttaatttgcagattggatccaagttacttgaatttcagacacgctttcatcgcatttgtccaccttccatattccgtaaaaccacgtcattcttataatttggacttgttcgaaatctcccttttcctgtaagatttgaactatccatgtacttatgtaataacctccttaaattacctactcccattgatgcaggctgcttcgctggatgcacctgatgcggcatttgtgaattgtgatcagcgctgctgcacctgacgaataattttgttttcctgt

SEQ ID NO: 73470 - DNA, 894 bp, Oryza sativa
actacatggttggtcggccatacatcccatcaaatttctgaaaggtagttaaggtcacaaggttagcatcatcaacagtaagaaaggctcacctgagtaagatccccatgggcttgtctgccgccatcctgtacagcatccgacgaagaagaaggcgccgcggccttgaattcccagccatcatcttcgaatccgtcaccatcctcctcctcctcctccgccgccgctaccgctgacccctcctgtgtacccacctccgcggcgtcggtggaggagggttgcgggtgagatccatagaggccggcgatgaggtccttgagatcagccggcttcgatccattggaggacgcgtgcgacgctccccgctgatccgcagccgtcggcggcagctcggccggtccctcctcctcctcctcgtcctcgtcggcgccgaacagggagagggggagcgggccccgcggcttctcccaggagggcggcttctccgccggggccgccgccgacgagccaccatccggattggatccgaggcggctgtcgacgaagtcaccccagtcgtcgtcgtaggcgccgaaggcgtcgaaggcggcggcggcggcgggctggggatcggcgaaggcgaagtcgccgaaatcgaggtcgtcgtcgaggaacggggcgggcggcggcgggaacgcgacggcgtccatcggggaggtggggttggggggaggtgcaatcagcaatggcgggtgcgtgcgtgcgtgcgagagatgagatggtgggcggttggaggagaagaggacggaaagcaagagggaggctcgatggtggagccgttgatcaagtcgccattgccaagctgtattccatcgtcagcgccagcaaagagaatgtgtctttttttcttatttt

SEQ ID NO: 73471 - DNA, 612 bp, Oryza sativa
gcgccacttgactgggatattctggagagatgcctaaatcatcacatcttgttagggaacagccgtttttgggtggcaaattgcctataatcttattcttgggcaccgcctttctcttttgatggcgtcacaacgcgatgttgagaaggatcgctaaccactagacaatctatttgggaccagaccgaagcacagatgaccaccgatgaatgacaggaaacagaagtatttcgcctgctccacagcatattgtacatgtgaaaagaaaaaccaacctgctgctggatcatgcgaaacggtagttccatgctgccatgtatgcgccatgtattgttttatgaagatatgcacaccaccgatctagcccggatatactggaatagtttattgggactgcgtatccctgacagacaatcccacctatattctcttaaatcatggaccgtcacatatgtgccacgatgcagacacagctctaacgataacttttgttcttctcattgcaacctatttgcgcattgacggcggtcatgctaccctggccacgtgggcaacgcacgatgcggtgcacgcacctctcgtcatggctggaatgatggcgtatatgccgta

SEQ ID NO: 73472 - DNA, 4220 bp, Oryza sativa
cattaaatatatttaacacaaagtacaaaaatatgatattgcatggacacaataaatcttgataataattaattatatataatcacttcagtatacaatataaagggaaatatacatttaaaaaatatgttaaaaagtatagatttattccattaatttgttgcgggcataaacaactaaaaaataaagtaggtaaataactatcctaatatttagcatttgcaatacacttaagaaattctcctgcaccgctagtagcatgctcgtactaacactacggtgacatttaataatatacgtgcacgttctatttttgcaagcaacatatatgtaacaaatctctacttatatatatctctcttatctactattataaaaattatatatatatctcttctctactattataaaaattgaatatgtttctaaattttggtatgtcatccgtgtttgaatcggctttaattttatatttcggttttaatctctactattatctttacctattaaaaatgttgcagatgattacatactcaactaaattttcgtccgtgcctctctactgacaacacaactaaaataaaccggactatgatgacttgtgttcactactccagtttccccacgtgcacagtaaacatgaaaaacggagcggtccattagtacgtaattaattaagtatttgctattttttaaaaaaaatagaataatttgatttttttaagcaactttcgtatagaaactttttacagaaaatataccatttagtagtttgaaaggcgtgtgcgtgaaaaacgagcaagatgggttgggaaaaagggtttgcaaacacaccccgttcggactcaaaaaagaaaaggccaatcaagaaaacactaatgactctactaatgaaccgtgactaattaacctatcaacactgtaattgaaccaacatatcttataactacctcaaaaatttgtaactttcagttcttcacatcaatttttcgtccgtgagtccaatcgaacgatggcctccgtttccatacacacgagtaactcatcacgtaagatggataaaacacaaattcaaaaatagatacaaaattcaatcagataatccaaaaaaagagaaaaagaacaggaaaaataataaaaaaaagcacaaacctatcttaatttattctaaatgctacctctgttttttaatagatgacggttttttaatagatgatgccgttgactttttctcacatgtttgaccattcgtcttattcaaaaaatttacgtaattataatttattttgttatgagttgttttatcactcatagtactttaagtgtgatttatatcttatacatttgcataaaatttttgaataagacaaatggtcaaacatgtgagaaaaaataaacagcgtcatctattaaaaaacggagggagtatgaaacaataccaacaaattttcggtatttctgaggtgaaagtgtgacattctatcgaagtctccagcactaagtgcacttctatgaaagtaccacatccaaaatgagcatgctaggcttgaatataccaattttccccgttggtaagaacattcccagtagtctgggcatagtcacaaattcagtgcgcctagctatgatgcttttgaaccatcctggacacaatacgatcaagcacattttgaactatgcaagaaggcaataaacaccatttatcacctacaattagaatcctgtctataggtgctatgaaggtgaagcaaaccagctccttcacctacaattagaacaagatattagtaagaaagaaaaatcttgagtaccaggaataaatttaaacaagaaaaccaagactaaggcttaattacatgtcaaatttattctaaattgaagggactctgcagctgaaatctaatatcagtaaaattacttatccttgccaatcattgcctaaaataatccaatcttctttattgcatttctatgtcaagaaaacaacaacaaaaaaatcacttgaaggcatctccaaccctccttcacaatttactgataagggcacatctttgagaaacataaatattacagatatgttagttgctaacttaagacaccacagctcaagttttgggatctccggagtaatttatgctgtctcttggaatgaacatccgaggtagataaataagctctttacatgatataagaagcaacaagaaactgaataatacctggatataattgtgtttccgaaaaacctacccatctcttcagcctgaatgaaaagcatgaatttgatgatgattactaatgtaattttatgaactttgtccatgttgtatctaaataaacaaaaataaaaaacagtattaagtggtggttagtctctaccaccaccatgggatcttttgtaacacattatttgaatattgagagaggagagttttttagtctaaactccagcatagaccaaaggttttcatactaaaatccagcatgaatccatgttgttgtctaaaaataaacatattaggtttatctaaaaaccaattctattcaaagcaatacaattagacaggcatatatacgcctcatcccattgcacgaaatcacattcagcagtatcatttaaaaaaatccgatcataaactcatgtttttttggtagtaaggataacctgacctgatcagtcagctaccttgtggagcagatgactactgctcttggtctccctggcttcgatgacatatccaaatattgcttcatcatgaggcaatagctacagaaatgaatgacggtgcaataaacacaaataagtaccaataattctgcataacatatttggggtgctacagacatatcaaagcagtattcaactactgacagattcaaaactcacgcatatgctcagctctgccaatcagggcaatctgaattatatttgctaaaacctcaacacaagtgagaccacatgattgcatgaatccttacatccaagtaaaggaaatgcagtactaacatttacgatttcagccgctaagttattatactgtaaagcttactaatcagtaactaaagaatgcacagttaatcatccctgaacagagccaagtgcatcttaaacagcagatgcgcacgtatcatcgagctaagatcctgcatatgtcaaaattaaccaaaatccacaccgcctagtttcgaactaagcaatagggaagattttgtagactgatgcaagcaaatcccaattcacaagtaaataacagtaaacttcaattttttgatcatgcactcaacatttgctacaggtggctacatcgatcttaaagtaacatcatgaagaatttaattattgtgctaacaagtagcatcttatttgggatgtaattgcactcctgccggatccaatgcacgacgtccagccattaatcctttgcaaagcccaaacaagcaagcatcaggcaggaatctagaggcagaccattagcaacaagaacagcaaagcagtgaggaaggaggggtgctagtgaatagtgatacattgttccaggaggcctccgagtcgtagtgccggacgagcttggagtggccggtgcctttttctgctggtgtgcctacgcgcgcaactatttcgataatggcttggccttcctcatctcggtcgacagcggcggtgcgggattcttgaggaggccggcgaagacgtcgacgacgaacgaagagatggaaacgcgtcacgtcgcgcatcgatggcgaggagtcacggtggcggcgtgatccttggcggcacgagagagtcatcggcggcgtcgcgacctgacggtggtcggcggagcagtggagggggcgcggggccgatgcgcggtcaggggcggatgggtgcgcagaggcagatccgcagatggaggcacggtgcgcagagaatccttgagggcgagggggtggcgtgattgacagagaagtgggggatggggtccatacggaggttgagggggtgcgtggtataatgtgatccgttggattggatgattctggccgttggatttgatgaatgagtaatgtaggtgtaagagtgggttggtgaattatagggtagatgaatagcatgatgatagtgatcagcctttttttcatttctcctgtagtcctgttgagctcgacattgctgtcatcagtccaacttctctgtactttttttttatgctttactgtcggcattaagctaccatagtcct

SEQ ID NO: 73473 - DNA, 2429 bp, Oryza sativa
ttaaggtgatttatacgtgcatatgctctgcgtcccaaaatcaaaatttatctcaaaatataataacttatttatctatattttctttttttttttgactgaagaaggtagagcacgcctccaccttgcaatcatttcattaatagaaatgaggttttcaggttacaagttagaggttatagttaacctagaacagaaagggaaaaaaacgataaggaagaagagaagaaacaaaaacaaaaagaaaagagaactggggggggggggggtggatttacaaagatataaacaagggttcttatatgtggtactggtacaccaggattgaattttctgcctgtttgatttattggttctcatgctccaaagatcaagggtgtctcagacttgttgtgtgatgtgctgtaggttgtcaagctgaccttcaaacactctgttgttgcgggatttccatagcgtgtaggtgcaagcagcgaaccaaattggttctattccttttgaagaccgattgctatctatgattgcttgaagaaaagccgagcttgattctaagttgttggccaactgcagtaagtttagttttttcatctatattttcttacgacctttcatcatttaagtttcatatctatcttattttctcaaccaatcgtaacatttcctcatttagtttcatcaactttctactcgtgtccaattctaaaacttcttatatcacggacacattagtactttgcctttgcaaattgcacggttgtaacgtactccctttgtccaaaaaaaacccaacctcgtactagatcccatccttcgtcctatatcccaacctcgtactagatcccatccttcgtactatatcccatcctagtatgaggttgggtttttttggatggaactacgatgcgtcccatcctagtacgaggttagtttttttttttttttggatggaaggggtacgtgtttgttggtgccttggtgggtccaaaaaataataagacgcccctgggaaacatttttcaggcgcataacggtgtaacatgaggcaagaaggccagcttgctctgcatctctcagggcaatgtcactgcagaaaaatataccaacggatgtgggcatgtggcattctagacttgtactattattgttttccccagctgacaaccatatatcaggtcgttcgaacagctaatgcatagtatacacaatataagactaaaatgtactccatatctcagttcgcatttcatgtcaacaatcatagtcattaacatcaggtacctactgcataagtgcaaatgcagacttgagaatgtagaccatttcatacaagtaacattacagcaaacatcagcgatgctatctcatattagtatcaaagcagaccatgaatacaaagctgttgacttagcagttatatccgtgcaacaaaaatcacagcgagaccagaaggaccagacaaatccaccttcctgatcatctcttcttaaaaccatatttcttgcgctcatagaagagatcggtcttggcgcttccaaggttgacaatcttaggacatccatctcggtccttttcttgctgagtgcactccttgcagtagtaagcatctgagatgccaacccctccacagataacacaccttccctggaaggatccatagttgcactcatcacagacccgaacaagcgtacacgggcgcacgtaggagtcacagatgacacacttgccatcacatttctcacataaacgaccaatcgcaatgccaggctgcttcctgcacatgatgagatcaggatgatgctttgccatggctgtcaaatgctaacctgcagaaccataacagagtgcaaatatagattaatgctggtaataagtcagtcaggaataacaagcaatactgactacagactttcaagtgtataatttaataggcacatcaatcaaacagcacaatttctaaaaaaaaaaaaaaattcaagacacatggttgaacaaatgggttactgacttactggtactgctagaccacaaaggaaaatacatccatattgctattcagctattggtttaaagactcttatgatctctgcatgtaataccccaagagattacggactttccagtggaaaatttaacatgcacatcaattgatcggaacaatttaaagaaaaaaaatcaagacgcatggttgagcaaatgggttactaactcatggctcccatcggttgcccatttggccaaaatggcttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggc

SEQ ID NO: 73474 - DNA, 5686 bp, Oryza sativa
ctatttacttgtgaaaaaggggtcatgtctctcgattcacaagtctcagattctcataggtgtaatatggcatacatggtaaaccagctttcaccgttaacttaaaacttattccctccatctcaaagtgaacttaatttgggacggagatagcagtacctctgaagtgtgcagccatatcagcattataatcccgaagtcctgccttttcgcggttcgatccatcgctaacatacaacgatttgtaatggtttataccaatgaaatcggcactcccacggatcaactcagattgttcttttgtgaaggatggaatccgggaaccggcttgcttcttcatgatttcagggtagtctccatacaccaaggggtccagtatcctaatcaggaatggtcaatttcaagtctcctcatcatctcattgcatataatcccccccaccccccaaaaaaaaaatctcattgcatatataacttttgtatgaaaaatctcatcgtatatataattgtatatggtcaatttttctttttaaacaaatttaagaagtaaaagaacgtaaaagaaacggatcactcaccaaccaatcgtgaagtccaatactctctgaactgcgtcaatgtctgcacagctgcgggagagcggatagggccagaagctgtagatgttcgtgccaacgacgcccttctgcttagcctgcaatcgttgacgcatgttggtaacaatagagcaatctgcacagatcttttcgagctatctttcagttctgaaaatctgaacagagttcagctgtgcgttcaggtcttcaaattccctaaattttaagtagcaaaaagtccaaatatccttctaaattttggatggaagttcatgtaatcatgagctttaaaatcggacatacaacctcttaaactttacataccgttcatattaccttctaacatggttttagatagtggttttgcatatttgggatcttaaaccagtggctttaaataactaatataatatatgtatcgtcaattgcaggttgtcaatttatacagtgatgtcatactattgttacgctggtacttttcttctaaatacgagcaaacaagaggtaaaagaaaagatttaagtgaaaattttaacatatgtgcaatgcgtatgttacatgataaaaactcagccaacttatatgcaaattaaataaaaacgactttataaaaccaacttagagggcattgaatggtattgtaaactttaaaagttgaatgtccaatttaaaacttcgggatgctagatagattttcaatcaaaatttaggagggttatttggacgtttttctttcaggtatagcggtaggatgtgtttcaggcaagtgatatctaaatttataaatttagtaaaatgaatgctcagatttggcaaaaaaaaatagctgttcaaaatttagcattttgaaaagttggtttaaattcagtagaaatttattcaaatttcaaaatttttccatcgtaagttccaaaattcagaaaatttcggtcccccatgaatgttcttaattacattccgaaatgtttttgctcactcgttcactcacctggtacttgtcccagtacagcctgacagcggaggcatgagccaagatggagttgtgtgcggcgaagtacggctccacggtggagtcgccggcggcgcagctggtcccgaacggcggcgagcagcggcacggcgggatgacaccgctgtcgtagccggcgatggacagcacgttgggctcgcccacggtggtccagtgcctcaccaggtcgccgaactccctgaagcacacgtccgcatacgccgtgaaatcctcactgcacaatttttttttctccaagttattacaatttcagagcctcagctcatcagagctgggtggtgatcatcatcggggggttgatcaaagatcgaagtgtatatcttacatgatccttgggctgagccagccattgtactcatcttgaagagcttgagggaaatcgaggtggtagagagtcacatgtatctcaatccccatagaacaatcacaaatttctcctttcttagggattgcgcaaaagatttgtgcaccttagagtttagcaggaaaccaccaagaatggattgagtgatatataaatatacgatattattctgtcgaacttttgaaattttatctatcaacaattctcgaaatattaagattgaaaaaaaaataaaagttgtatgcgtagatttttctttataagcactttagaatattataattttgttacaaattattcttatattctaatagaaaaatagatgtcaaagttacatactaaagacccaataaaatcaacaaagtctatatttaaatatggagctattacaatgtttcactaacaattttgctatatatttatcgacaaattttcccccaaaaatttgacagatgtaattacagcacaatcgtagtgtaattacactgtaactataatgtaaattgtatgtaactttcaaaaatctctccataacatgttatttcggtaaaatggaggttgtgggaacaaattctttcacatatatgtgtgctgtaattttttttgttcctcaccaaaacaaatcttgtaatagatctagcgattcaaaattacgtgaaacttacatataagttacactgtagttacatgcaaattacagtgtaattacactacgattgtactataattacatctgtcaaatttttaggagaaaatttgtcgacaaatatataggtggtcccttcactaacagctttaaaaaaacttcaagggcaccataatttctgaagaaaattggggagataatttgaattaaaaaataatttttgagcatactattccgttgttaatttatatgaactgaaaaaattatatatggtaaagatatgttgaagaaaaatcaagtaaaccagaaaattctgttttttctcttatgatcataaacagagggacttaaatcctaaaatccagtctgatatcacaaaaatcctagaaatacagcactatctgttcagagttaccccttttgactagcttatctatcaggtcattgtagtactcgagtcctttaggattgatgggtcctcttcctcctgtgtgatcatagaaaccatagattaaaagttaaaattacttaacagtaagggccagacgcatttttttgcaagttccccaagttaattgcggttagtatatattttcttactcggaataagcctagaccaagagatggagaacctgtaggcctccaatccagtatcactcatcaacttaacatcctcctgaaaaattcagatatatacttccaattagtatatattttgattagtactgcttggcaaaatttatttcaagcatacgattccgttgttacttctggctggtctctccatctttttaaatgtgcattaagcatatgtgagtgtgttgtaggcgctttgtgtgggtttaatgttaaaaacaaatatgcgagccattatcttattgaaaaagaaagagtcgattgatatccatatccaatactgctaggtaactacgcatctgattgggtcagagaattcatcaaatcccagaacaaacacacggcatttaaaattacaaactactccttccgtcttaaagtatattgttctagtattgaattagacataatcaacccctctatccagatttacccgtgccaaccaaattaaaacctaacaacattttgagcttatcgattgtgcatcaatgtgatgtgctgtacactgtgcatgccttctgcctaccttgtatttgtggtatccggcggcagcccgatcaccagtgctattgtccgccatcctccctgcaaatatcacaaccagatggtcggaaaatctcaaagatcgatgtagcgcactccctatgattccaaatagaggaggttttaggcttgtacataacaattaagaaaattgactcaaattatagttgccctaaattttaactaataggaaatgtaaaccattggcttgtgcgaggagaagcatttatttgagaagggtaaacatgaaagaaaatatgataaaaaaataactaaaagttctaaaacaacatagggaacctttgaaatggaggattgacaaaggattttggaggattcaattttcttaggatcctgtaggccactttgattcatatatatgaagaaagtatgaaattttgcatagaattgcattcctacaatcaattccatatgaaaataagtaagagaacaaaactcttgaaaactttactttggcttaattctttctttgatacttcgatgccttcgttttttctgttctcacgtttttcatatcttatgtttcaaagtgacctcatgctcaaaacgactttgaggagctacaattacctttatgtttgggaccatagaaaatataaactttctgttggacacatatatgaattttcttgatcatgtaacttactctcccatcccataaaagacagacctattacgggatacgacacattctaatagagtctatcattcgtattactaacatgtgccacatgccatattagatttgtttttttatgggagagaagagtagagattagtagctaggtagcttgatcatatatgcatggatgcaggtcctctgcagtactggatctcaattgtatatgcattcgctacatgaacttacaagtagtgatttaattagtaataatggatgaaattaagatcgattacctgaatgagtaaaagtgtcccagatgcttggggtccttccgtcttcaccggtagccccctcatactgtaataaaaaaaataggaagcaaaaactacatacatttatgcacagctaattaagaaccaaggctccaagcaataaaaacttttttttttttttacaaaaactcaatggttgactgatccaaagtcatgtacaattaaaacgatgagtatatccgcggtctcagaaaatcaattaatggcatatatagttatacactacgtacagtccgtctaaatctggattgggattcgatgacattgcgccggtgacattccccgtgacattgagtcactgacgtgtgggacccacgtggatccagacacatgtgggtcccacatgtcagtgactcaatgtcacgggggaatgttattgaatctgcgtccctaaatcctatatatatatgtaaatatatcatatatgaaaattaattaagcttcgtcatgttaatgtgtatactccctaattaacatacctggtaagcagatgtgccggcgccgaagacccccggggaaatcctgcctcgtgaagttgagagctgcctccgccgtcgcctcgccggcgacgagcaagagaagcagcagcagcagcagcagcaggagagagacgagcgaggaggtgcaggcagccatggcaaaggtatagtattaattacctcctctcactggtggagaaactatctttcgtcggccggccgatttccacaatagtcccgcatacaataaaaaccggggctaaagatgatctttagtcccggtttaaaagggtaacggacatatttgatctttagtcctggttggtaacaccaaccgggactaaagatcatctttagtcccggttcgaatgctgtcagggcatgtatatatgtcttcttcctcctccagctgcccgag

SEQ ID NO: 73475 - DNA, 647 bp, Oryza sativa
tggtttatattagccctaatcaatccccacgtgcttgatgaatagtctgaattccagataatatccgtggtgattctctggcagatgtaatctgacatgacctcctcctactaatagatagattgaattctttactaagcagagcattgtgcaccaagcataattatatccgggccttcatcagcaatacgcagtgagctcgaaactgattgaattttcagtgagcagtaaacgtctctctcttttctatctctagcgtgattttcgagtagcagcaaatgattcttcccttcgccggtaaggttcgggtcacatacctatacgcgcgaaaaacataatggctcattacagcatgtttctcccgttacatattaaaccgctttatacttgactattttatagaatagtttagatcgatagcccaaaatgagtttcgttcaatatatcttgataatatgttttctgagggaaacgatgtgatatttttacaaacatccaaatggagggagtgatgaatgaacgatcagcttaaatacacttgagcagtagaatgaaggctgtttttaaaagtattgtgcgtatatatcttttgataaaccaatcacttaccggctgggaaagtacctaatacagagtttatgtagggc

SEQ ID NO: 73476 - DNA, 696 bp, Oryza sativa
gatcccccgtcagctacaaaatcttgtacaggaatatatggatgcggatcctatacctagcgtctaacattccacaggctattgaaaagcttgccccaacagatatagaggctccttaagggacttcagatccaaagaatgaccgaattgaacatctgctcatatatgacaaaacagctgatcttgatatatgcttgccaagagtgaatgccaagtgctctaaggaaacaacaagcagttgtagataagagtggagcatggaaaaggtatcacagtgccatacaacatgtgccatctaagcacaggatggcatccttttcatgatggaataagttcacgcagatcgtgaccatatgatcatactctttgtgcacaggaactgataggtcaccaggcttgtggaaatgaaccgtaaaaggatacctgtttactctcatcttatgcccaactgcttctcatgcttgtggtatcaaattcaagtacccctggatcacagacacacaggtatactttagaataaatcaacactctagagacacacaaacattatcggccactagtcccacccacacatggcattactctcagcaacagcgacaatgcacacccattcacccaggcatgcccactgccaagtgccaacctatattcctaagatggacacctgttgctgcgatttttgccatcattgcaaca

SEQ ID NO: 73477 - DNA, 713 bp, Oryza sativa
aagttcctccagttaaacaaattgccaagtatccagtgtgaatgatttcagtccccaaaaaccatagtacaaagaagaaaatccacgacagcatgaaattcatgcttcacattagtatgattcaagaaaagacagatagtgaattgtacaacatgctcagctggacgaaagaaaaatgtgatcatataaccttttacctttatcaccgcattgatttctttgtgcgtcaaactttttataataagaacctcatcagctgcaacaaaagcaggacagttagactcctgtttaaaagctcatctagtggtgactactataaaaagtgatctcatgcatctaaaatttattagaagagagcaacttaagtgaagtataataaattcctataagaactagttaagctacaaataaaagttatctggtgttattacacaaatgtccttgtatggaataatatattaacatgtgagaccaattattaatgatgtagtatatatttgtagttaactattgtattaattgactattagattgactataaatgatttagagttagtagttggctatactattaaacttgctcttaggccatcattactccatcactttacaagaaacttgctcttaggccatcattactccatcactttacaaggaacgaccagtgcaacgaacttccatccatacatcacagtggcttttaggtggctcaa

SEQ ID NO: 73478 - DNA, 1510 bp, Oryza sativa
  unsure (1)..(1510): unsure at all n locations
ttggataatgttcaaaagaaatttagcatgaatgtacttaaatatgatgaattattggaggtacactacaattagaaatagagcattgcctcgaggttaactaaaaaggtattcagatatgatcttcagtatcccatccagcttgaatcccatcctatactaactcgttgactcaaaaaagaaatattaactaaaacaacataataaataaataaaatatactactaacatggactctagccaccatgatttgaatcctgacaccaacatatattacacagatatagatgcacatttaatagaattttagagagctagggattttgctgctggtctttatcttttaaccatatgttgagagtacattcaggtgtatccgtgaaaaaaaagaacatccatgnaattgcattacgttatcaatatattaggtgattncgccgtgctttgcttgcggaaattactaagtaattttcaatatatattttctcgttacaatcaagataggggtaaagaaaacaaatgaaatatcagagcttatcagtatttatcatgaaacaaacaaataaaacccgctttaatgtggaacatattgataagtttattttaaatattatacaaatgatagatagatttgtaaaaatattgtggaaatgatgcgaggggtgatgattggatatgtttgcatgttgatttgtagaattaaataaattgtagatgatgttgcatgcttgcatgaggttgaatatataattattgctagtgggtgatgatttggcatggctgtatgttaagctttagagttagtgggttataactttatagaaagtatagattcattcatttgcacgcatgtggatggctgggtaccatgattattgccattcaccctctgtcttctttcgcataagaacatgttgtggaggaaaaaaaataaggtcaaaatttaaaaaactctatgaagctgttgatgcgaaaaacacgaggcctggaagatctgcttaactttagtgcaggtccaaaaattttgcttttaggttcgtgagcgtgccagttgatttgatcctgcaatcaacaagaaataaagacaaagaaacagcggttaaatccataaatgatagccgatcggccagccgccgatgacgtatcatttatctttgagtcgatgtcatatttgaatcgatcggcagttataaacaatcaagatacaactaaatctattcgatcggctgtagatattaatgatatataatctttctgtcggtgtatacttaaatcaagtgattgggagacaatataaatcacttagatcgaaatatacattaacaaggagattataagcattcatagcatagccgatcagatagatctagcatctatcggctaatactccgataccactctatattaagatattaaagcaaataaaatatatcgaacagaagcctaatatactttgttgtagtaagatcttaacataaaaggcagatctagcatatcaattaagcatgta

SEQ ID NO: 73479 - DNA, 1466 bp, Oryza sativa
agtgttttcctcgttttccgtcggtggccgatgcctgaagaattcaagagcgaataactgaatatacctcctcaagactcaaagttaagaccctgtttagttcccagaaacttttcgtaaaaacaacacatcgaatttttggacacatgtatagagcattaaatatagataaaaagaaaaactaattgtatagtttgcatggaaatcgcgagacgaatcttttgagcctaattaatccatgattagctataagtgctacagtaacccacatgtgctaataacgatcgacttaattaggctcaaaagattcgtcttgcggttttcaggcgagttatgaaattagttttttcattcgtggccgaaaaccccttccgacattcggtcaaacgtccgatgtgacacctaaaaaattttcatttcaccaactaaacaggccctaagatcatatggtagactagtcttatgatatgtatctgaagttctgaacttctccatcgaaaaaatcgaacaagtttccgagcttcttcttgacagagttctgatttctgaaactctgaagtctgaacgcttatatgaaatgatccaccggtgatgttcctttcagacttgatagttggaagctagctggttgcaaacctgtgtcacacgtagtctgaaactggatgaaaggcaatcacatactcacatactcacacgtagtctgaacttctgatcgattatgcaaaatgaaggtaactggggaagttcatgacagtctgaactctgaaccaaagcaaagtaaatcatgtggaagatggatgatgatatttcatactcacccctacaaatgatcccgcacacaacaggtaaatatgaaccaagaaccgcagatgcacagcaacattcaatcctatatgcagcgtataatatatcaacggtgtgcagataccagaagctacggtagtttactctgcaaaacgattgtaagtatcccctccggttttttagatggcgtctttgacttttgaacatttttcttactaaaaaattacataaatatcacttatttagttgtgtttcggtttatgagtaaacacactttaagcatgacatatttttttcctgtttgcactttttttttagtttggatgaatggtcaaacatatgtcgagaaatcatcggcatcatctattaaaaaccggagtaaagtaccttttatcccaaaaaaataagtggtagtctactttcatcgcagtttcagatttcaggagaaggggagggtcaaaaaatagacaacaaccaccttgcctgacggaaagtatttttctatacctaggtgccacacctaggtgccatggcacctagatgtattcatgtaatttaaatagttgcataaaaattcattgaggaacctgatcagtaaccaggcagacagcaagctggtgaagttcagcattctagtttgatttcaccacaacatgcgagct

SEQ ID NO: 73480 - DNA, 2070 bp, Oryza sativa
agaaggggagggtcaaaaaatagacaacaaccaccttgcctgacggaaagtatttttctatacctaggtgccacacctaggtgccatggcacctagatgtattcatgtaatttaaatagttgcataaaaattcattgaggaacctgatcagtaaccaggcagacagcaagctggtgaagttcagcattctagtttgatttcaccacaacatgcgagctagttactacagagcgaaatgaagtactagaaagttagcgtgattctgaaacatgaatacttggctgaaatataggaacatgcacattgactgatggtcagacacataagtacattaatgttatgtatcataaatacataattcaaacttgagaagaatacatattcttagtttcttcagacagcaaagcaatagatcagaattgtagttcagtttcaccagaaagcgtgaaatgcaacacaaattagtcatgattatgaaacatgaatacttttctaacataattgagcgcccctgtacagaaactcatatacatatcataatactagaggactctatcatgagatttcttcactcttaatttctgcagattagtccttttttgtgggagttcttttccttcaatccttgtgtagaaaaacgtcaggaacagcagctgggtcgagctcgtagcagtcatggagctttccacctttctcttttgtcagacaaaacgatggtattcgatgagaaaacctcaggctctctttcacaggaatcttcagtattccccttcgtacatcaggcttgaacacagagatgtaaccatcaactttagtcagataaccaaataatgtgaaagcttcagtggagtcgacgatcttgccaatagcatacttagtaccacgagtgctgcgggaaggaacccacttatttgaccagttcttgtagatggcccagacctcacctatctttggatgaatttgaaccttgcactttgctccaatttgtttggtttctattaaatgggagaatgcacaattttcattaaactttgtttccatgttttggatttcaaatgtaccacagctcacaggtacatcatgctccaaccagagcttctcctacgcttgttgagggcaagcctcaagccaggccaaatccgcgttgaacggttccatctcaactttgcttactagaggactcaagctttctcaatgggggcaaaagaaaatcagctacttcaggctacaaattcaaattgcaaatgaagatattctgaggttagatgtggcacaagaaagcaggttgctgaccgaccttgaacgccgactgagggctgccttgaaggggaaatgtctcgccttggcctctcttgaaagaataagagtgagacaaagagcaagaattcgaaacctcaaggagggtgatgctggcactgcctacttttacatgaagttgagggcaagaagaaggaaggctttaataccaaggcttgagcacaatggcaaagtggccacgacacaaattgacatgcaacagttagcttgcgaatactttgaaacaatcatggggcaggcagaaggtgattcaaagcaatttaacttgcagtccattcagatggctaaaggaaacttggcatcctttgatgaaaacttcactgaagaagaggtctgggcagcaataaaaaatctgccaactgagaagtcgccaggccctgatggatatacttcgctcttctaccaaaaatgctgggctgtaatcaaggatgaccttttggcggccatggggaaattctgcactggaaatagccaaaatcttgaattgttgaattcagcacaaatcacactcattccgaagaaagaagcgccaaccatgttgaaggactatgggccaattagtctcattcatagcttctccaaattggcaacaaaagtaatggcacggcggctggcaacaaggttggatgatctggtaccccacacacaaacggcattcatcaaaggcagatccatacatgaaaatttcatatttgtcaaaggtatggctcaacagttccaccggcaaaaaaaggaagttttactcctgaagct

SEQ ID NO: 73481 - DNA, 3812 bp, Oryza sativa
gaggccaacccgccgaccgacgtgtccacgctgaccgtcgagatgaccgaccagatgtggcgtatgtcgttgccggtgggcgcgaccagggaccacccggtggcgaacccgttcggcccggagagccccagcctggaggcggtggcgctcccggcggcgctcgtcgtggcgtccggcggcgacgtgctctacgaccgcgtggtggactacgcggcgaggttgaaggagatgggcaaggcggtggagctcgccgagttcgagggagagcagcttggcttctcggccgccaaaccatcgagcccagcgatcaaggagtaaatccgagtcctgaaacggtttgtgcaccaaggcatttgaatgctcgtcgtcgaaacaagatttcggcaataataaaaaggggtggctatcaagttaggaaagtggataggtttgaagacaaggaattttatacaggttcaggccttcttattcaagaagtaatacccaactcttgtccggggatgattccgccgagtatgttattgattgcataaactggaaaaaagatcacgccctaagaggcacacagacctctccttatataggggaagatgtccgctttacaaaatacagtccatatcctaacggaatatgggattatagataaaatacaatcgtaactgactaagatcccgagtatttccttgacatacaagtttagaatctaacccgagtcctcatagagatattctatctatatttggtaccgtatatccgactaaattataatgtcatgtagatatggggtatccataatctccacagtagcccccgagaccttcgcagttgacaaaatagccttctcgaaacaaaaaacaataatccgagtgctttaattcaacttgctccagcttgccgagtgctaaaatcaaaaactgcgaagggcgaaaataaaacatggtgcatcgagtagatgcacctaattaggtgtaacccccgactatgtaattagttgaaaaactaaacatgtagtcaagaaccgagtggttttatagcgaagcatgcatggtacttagtaaaatacccagccgactgcttctcaacttgaacatatcaaggataaaaaatacaaaaagggccgagtgataaacactcaaaaggtccaaaaatagacatatttgataggaatccgagtaaaaaactcttaaaatgatccaccaaacatgataaaaaatcatggtaatcaatgagtctaatagcctaggctatgacccttaccataactaaaataagcatataacatgctaaaagaatgactattaataaaccagtcatcttaaatcaacccaaacagcttttgcagactaagaaagcttacaaaaacggtataacacctttctgtcgggcacctttttatgtgcatcataataattccaaagaattattgaatcacgttaaaaaggattttaacagcatctggccacatcatcgtgagcacaaattgccaaagcaaaaagcgcctaagtccctagggatcacaacgggccacgctgattataatattgggctgaagtactgtacaggaccaggcccattagtactcccgataccctaaaaacaccgaagtccaagcgtcacatcgtcttccccgccgaaactctcgccattttccccatttcctgctacagtaccaaactgcgccggccaaactagggttcatcaatccgctccaatccatcttcaaaaaccttacgaaatttctccccgcgtccaccgctccgattccccatccctttccagccgtatctcagaccaaattaaaccatccagttcacattcatggcgaaagaaagagaaagctttgagagtcagtgggcgccctccgatgtgacggaagataatctgaaggagatggtggcgcacggcgttcttccagcgaaggagatcatcgggtggcgaccagcattcggcgaagcattcccaacccccgatacgcatgaaatcgtggtatttgctcatttcttctatggcggtttctcccttccaacctcaagattttttcggggaattctgaatttctatggaatcagcctgcatcatctgaacccaaactccatagttcacatcaccaatttcattcatgcctgcgaagcctttttaggtattaggccacatttcgccttgttccgccgcatcttcttcctcaaaccacagccaaacaagagcaaaccatgtgttgttgggggggctggtttccaactcaggggaaccttaagccaaaaatacttctctatgcccttcaaaacctcaaacaaaggctggcacgcaaactggttttatgttcaaaaccctgagcctgctctccccgagtactcctgtcttcctccagtttatcgggatacttggaactcactgccaatgggagatgaaactgcgcaagtagtggaactgatggagaggatgataaagctaaaagaacaaggccttcaaggagaacagatcacccggcactttatcaagtgtcagttagctccaatcaaagagagatctcgcacagccttcgaatttgacggcaagcacgacccaaaccgtgaagatccagattctcttgacttcaaagtcatgaaggaaaggatgtataagatcttctcaaatgctatcgttgtcagctattcacacttgctgccagtcgtaccgttcaatgcattcaatcctcctccaccggtatgtattcgaacgttccaaccttccttaaaaacatgatttcgtctcttgttaaattgcttgacatttatgctcaggagttcgcattgatgaagttagatcctccaatctcccagcaccaatcacctcgccgccaaactggtcagggaagcggaggaccaagaattcggtctgaaacccaaccaagtgcttctgatccagtcggccagtcagattctcgcaagaggaagctggttctaagtgacgacgaaagcgatgataccggaaagctcagagataaaggagtgaccagaagacctccgaagtcaactaatccgaagaagaagacctctaggcgtcttgtaccaaaaatcagaaagtcttctaggtacaaatcatataacaatcttccttgtattaatactctcccatcatgaaaataacactgatagcaaaacttgtaggaaaccatctgacatagatccttctgagaaagactctgacccgactaacatggaagcggattcctcaaaagaaaccgggctgactgcaaaagatcacccaagtgataatccgcaggccagcgactatgtaaaacccagtgacaaacccacgactgcaagccagtcggccgaagctggagtcggagttaaccaggagcccccgactgcaaaccagtcggatacaaggccaagccaaaagattcccgaggttgaagcttaaacaaacagtcctcccggaaaggatgctggcaatgactcagaaaccagatctcctgtgaagacacaagagtccactcgtccccgaccgggaatcatcacaggtaaacacgctatctgaaatcatttcaatccaacagactttatttgattgcttcatctttattcatgggtacactagggccaatgattggtgatgaagaagagatcctccggatacgagcagctgaggattcgcgccctcccattctggtcaagtggtgggatgacaacatgcaacctcaagggatcgtaataaataagcaaaaagaggacgaagagttatgcctactgaaaaaggcacttggtcaggcaacccgcattgtaaatgtaagctctttggcgcctgatctcaaccatctcgtttgccat

SEQ ID NO: 73482 - DNA, 4301 bp, Oryza sativa
tatccatttgctcatatgaaatacggagtattttacaaggatatgaaaagattgcaacttagaaaaggtataggtaacatttttacaacttgtaaaggtattgtgaaaaatcacagaaaacgccttttggtgcaagcaaaaccggctgcacggaatctcagccgttggatagtcacgtggacggaagcagattggcctttcgggaaggaataagtcgactctaactccctcaatataggtccgatttaatttgtatcctcgactgcaatactagatatgttgatccccaactacttaaaaactggtgtagtttggctttctggactgttttgacagtggttttcattggtcgattggcgtggctagttaacttggtcaaaatagtcgagtcaccatgtggggcccacatgtcaatgtttcctcctctcttaatatggttttaacagttggagtcattatatttgattttgccgttgagggatagatccgatgtatatttaagggactcaatgcagacttattcctttcgggagtactagtacatgcgcttgggcctgggctaagtgcttttcaattgggtattggaccatatttctggcccaataggaataactgccatctcaggctctcggctgcacggcccattgattggggaaatatgggcttcggccatcttttttcgaacacacaaaaatttatcatgtcatactagtaggaaaaggagtacatctgacattcgtcggaaatgggacaaatccaaaaatgtaaaggaaagctagcagcgaaaaaggactagacggcgaacagtactcataataggcttcgtccatcacttttgcaattttgaggtaaatttctcaatccttttgaaacgcaaaataacatgatttaaacgtattgaaatcaaaatattgtatggttgtgtcgtatcgcatgtgcatccgaacgccagactcgttagttctccagaaattcttacaaacaaaagtattgactccagacctcacccttcatatgccgtaaaaatggttttgtttgtaaaaatggcagcaaaattgtagaaaaagagcttcatgcgcgtaagaatgtcagaattgcactctgtatcacccgcttacgcataacgtaagtcgaaagctgagacagagcatcactgatgctggactcaataacttctttggatcactcaagagtctgatctcatcacacgaacattcaaactgtaatctcaaatttccggataaaatcatagctctatagtctatactagtaataagtacggtcatgtaaatttcgttgcaagagccaagaggtgcatggctacatagtttttgttcagtgaagttgttcttctataatactcagaaaagtaccaagtggttcttataaaactttttttttattatgtcccgttctgaaaagtaacactccttccatctttttctcaaaaaaaaaagagaaaaatatctactaagtcttgacagccaaagtcatggtttggcgatcaaggcaacgactaggattaggaagcttcgtgtcaaccgattaattatctaattaattaattagcccatctgcttacttaaacgaaacaaccgtgtttaattaggcactaagcgtaggcacactgaagaagtaaccatgtccgggcacgccgcgccggcgccgcacgtcgtcgaggactatcgcggcgtcatccagctcctcagcgacggcaccgtcgtccgctccgatgccggctccggcgccggcgccctgctgccgccggaggacttccccgacgtgccgggcgtccagtggaaggacctcgtgtacgacgctacgcacgggctcaagctacgcgtgtaccggccgcccaccgccggcgacgccgagaggctgccggtgctcgtctgcttccacggcggcggctactgcctcgggacgttcgagaagcccagcttccactgctgctgccaacgcctcgcgtcggagctccgcgccgtcgtgctctccgccgactaccgcctcggccccgagcaccgcctccccgccgccatcgacgacggcgcggctgtcttgtcatggctgcgtgaccaggccatgtccggaccgggcgccgattcctggctcgccgaatcggccgacttcgcccgcgtgttcgtcgccggcgagtcggccggcggcaacatgagccatcacgtcgcggtgctgatcggctcgggccaactcaccgtcgacccgttgcgcgtcgccgggtacatgctcctcacccccttcttcggcggcgtcgagcgcgcgccgtcggaggcagagccaccggccggcgcgttcttcacgcccgacatgtccgacaagctgtggcgtctgtcgctgccggagggggcgacgagggaccacccggtggcgaacccgttcggaccggacagccccagcctagcggcggtggcgttcccgccggtgctcgtcgtggtggccgggcgcgacatcctccatgaccgcaccgtgcactacgcggcgaggctgaaggagatggagaagccggtggagctcgtcaccttcgaggaggagaagcacctgttcttgtcgctgcagccatggagcgagccagccaacgagttaatccgagtcatgaagcgatttatccacaaagatgaaggttctaataacttctaaatccaagtaaattaagttggatcagtagagatgcatggttggtgttctcatgtggtctgaatctgtgttctgtttcatcttttgtgtaagtgtgcaacttcgattctgtaaaacttggcaagtagatgaacgatgtcatttatatgcgtgtagcttgtcaaaatacaaagtagaaacctgtatctgaataagatggcattcatgaaataatattatcgattgaacgaacgaagcaacagaatgatcttccaaattgaagcaaaggaattgatggacaacgagttgctgtactttggagctgtaaatctgtagtacttctcaacgatgctatggaccgtgggccgtccataatcgctgggtggaatgagcccactgtccatgtgcttctgcatttggcccgtgtacagcccatataatgtcgaaaaacctaatacgcgcgcgccgccggcgcgcgtttcggacccagaacgcctagcgccgctgcgccgacgtgcgcgcgtctccactttttttttcgttttctttccattttctttcctttttttccattttttttatttttttatctttagcatgttttgagtttgaaagtttttaatttttgagttgaaaaatttcaaatctgaacttgaaagttttcaaatctcgagttgaaagtttcaaatctcgattttgaaaattttcaaaattttcaaatcttgatttgaaggttttcgaatctcgagttgaaagttttcaaatctcgagtggaaagttttcaaatcttaaattgaaagttttcaaaattttcaatctggacttgaaagttttcgaatctgagttgaaagttttcaaatcttaagttgaaagttttcaaatctcaagttgaaagttttcaaatttaagttgaaagtttttaaattttgactttaaaatttaaaacttaaatcgaaagttttcaaatctaacttaaaaaattttcaatctgttagtaaaaaaatctccagaatttttctaattactattattagtgttaagtatattaactaatttagttagttaagagtagactaaaggggagagggagtgctcgctgctggtgcgcacgcgccagctagtagcccccatacaatgtagatggcttgtcgtggctgctgtggcgcatgtacccggatgtacctccaagaatcgtactagtagcatttgcgggcaaactataaactcgataaaatattctatcgttatttacacgtgatttaaatagttatgaattttttaaaaaaattatgtatattaaaatgtgatatatcaccctacaaacgtgcaatatcaaaattaatttccatatgtcacaactaaaaaaacaaatttaaatgtatatgttaattagttatagtttaatttgtttttttacaacttgataagtttaaattataacttgtatgtttgtggaatgatatatatcacctgtaaatatatattctcaaaagtatttttaaaattatttaagtgaaatgcaaacgacaaggcgataacctcccgatagtttaaaactcattctttcgtttgcgtgcgtgactctccaagtactccctccgtcttattaaaaatcaatctagtaccggatgtgacacattctagtactatgaatctgaacatacatatgt

SEQ ID NO: 73483 - DNA, 2497 bp, Oryza sativa
caaggaagcttctagatggagatgtgatgagcttgctggaccagaagctgtgtggtgaagcggacttgaaggaggttgagagagtgtgcaagatcggttgctggtgcattcaagaggatgaggttgatcggccgacgatgggtcaagtggtccagattcttgagggtgtcttggactgcgacatgcctccgttgccgaggttgcttcagagaatctttgagaggccgtcttcagttagcaccagcacaccagttttcctttttgtcggtagccctgaacgccaatgagaatacagtatcagtttggaatgtacagtatatctgaatgtctctctctttttcttttttcttttgttttaaggttgttatgtctgaaactttagttcatttttgtagtatgtattgtactatcacaccacataccacaagcagcttataccactgtaatttgatcatcaaagtgtgtatattcctgtattcattttgttttaagaaaaggaaagagattttgcagtcgagaagaaacaatagtacataccacaatatattcttgtattaatgatgcagttgagaaaaaaaaaactagtacctccaattttttaatatatgacgccgttgactttgtacataacgtttgtccattcatcttatttaaaaatttaatataaatatgtaaaagtataagttaatattatagtttctttgatgataaaacaagtcaaaacaaaataaataatatttatatatttgttttaataagacaaatgataaaaatcacgtcaaaagctaactgcgtcgtacattgaaaatcggagttagtataattttggggaaaatttcagagcagtagtttatgctagcacttggattcatttggtacttgttttcaagttccatatctgtgcaggggtcttccggctagctccacaaggtgatgggctagacgacctgggttcaaagcctcaccccttctaattatttgatattaggtccttccctaatattcgagtttttttttaagttccatctctgtgcaattatacaagataacatcacaatttacatccactgctataacacatcacgactttccataaactcatcgtgatctgcatatacaatcttggatccgtgtgtacgtacatgagctaagctaacaacaactctgcatagcacagagctaaaacggatcaaagaggaaaggagaaaacaagaacactggagagagaaagagcatgtgtcatgacttgatctcgccgccggcgacggcggcggcggtgggcgtggctgcaccgacgatggaacggaaggccttggtggtgcaggggatgcagagaatcccccgctgctcgtagccgaactcctgcaccgcgaggtcgagcagcgcgaggaagtgcggctgcttgagctgctccgtgcgcaccaggatcctctccctctcctccccctgcccgccgatcaggatcggcacgtaccctcgcggcgccctctccttcctccccctcgccatcgccatggccgctctctctctctctctctgtttgttcagtcttctcccttgctaagaatgcgatcttgctgtccctgaattatatagtgcttctttctcagaaagagagaattacttagtgtttgattggcattgtgtgtgtggttttgcttttttgaaggaaatgattgatgattggtgctgcattacgtagaaggcatacatgatgagcgtaaaaaaatggtgtgtctggtggaattgcggtctctgtcagatggaatgctttggtctgcagattttgaactttggagtatgtagcatgctaagctaagcactggctgtgttgcagataaggccctgaaattaagtaacccttgatatcttgtgttaactttttttttcctggaaaaatgggcatcttatgttcatagtgaaaggaaattggttcaggccggccagtggctgatttacctgagagatcttgcaatatgaacgtccaaaccaatcgaaatttgcttagaattgattagaatggttaatttgccgcgatcaatatttgaatagatcaattactggtcatgatttggatgtgtatatccttcgtggatatagagaccggattaatgaaaatctattttctaaaaaaaaattactggtcagggacctgattgatgatcagtgaatgagacgaggtcttggctgtgatttctcctcctggctgaatataaattatttaacagacgtggatgagatgtattatccattcttccttagtgtgatgctattaagattcatttgtttgctcgcattattgatagcaaacaagcgtacttcgccggatttgagttttgtttatgctaggtcaacatgatatggcgttgatattttgcatgcatcattgcagcgacttgtatctagtttatactaccccattatatctacttacctagtgctctttttgttgtggggatagagactaagtcaactcagaaagtaaggtttattatta

SEQ ID NO: 73484 - DNA, 1362 bp, Oryza sativa
ccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtcatggcacggggctccgcaccgctcgacggtagcgtgctgccgccttcccgcatcgtgagcgagaggcaggccgggctgccgcgccgattcatgccggaatctgccaccggccgggaggtggtcacgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgagcccatctctccggttgttccggtggttcttcaccgtacagccggtgtcgccgccgacggtagtcggtggctgctacttccagccgcgggggcaggtgttgaaccgctacattccctgcgtcctccgcaaaaagtgggacgactggaagagtgattggttctacacccccctcgtcgacgaagcgcgcctccgacttccgagccagcctccggcgcaggcctccagctggcaggcggcggtagatctgggagacggctacgacgccgttcttgaccgcctggtgggtctgcgatcccaggggctcacgggggccatggtgttcggtgactaccttcgccgccggatcgcgccgctccagcggcgtgcccggggcgcctgggagtacactgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgttggcgcgggcgggagccgcaggggagaacaatctaccccgggggggggtcgtgcttctgggccccgcgacggggacccgggggggagccgccctgccgacgcccggtggaagaggaagcacgagggtacccctcccccatctcctccccgagggggcggggcggtgcgtgccagcagcaggcgcccggagggtgccgtgccgacgccgcagcccgagggggagcgaaagaagaaacggctccgcaagtatgggggg

SEQ ID NO: 73485 - DNA, 2030 bp, Oryza sativa
cctgcagccccaagcgtactgacaagggcttctcttaacactctcctaaaagatatatgaatagcaagggtgagtaccaaccgtactcaacaagccaccacaacaacaatgcatatgatagagggtatttcaaggaatggcttcaggttcttttgcataaagctaattttacaattcttttcacaagcctaaaacctagcatagactgatcaaattttagtacagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatcccatcccccacaagttaagaatttagagtctagccaagtgtaatacatgtcctggtgctcaataaccgcgagcacggctattcgaatagatttggtttactcacactgcagtggatgtacactttatccgcactccgcgactgcccaacacatgagcctcgtcccaacacatgagacgcgtcacggcaaagcttttcgataacctcgcattggcagtatccgctccatgaacttaaatcctcatgcactctaggcgtccatgtttctagcagtgagaggagttctggcactcctgggaaagagaagtctcacacacatattaaattatggttcaagttaagttctctctctcacacactcatggcattcctaccaatggtgacaccgatgtagggcacgcctctcggccctacctcaccggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccaccccagtcgaaaacaattgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtgggatgttcatcattgcatgcaattttatttgtaaacaaaacaatttcgcaattgggatcaacatgttcaaggaatagtgatgacttgcctgctcagagtagttcttattcttaatataatcttgatcaaccttcacctcctggaagctgcatacgttgcctcacgactaaccgatacacagtctagaatacgcaagaaaaaccaatattcaagcaacaatcaaatatgcacaaacaaaatatatttgttgaggtcgaacttacagttgctcatattattcgcgcttgctaattgacggagagtgaggctcctcaccgggagaccgcgcaggcccccctttgccggttcggccgggggagctaagtgaggttcttcgccctcaatctgaggaacgtcagcgagaagaatcgcacaacacacgggcgacgtagacaggttcgggccgctgagaagcgtaataccctactcctgtgttctggtggatctgtgtgtaaaggaatacagagagctcgagagcgagagagagttccagctctagcccccctcctccttttttttctcccccttctctcttaggcctgggcctcctttttatctgatcaggggtcaccacatgggcctctagctgcctaagaaaggaaacatgctttttacaatgagggctagtctacagccggaagtgacttctgacaagcagagcacgcgccttctgctccgctcgcccgctttttccgtggacgcccattt

SEQ ID NO: 73486 - DNA, 7290 bp, Oryza sativa
cctgctgcgcggattgcaagaccgtagacggtgagccaggattccgggttggtggtgccgtcatacttctcgattccagtcggcttaaagtcagctggccaattcactcgacgcagatcatttgtgaaggcagcaactccgtccatgtcgtcgtcgtagcggtccggtgaatgatgtcctcttgccgcgcggcgctggttgatggtgtcacgaagatcgatggggcgtcttcgatgtgggaagtgtggtcgttcaactcggcgctccctatgttgttcaggaggcaaacgaacagatcgttcatcatgtcccttgctcttgcgactagatccggcgccggtaatgctgaggcttggttggtgatagtcttgagatcgaagatgagggactcggctaccagtcggggtgcgggtgcttgcggagttggctggaaccgaggcagcgatcatggtcttcgtctggttcaagatgttgacaacatgatcagcttggttgagtgcgtcttccttgaggagggtgtcaaggagagtgattgctgcaaccgcgttctgctggggggtgcgaaaaaccgttgtttcatcgacgtcttgttgcccgatgaggtctctcgctcgtcgcctggattccaaggcgcgttgccgtcgatcttcagcctcctttgcaactcgctcgcgatcttgttgctcacgctgtagtcgttctcgctcttgtcgttgtcgttcttcctccagtcggcgacgttcggtttcttgtcgtgtgcgctcttcctccacttctttggctcggcgttgttcctccgtttcgttgtcagccatgaatacgccgaaaaagagaggcgtgtacttatcctcatagctgtcgtcgaagtcgccgtggtcgtagtggtagccgaagtcgtcgcagtcgaggatctcggttggtcgagaactgacgtcagggaagctaaggtagccatccaactcttccgtcgagactgtcccaagaggttggagtataacgccaacctctctggatctagattggatcggggccgaagccggagttcgcctagatcttcgagtgggagatgtcttggctgtaaagacagcggccaaatcatcaggaagtctcatcaggattgagggataggacccgtcgtcttgatctggtcgcggaggagtagattggatctcgtccgagtggtttgaagccgacccgagagagatgatcttggagtaggcctcggccgagttcggaataccgaacggcgcggggacatggtctctccccgactggttcgaatccgagtcaaggagagagatcttgctgaggttgttggtgatgaagttgaggctatcgaaccggaacgcctgcccgggagggaaggcgaagtcgtcgatgccggagacggaacccatcgtacttagtcagcaaaaacttgatgctgcccctacctggcgcgccaactgtcgaaacaagatttcggcaataataaaaagggggtggctatcaagctaggaaagtggatgggtttgaagacaaggaattttatacaggttcaggccttcttattcaaaaagtaataccctactcctgtccggggatgattccgccgagtatgttattgattgtataaactggaaaaaagatcacgcccccgcacacagacccctccttatataggggaagaggtccgctttacaaaatatagtccatatcctaacggaatatgggattatagatgaaatacaatcgtaaccgactaagatcccgagtatttccttgacatacaagtttagaatctaacccgagtcctcatagagatattctatctatatttggtaccgtatatccgactaaattataatgtcatgtagatatgaggtatccataatctccacactcgtgttattgaatttgcatgtgccatggttgaacccgaaattttcaataaaattaattttactgcttcaaatttatgcctttttggaggtcatatacaaagaggacacagctgacagctggcttgttcaccagttattttcttgtttggacgagaatggtttaaacatttcaatcaaatttattttgaatgctattttctatgtcaatccttttcatgtgacttcatcagcttagaaaaatcatgcctagcgatacaataatggatgctttggatggattggaaaagtacttccttataattgggagtttgtacccataatttgtggacggagtaagtatgcaagtactatcaacatgtaattccatcggtcgtacagtaagtatttgatggtcttatttgtctgtgtctaggataagagttggttaaacatttcaaactttcaccatccattttgtattataaaatctaaaagtttataatattacttctagaggaaaatctactcatacaatctttttttttctttttaaatgcacaagtttgtcataatatgatattacttttgaaggcaaatctacacatacgaaaactatttatggtcaaagtttaagagataatccaagaataccattgacaagcgtcaaatccaaaaaatatcatcgtacaaacgattttgtcccaaaaatgtaatcgttgttagggttccgttcatcctatagcactaagcaatgcagaatggacggaaccctaacggcgataatatttttaagaaaagtcatttgtacgttgacatttcttaaaactcacacttatcaatgatatttattggatttgaatgtttgtcaatggcattttttagattatctcaagttttaaaggtttaactaaatcttacgctaaacgtcaaaatatttacgaatcttgtcaattcttctactaggcgaatataaatggtcatgagtacagacacggaatgaacagaaaccccggaaggccagaacaaagaatttgtaacccagaatttatccaaacaaacatgactatgtaaaacgagatggtattaacgtataattgattgagttttaatcattacaaatttaaaaaatagattaatatgatattttagagcaacttttatatagagagttttagcacgaaacgtaaagtagtttgaaaagcgtgcacggaaatcttaatcttgatctaactcttattggagaaaagaacggacctacgctcccagttgttaattggcatttgtcaatcgatctgaaccacgacagctaacaataacaaatatgaatttggaagtcatatatagagacattttcaaactagtaggccaactgttttctaggctacttttactaaattgataaaaaaagcaatgcaaagtgacgctttacactaaagacctactgaattctactttcagaattatagcaagctgtggtaattttcaggtgtcgttcctggtaaaactgcattataacaaaccagaggcttccctcttgcagctaacttttctcttcgggagaaacacatcagtcagcacagtcttagacttcagggaagcaaggagtatctccagtacctacatttgaacacaaaaatcatcaacagtgccaattaaaaaaaaacaaaaacgactgatttttttttctctttactcaaagtgagagatatgtacacagtagtacagtacagacctcttccttgccaatcttcacggtccgttcctgcagcgcgctcaagtccttgacaccacactgtgcaagtaagctgacgcttgacacactggacgctggagtcattgagagatcatccctgacagtgtatgtggctgtcccaaccacaaatccaacggttttgacatgtggaattgccctgtgcatttgagtggagcagacagggcatacagcgcctttgctaacagaaaaatatccacaaggaactttagtggtactgtagcttacgacggtcgatttcccttcacatgtgaagaagctggcattgacatttaactttgcatccagcagcagctgctgcaatggacagagcacggtgggggcaaccgtcgggctgaggaagcgttccttgctttggcttgagattacatacttggaatccagcttctccacgctgtcaagcacattgcccatgctaccaaccatacgctccttggtaagcatgttgatgatggtgctcattgggaggcaaaggaggcaggagataaactcaatgacatcactaccagcctcggcaaagcagactttctgagccttggtatcaatcaagagcttcatcgataatctgatggctgccatgattttcccccttctatcaaaattctataaatttcttgggagttgattggttgcttctacaatcaacaacaaaagaaaattatatgggttttcagttaactagcgttagagtccaaatgatcagaacgcgcagcacactgacacatagtggaaagctatgcaaacaattttccagagaaatttagagcagagtagcagacaaagcaaaaacacgttccagattgtaatccaatgaagcgtctagattggttggcagctgctcaaaagtaagcaaaaatggcatcctagtatacaggatacaacttctcctgtggacttgtggggtaaccgggtaaggtaacaatccgtgcagatgacacatttccaaataagaaatggcagagcagtatgttcatattttccacatagtgacacgggaaaatagattcagtgcaagtaatctgctttccttactatctcatttggcaatgccaacaaaaaaaaaataaataaacacgaccttataaatgttcttacaggcaaactcattggttgcagaagcagtgaagcacttgagacaaatattagcataacatatcaagtgtaaactagtactatgtactgcactaatgttcaggatcaggtttatcagttacgttttttctgtaagtcaaatcgaatgttcctaaaaaaaatcgatctaggaaaaccttgaaaagacgggtaaatgtttttatcctgaaccatagaaaaatatttcagcaagagtgctagattcatttcgacagcaagatcatgctagcagtctccattatactagaatattcaaactgaaaaataccattccgtttgcctcactagatctacggtccgatatcaatagaaccaaccaaaagtaagggagagaaatcaacgacgatgaggaaaaccaaatcaacgagagagagagagcaatctgcaaggtgagaggagaatgtatagcaccgggggacggagaggaactcgctcacacaatggatcgccgttgatgcccgccgctgccgctgccgccgtcctgcgacggcaaaaagaagggaggcgacggcgaggagtccaggacgatgatggatgagcacgggtagtagtagtagtagcctaatggtttgcttcctttggccatttacaaataccggcccgccccgatgccgccgtaatcggagttgccggaggtgctgcacgttgacgtttcctgacttcgtgtgctgtttcagggcccgcgtaattgtgcggttagcatcaaaataaaattacgttatgatatgattttatctatattttttcattgcatctttaaaatttgtggaaccgtagatttgttggctatgtttatatcaccaacatatcgtattgcatacatatagacatgtttcttggatagagagagtttataaatcagtgatatgttatttctgagtgagtgaaataaataaacaaagcaactaaacggtattacctctgtcccaaaaatataacaacttttgattatgttgtccagattcataactaaaaatgcttataatttaggaagaaggaagtagtaaattttctacttgactaagtatttccaagagactccttatcctactatgctaaaatttaaggattttatagaaaaaaatagccatctattattgtaatgtttagaaagtcccattagccactagcccactaccaacttctcctcgtttgcatgctgtccttgtccatactctttcgttgttgtcgctacccatccgttcgccctccagcgtccgtcagctttccttctcttctttgctgctctttattcacagcctgccgtgactcttaggctgtgttcagcagctgagttttccaactcacatttctctttttttcgtgcgcacgttttttaaactgctaacgatgcgtctttataaaatttttatacgaaagttgctttaaaaaaagtcatattaattcatttttcaaaaataaatttagctaatacttaattaatcatgcactaatgagttattgacatatgggtgacaaatagttaaatgttaaatctaaaagtggcaaatagttaaatgcccccatacaaagagtacacagctggcttgttcatagttattttcttgtttggaccataatggtttaaacatttcaatcgaatttattctgaatattattttgtacatcaatccttttcccgtgagacgtgactttatcagcttggaaatgatgacgtaatcatcttgcgaatggaactacaccttcgtcttattttaagtgtaactataagtttccatgttcaactttaatcgtatgtctttttaaatttttttgaaaaaaattaaaatagaagtcacgcgtaaaatattgttcatgttttatcatctaatagcaataaataatactaatcattaaaaaaaagaaggttgtctttatgattgatcgtgacatattggacccttgagtctttgatagttactacctctgtcccaatataagtgcagttgtggaatttcgtgtccaatgtttgattgtccatcatacttgaaaaaattaaaaaaataatcacatataaagtactacttgactagagtaaaagatcttgtactgaatattggcaaactattctaaactctcgagagaccgaggggatgctatcattatttacatatcacttaaatggttatcaagaaattaataagatagattaatatatgataaactaattatgaatccactctcctgaatattacttagatacccaattataaatacatacttcctccggtcattgtttgggataaaagttactactatacgaaaaatctatgtataatattacttttaaaggcaaatatacccatacatttctttaaactaagcatttgagaaaatattgatgtttaaagtttttaaaaccttgtccaaatcttatactaaacatgaaatatttataacccgagtactcatttgtcaatcctttcaatgagtaaatacaaatggtcaagactaaatacacggaaagatcagaaaccatatcgcgggataaagataaaggctctcacagtgagccccggaaggcct

SEQ ID NO: 73487 - DNA, 604 bp, Oryza sativa
tggtaagacaagtaacaacaaaataaataatatatatagttttttaataagatagatggttaaacactatgtgaaaaaatcaacggtgtcatacattttgaaatggagggagtatatccactaatgtatttggggataccatgtcattgatcattgttctcgaatgacaactgcttcacgtcgaaagacgtggtaaactcggtgagtggttggaatagtaaagcaatgtattaattgataaaaatttttgggatctccccattacatggctctaggagactatttataatcctagtacaggcttgtaccctttaggatttggttagtacatgtgaatttgcatagttacccttaccgtagggacattacaatgtgtatacagtgtcttttgcatttatgggccttgaggcaacccccttgggccggcccattagttgtcgaagggcctctataggccgctgggcctcctatgtccttagccgaaggtatctactacttcggggcgatggccttgtgcttcgccctacaaccttcgcccgtggtgactctccagttgaccgatgagcttggaggtgaacccttcggtctccattccatggcttcg

SEQ ID NO: 73488 - DNA, 5849 bp, Oryza sativa
tttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagcttgccaagcacgccgtctccgagggcaccaaggccgtcaccaagttcacttccgcttaggctgcacctggtgctattgtgctagtagtaatattagtttgatctatttatctactagctgtagtgcatcaatgatgggaaatggatgttggggatttagtgactgtaagaagaattaggtggggctgcttttgaggaacttctgtttcatggattcgaaatacactagtaatgcttttgtatcatgtgaatatgtgatctctcctatgttgtctttggttgccttgtgctgaacttgtgtttgttttaattaatttatgtctaattttggggaactaatctttgtgttgtagtaactatttgcattgtcttgcaaattcctcgtcatgttaccggaattgattctggagcatgcatgtttggagtttggaactgctgatgtgctcatgtagacgttattatggaagattgctattatttttgtttctgattaccttaattagctaatgtcactggccacaagacgaatttcactgggctccttttggggaactttttttttttctcatggatcaggaatactctttgatttccttgtgcttgaaggtgaactagtgatgcttatgtctagttttgtggaattaatcttcatgctattgctatttttcattgtctagcaaatcatcaaatccctctgcttgttactggaattttatttcttgagcatctattttggagtttggtactgctcgttggattatgttagttttagatttatggactggcactacttttgtactttggaccgtttgtggactgagcatttggagttcatgatgtttgcattcgaaacaaaacagaggttgttagaagagattagaactttgaaaattgtagtaaactttgttttagcttcgtctggtactaattcaaagaaatctaactcaagtggaaatagtactgaaactccacatatattgcctttgctatttcactatttcaggattatgcatgcctgcccgtttgctacatttctgtcctgaatgtcttatggaggttcctctgttgaagattagctaacaacaaatatgaggtatgcatcttttatcaaaccttgctttgggctgttctgttctgtgcaagatgtgctgactgaagagtgaagatgggactcttgtgggacttcttgtaatgcaatccttttattttctattcagggagattatttgaggtgatcaattatctttaaggttctacagggagagcatcctgaatttctgtttggcttgttcaaattaaatattccatgccaaacaactttagctttaactgattactgtggatatgtactagtatctttttctcatgaaaaagctttatagtggctagtacaaatccacagcgactgaaatgatggatctcatatttcttgggtgaacaatccttcattcctatttggttaattgtttgggctattgttcttctattctataattgtcatggatttggtatcctgtgctagaactgtttagatgcgatcttttttgctgctttgtttatgtcgaatctgaaaactggttgcctgggtatttgagtcagggagttaggaaattttgctgctatggttctgtaggtaactaggaattggtattgaattattattggtgctgcgtaacctttatttaacctctaaaatgcacgaccagtaactatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgggcggcccacatggccaactataccagtaaccatggaaccttgtatgcagctgattattccaggtacagtcatcgatactacacatatgcatattgcccaatatttatgaatgttgctctactgttcattgcccgactcaacatttagttaagagtgctctgttcattttcaaccatccaagacctgagatattcatctctgattgcatgaatctctgatgcagcatctggtaacagcattcggtctctgggttgttgctttgagcaggataagccgagcctaagaacggacaccaaacactgttgaataattcttctttttgtgcttgcatttgtcccatctgtatcatttgcttcttcatgcagccagattgttcgatcagctatgttcatggcgctctcaagaaaagaagctgcaacaaacttgtgcagatccattgaatccctgaaaatgtcatcagtgggacttcttccattaaacatctcaagcaacaatatacctaagctgtaagtatcacctgctctggttactgcagaaccttctccatactctacaatatttgcagttaaagttagtttttcaccgtactaccgacatgtaaaagatacaaagttccagtccaacccccacccatgagggaggaggtggagaaattgtaggatataatacaaaaatataatatttttgacctacctggtgcaatatatccaatggaacctcggattccaattgagctttttgaatattgaagagttctagttgtgcttttggggaggatttttgatatgccaaaatctccaacctttgcactcatgtcttctgcaagaagaatattacttggtttcaggtcacaatgaatgatcggtggctgacaactgttgtgaagataatccagtgcgtccaagatatcaaccacaatgctgagtctctgcgaaaggctcagtgtattgctgggagtgggattgcttgacgtgggatggagccgactatctaagcttccgttgggcatgtactcgagggctaatgccttgaactcctgaccctgtgggtcaatacttgaacgacaagtgatgatctttgtcagacaacgatggcgaactcttctcaaagcctcacattcagcctgaaagctccttgaagatcctaattgtttaaggtcgaacacttttatggctacaggttcaccctcatcttgtaaagtgcatttataaacagaaccatatcttcctttgccaagcaagtttgcttctgaaaattcattgcttcctcttgataatgcataatatgaaatcctctgatattgttcctctataaccggagatatctcttggctattttgtcttccttttagtttcctgtgctgtaacataatcagaacaatagctgaagctaacaccagaattgctcctgttgttatgaaagctactttaagatatttcatccgttcttttctgtcctttcttacagcaggaattggacatggagccaagtgaagccgaggtattccaccacacaacttgtcgttccctgcaactgatgcatacgtaaggttcctgaaagcaccttcatctggtactttgccttgcaaattattgaaggacacatctaagtgccacagctgtgtcaaattttgtagggtttctgggattgatcctgacaaattgttgtgagctagacacagctgttgcagattgcccatgctaccaatggcattggggatgctaccagaaaacttgttcatggttaggttcagtatggcgatcccttttagttttgtcaaagattgaggtatgcttccttcaaacgagttgctatctagcagcaggtattccagcacctcacaatttcctatactgtcaggtatttgatcagatagctggtttcctgacagttctatactgtttaggttaaccaaggtaccaacttctgatggaatgggtcctgagagagtattatctgacaagattaagaaccaagaaagtgacggcagctcaaaaatttcttttgggaccgaaccgttcagatggtttatggacaaatctagagcaaatagcttctttagcttcccaagggttgcaggtattgggccttccaaatgggcatcgtatgcggctagtatattcaaattggtaagatttccaattactgacggtatgaggcctgacaatctagtgctgtacagagtaattatggccaagtctgctagcttccctatgctctcaggaatcactcctgacaaagaagtggaccctagatcgagcgtgtccaagccaatcaaattgccaatgtctgtggggatgctcccggagacgctattaccacgtaagaagaacttttgaagtgttgtcgacaggttaacaatagagattggcagctgcccaatgaaagaattttctgcgatatctagctgttgcagctgactgcagttggcaagtgaagttataaattcccagcccttcatgttatttgcctcaagtcggttgctagacaaggatagacgcacaagagatttcaaccttcccacggtaggaggcacaaatccactgaatttgttaccatcaaggtatacgtctgtgagtgatgatagattgaataaggaagaggggatgactccgctaaactggttcacagacagaacaaagtgttgcatgttaggtaatttgtcgccaatgttggcgggaatgcttcctttgagcttgttctcatatacttggagaacagtcagttttgacagattccatatggagggcgggaattcgccagagaggctgtttccgtcaagaccaatcttctgcagatttgggatgtttccgaggcttgacgggatcaggcctttcaggtggttgaagtccaactttaggaactcaagcgatgataggtttgctagcgaggctggaatcggccctgtgaagct

SEQ ID NO: 73489 - DNA, 1930 bp, Oryza sativa
caagatgcagtccatagtctatttttcaagataaaagaaccacctgcttttgccaatcagactttcagtttcatgaaagctgcaactacagaattataagtacaacaacataagtttagtaggattataataacttatacagttcttagctctaagtacaacagctgcttaattgaagtgatcatctgcatttagtatgcctcactttttagattagcagatgaacaaccacatgcttgtgccaaatattgaaaatagtgtctgaaagatgcaatttcagtatgtatgtgcctaatcactcactgtcgctgacatttattcttctttagttcccttctctgatgccatcatagacagtatgtgctctgaaatattgagaaactacttgctctgaatttttgctatgctctgaaagtatacaagtctgctttttttttttcctcaagtacatgctaacaaggttccccgattaattactgcatgacctataacagatccaccacgctttggaacttcatcatcgtcgaactcaccgtgcactatatcaaccgccgaagaaataaattcttcgtcaccatccgatgaaaactcatccaatagcatttggaggagggtgcttcgacgactcatctcctctttttgtttgccacggtgttggagcgtttaccacagggatgaagtgcaatggagggaactgatggcaggaatagaacaataatcaatctgcaaaattaattatcagatcaaacttaatattttccaacaatatatatccacatcaaaatactgacatagagattgactacggcacaagagattaatgggatttgctaaggattacctccttgatgacacgaattgctacgacatctccttggtgttccgttttttaacaaatcgcagcagtcaggacactggttggctggctggtgatgatggcgctaggtcacggcggcgcaagtgtggggaggaagaagtcgatcggcgctggtgcgggagggagaagacgtgcgcaagtaccgaactgggccccaccttgcttatgtggcaaactaacaaatgatagggaattgatttttgggcttctcttggaggagggggtcattgttgggcccaatttttattttggtattcctaattcagattttttgggaatcaaatattgggtgattgttgggcatgctctaagtgatttgtttggttgggagacatggaaaatttagtgggatagggatggtgaattgaggaaggaactccctccttttcaatacctgggtaggggcaggtaattgggagggaattcctcctttactttttctaagcaaatctgagccatctgtttttattaatgacttaatctccaactaaactccctatcaatttccattacctctaccaaacaagatattgagattaaaaatcaaattcccatcttaatctcattatcaattccctcgtgtaaactcccaatctccttccctcgagttaccaaacaagccgttagatcactaagaatacgtatataaaagttttattcacaaattttttccatttacaaatatgccgatgggtcctggtgatttacttaacaaatgtttgattagatcttcagttttatatacaaattcgttttgtctaaacagataaaattgacttattaatcttgggaaggccgttactcactctagactttactcctccttatctttttttttcttgaacgaacatttcatttcttatatttttgcatagtttttttaaggtagttatagacaaaagtgataatgattgggcttctaaataatgggtaagacttgtctccaacaagtgacccataagggcacctaaatctaaaatgggtttccgatagtattatttcagcctccaacagagtacctatacagaagacctattttacgtgctataagac

SEQ ID NO: 73490 - DNA, 1173 bp, Oryza sativa
ttagtccctgtctttagacactaatttagagtattaaatataaactacttacaaaactaattacataaataaaagctaattcacgagacaaattttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgtaggcggagaaaagcagttggcaaagctcgcgcaatggcagcctccaccaccgcgctgagcatgaagctgctcgtcgacaccaatgcccagcgagtgctgttcgcggaggcgagcaaggatgtcgtcgacttcctcttctccctcctggcgctgccggtcggcacggccgtcaagctgctcgggaaggactccatggtcggctgcgtcggcaacctctacgccagcgtcgagaagctcgacggcacctacgtccagcccggcgcctccaagaacgcgctgctcagccccgtcgtgctctcgccggcggccagctccaacacctccgtcctccgcttgccggccccgtcttcttcgcagcccaagagcttcttcagctgccgctcctacgactgtttctactacgtgacggacgtgagcggcgtcaagtgtccgtcctgcggcaaccagatgacaacggcatgcacgtatgccgcaccaaccgctgcccagaagctgcaggccgctgcagccgaaggggcggggaaggggttcgtgcagggcatcgtcaaatacacggtgggctgcagg

SEQ ID NO: 73491 - DNA, 1837 bp, Oryza sativa
atgtcctgaatcctgatagcatttttgtgtatgactgtatggtactagtttcatcgtttgacctaataagttttaaaacaatttattaattagaaaaaaaattgtctttcatatatatgtgcatgtgaaaaatgataaaaagcctcaaaatctattctaaattcactttaaaattcaaattttgattgcggctaataaccaataacaaacaatgtggttttagtattgtttaggacatccattttacatgcgacaatattttagtaattcgctacaattttctttcttttttcgagacatctattttttcaaactgctaggtataaaatcacttaaatttgaagtttggattagttatggcaatgtatgcgataagattagctcaagcctgttggtgtagcacagttacaccccttcataatccattagctagattgaacttgcgaaacaataatatgtacaccttgatgcttggtccatttggaacgaaaggaacaaccgtgtattcaacaattgcatacggttatggcctaaggttgttggttttgttgcagccatggtgcaagaaaccaccctttggcggcatgcccatcccttgtcgctcacactccctcagggtagtatactcggtcgctaggtcgtcacattgttagcgagagaatagcctcaagtattttttttaaccaagggcacgcgtaggacactagcttgcttgtgtgggtaagcagagtccaacacccagttattcaagagacatgtagatcgatctagccttcaagcttgcctacctaggaagcaggcttcaggccaatgaaaacgtcagtcaggacagtcttggattgcagggaagccttaagaatcgccagaccctgcagagaatcaacaaatacatgcataccgcctaaaaccaactgatattaagttccaacaatcaagtagagtcatgtgtacggttacgaatgtaatcacctcagtgtagccgagctgcacggtcttctccttgagcgcgcccaagtccttgaccgcgaacctgttgagcagcgtgatgctggagatggacgacatgggcgccacggtgagatcgtccatcaccgtgtacgtcacgatgccctgcacgaaccctcctcctttcgccccttcggcggcggcgttctgcgtgttctgatcttggccgccggcaacataggtgcatgccgttgccatctggttgccgcagttaggacacttcgtgccgctcgcgttcgtcacgaagcttctgcaggcgttgctgctgtagctgcatctgaagaagctcttgcttgactgcgcagaagacggcgccggcaagcggaggacggaggtgttggagctggccgccggcgagagcacgacggggctgagcagcgagtccttggcggtgtcggcctggacgaaggcgtcgtcgagcttctcgaaactggcgtagaggttgccgacgcagccgaccatggagcccttcccgagcagcttgatgcccgaggcgatcggcagcgcgaggagggagaggaggaagtcgacgacgtccttgcgtgcctcggcgtacagcacgcgctgcgccttggtgtcgatcaggagtgtcatgctcatcagatcgctacttgccttttggctggttgtttcagaagccatttttgcagtagttgcagtgtgcagtggcctgcgtctgaactctgaagtcgaagtctcgttttgcctgctgcattctggaatttacagcgtaacagacgagagcatcgaggttcacggggaagaagagagtaatttatttgcaaattaaccgctcattgtgaactttaattcctaatcaatcaatgccgtt

SEQ ID NO: 73492 - DNA, 2642 bp, Oryza sativa
catttcgaaacggagggagtacgtcattaacttgacaatacaaccgaccattcccgatgacacatattgagcaataaaaatgtggaaccaccagctgttacaaagtactccatctagagcattagcatgtagattaatttaatcactaacgagaacgatcaaacaacaatacacatgcgtgcaacaattagaatcacaggctcgcagctactacatatgggcaacaaacaaaaccgcaaaattatcagcaccagtctatcactaacagcgactcacctggaccgtgccggatcggtcacgaagggtgaggaaggtgaggccggcgtgggcgcggtggagagcgacccagccgcagaggcgcacgcggcggccggcgtcaccggcgccgagctcgccgcacagcgcgtccctcgcaggccactgcagcggctgcagcctctcgcgcttcgcctcggccgcgggcgccgccgcttcctcctccggcggcggggtcgccgcgtcggtggccgctagggttcggagcggagacggcgagcacgaggccgacgaggtggaggaggcggtggagagcagtaggaggcggcggaggtgcgaggcggtggggctagggttgagcggctttaggcgggagaggagggagagcggcgaggcgcggaggagagaggaagccattggattgggctcggagacggtgggaaagcgagcagaggaggacaagggcttgggttgggttttggaggaagacgggatgggatcgccttatcctcctgcacgaatcttacagcacaagtttttcgcctgcctgcaagcacaagcagatagaaccatcgccagaattcgaaatcaaaagctcttcgacaccaaaatcaaaagtgaattcgcgccggaacatttcatgagaaacgtaggagtacttctcagcttatttaatccaaagtaaactgcacgaccaccgtgcttcaccaaattggagcagcaataggcgtcaaaattgtgcttacaaattcagatcccgccaaggcagaaccaaattttgaaaactgcacaaatcacaaaacgcgcaacaccagtagcaggggggaaataaaattggcgcgatgtagagacaattttttttttcagagcgcgcgcgttcatcaggcgaaaaattcgtgaacatcgtgaagttatcgcttccaccgttccaggcgcataacatcaggacaacgaaagttttgaaaccatgaaatcaaacagcgcccagattcactgccagacttcacaacaaattcaaattaaacatcgaaacatgcactaaatgaaaatgaaatacagccccaacgaggctctggataggaaatttaagacaaaatattcagagattttcagataagcaaagacagcgcaggagcaggagcaggagcagattatcgtacaaaccacaggattggaggcgacaggggaataatcaagaacatgtaaaaggcaagcagattaagccatcatcatcataattactactttaccagatccagataacaatattgtcctaaatccaccaggatatttcttacatgaacccaagatagtcaaaagccagaataactacagcacagtaccataccatccaaaattccaacctaccacaactaccattagcagcaagacgagaaaggggcctatgagcctaagcggaggtgaacttggtcacagccttggtgccctcggagacggcgtgcttggcaagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttcctcccagcgcggtccttcttcccctcgccggagcccttctcgcccttgccggcggggagccgcttctccgccttgggcttcttcccggccggggccttctcggccttctccgccgcgggctcctcctccgcgggcttcttcgcggccggcttcttctccgccttgggcgccatggatgctgctctcttcttctcgggaaggggaaacggtggtggttcttttgctgtgtgtggatcgcaagatttgcggttgggaagaggaggagacggggccgattggttttatagaagaggggatgtgcgccctgattggtggaaagcatgcggcgcggatcgatgacgtggaaggattcgtgtcgttcgccgctgtttgcggtgaacgggtgggatgcgtttcggcgcggattgctgacgtggtgaaatatctgggcgcgaagagacgagcgcggggcgggattttctcgcgcgtgagcgaaattgtggaagggcccatgggtcatagggacgcgacgatttttgtgtatcgagaattacaattttttttagagtactggatttttttaagttttaatgtatacataagaaattttgaccaaatattgatttcaaaatgtttcacgataaatgcgcaattctataatagattctaccatggtttttatgtggtactattatgctatta

SEQ ID NO: 73493 - DNA, 2906 bp, Oryza sativa
cccattgaacgtagcacagggaagtcttacaaaaaaaggttcttacatttatttttattgcagttttcaaaagttagttctagccataaagtttttcttttaattggaaaaaacaaggagataaaggaaattaactacatccatctactggaagataattgtgcttaacgatggtaagacaattgatatttgagaaagcaattattacaccagtgaacccaaatatgatttgggtaattaggtctttgaaagttgccacaaataaaagtgaacgaaaaagcactgcgcatttttcaacagaagaaataaacgtgttataattgtctgtttaagtgaaaaatagttacagacaacttacctgaactctcgatgggacaagatagtcccgagcaccttctggtgtagacttagataaaactggagtctcaatctaccttggaacatgcggtaactttggatcagacacaatagaaacaataacagatacagacattataggcattgcaaggtactaagatattattagtcattgtgatgtcttatattctaatgactcgctgtaaaggagatacaacagcaaagaaggcatacatgacccatctatttcaactgatccaagttattttaactagcaaattgtacaggaaatgattaaaaaaaatttcatgtacaaagcaaacaaagcatacatgcactctgtaaaaaaaaaaaaagatgattaaaattggaattagagccctaagcccaaggtgcaacatgaccttcaggcattacatcatgaaagcaagtatcttgctctctctactgcaggcactgcatcgaaaagaaagtattttgccgtcttgcaaatttccgttcatctataggaccagactacttggatatattgcattccatagtggaacaaaatgagaagcatatagccaaaggcagattatgttagaggtgcaaactcagcatgaagtaattaatgagtatataattggtatacagcatacctcaacaaaatcatgtctatcctccaagtatcgacgaatatgcttgacaacattatggcgcaacctcaagtttgactgcatttgtggtcggcgtaagtccagcacccggaatctagacatttacaaatatggaagttaaagaaaaagattggtccttaatatatggaacttaaaacccataatataactatattcaagtacaatggtcgcctgctgtgaaagaagacattgagaacagggaaaagtgctttaggcaaactattaaaaacattatacaaacagattcaagcataatggtcgcctaaaatcttgaaagaaggcaaagagaacaggcaaagggctggcaaacacagaaaatgtacatcttctggcaaggatggttaaatctggaacaaatttgtggtcaggattgcagaatgtcatgacatggtattgcaacagagtaaagggtggtttaacagcagtatgtagttaaaaacattcctatacactagcataatccaaatgatggtagaaaattccaaattaaactgaatatgacagccttcataatgaccgccaatatatcgatctagtgaaaaaatattggaaccttggaagaacaaagatccatagaatatagcaatggccatagttcagcgtaaatcagtaactggggtgaatgattaaataacacaaagagattgcaaccctcacggagtgaatgatgtgccatgtttcacagtatctccaaagccactattcacagggtaaacatgtgactccccagaaaatgggttaacacctcaacaagttgtgtcccagtagttagtgtcgtaatgcaacctaagtattattttggcacctaaaatcttatgcacaactttgaatgtgcaatgtaatcccatttatgcatgtattcaacaagcctaatcaggcgttaaccaacaatcaaccaccatatttgaggtattcaatactagtatttcttttcttcaggatacttaatatatgagcataaaaagagtgcagataacaatgtattttacctcagtctaatttcttctggaaacttctcttttacagtatcagcagtggtgattggaaaaggcaatgaacgagttactgagttcagcacatatatattatctgcagcaacctgcataggtcagcatgtaatatcatagttagagagcattttgctgtatggaggaacacaataaaaaaattcaggaagtccgcaacaatgaaagaaaagaagtgttagaattacaaataatgttgcacgggctattccttatcctatatattagctcttatagcatctatgtgctccgtacatatgaacagcaaactttaaaagtgtggaatttctgtactagatagtttgaatttcaaattcttcacttgacatatcatctcaagcttctctctctaaactgcaaaataaagtaacatacaaccagtcaatacctctatagccccagtcttcatatctgtgttgatggcttctgttgggcgtgaccgaacaaccccctcgaccgcaaccactgactctactcttagtttgttcaccacagcataaacttctggatattctggcaaagttgtcacctacacagagagaacaattaccgataagaccatgctatcttgtagatgtttatcagtctaccaatcactacagaaagaaaaaacaaatcaactcccccataacattacaaattgatgcgattatatgacttcattttgccttcgtaagttattagatcactcaacatcagtttattgggaatttgtagctgcaaacgttgctaaaaccactcaatagaacaggaaaacagtaggtaatgtcagtgctacaaatactattatactccctccgtttcgaaatgtttgacaccgttgactttttagcacatgtttgac

SEQ ID NO: 73494 - DNA, 16057 bp, Oryza sativa
gaaacgctaagcgaataaacgataaaaaataatagatcaatcgtagaagacacgagatttaacgtgaaaaatccttttaaaataggagagaaaaaaccacgggcgccagccagcaaaatatattcactatatctgaggtgagattacatcgccgcacggcggcttacaagaggtacatatattgtggaaccctgaaagggatcaagcctcccggcgacgggcctccgctccactacggtagaaactggcctttattaaatgcaaatgaatttgtatcaacatgagcaaatgaccgtggtgccaaagcgatcgcgtgaatgtgagatacgatcaactgcactggtagcgataaagagaagattgaacgcactgattctagtcgtccgttcagcgaaaagcccatctggtttaccagttggcacagcctaaattaaatcacaacccattgatagcaattacgggccaggcccatctctccatcaaaagctcaaggccatctgtgattttgttctataactcgtacagaagacatcacataatcaacaccaatgtatcttgcctaactaggtaataagtagcagggctaagtagtaggtctttataaagtgggtcccacgagaaaaaaaatattgctttttaattgctttttgtccaactcagcatgcagtagtagcacatcttgtgttggaaggagagagtgaaagagattttaatgtttttttattcttatgagtgggtcataagcttactacctagcattagttactacccactttcacaatgcttattactaggtcataggaatattatattgcctaatacctgctttttcctaacattgtggatgccctaagagtttcaaatcgactggtcacgcttgcggcttgccagcaagcaaaataaacaacaagagaaggaccaacacaaatggccatttcttccgcttcttgccaaggaaaacatctgtaagcaccgtcttcgactgcagcgacgccttcagcatagccaaaccctgcagtacagtgtaaaacaaaatggttaataaaacacaaatcaaaatgtaccaaaacttcatatgataacaacctcagtgtagccgatctgcacggtcttctcctggagcgacttgatgtgagtgacaccggatttgaccagcgcgatggtggacatgggcgcgaccttgaggtcatccatgacggcgtatgtcaccaacccctgcacaaaccccgtgcctgcgattgcagacggcgcactcgcggtcgccggcacctcgccgccggtggatccagcaatggtggtgctcgacaccatcacatgcttcaccggcaaactcatcttgccgctgcactgcggcaactgacaaggcaagccactcaccgtggagacgtagttgcagcaatcaccgaacctactcgcgctgccccggtaaagctccgtggaggccggcggcggcgccgccgcattgatctccggcaggtggagaaaattatgaaaaaaattaaaaagacaagtcgcgcataaagtattaattatgttttatcatctaacaacaataaaaatactaattataaaaaaatttcatataagacggacagtcaaacgttggcacggaaacctagggtttgctttttttttgggacggagagagtaaagtgctaatgctaacatttcgtcatagataggtgttgttctgagacaaattttttgaacgaacaacgaattttacaaccacacgaggagaacgtccatgtatgtgcacatttctactagtgacacgtgctaaatactgtttctagtatttaaaattagatgcgcagattaacactctcattattatttagtttgttttcattaggaatttactgtttccaataggaaaattaattcgtgagacttgcatatctcttaaacatgtgttgaagggggccaaaaaacttcaaatttttaagacgaatactactggtgcgttacaaaattcgcgtgaagtacgacgttggctactttgctgatctgatcaaattggcctcgattcctcaaaccagcataggaccagcggtgtgcagtccgcctcgcgccgaggaagacatcggtgagcactgtcatagaccgcaacgacgccttcagccacacttaagccaaaatctctaataccgattgcagggttagaacccttgctattgattgggccacgtggcatcacgcatagctcacgaccagattctcggctggagaacatgccacgcattcgaactgtcccatagccgtccgattacatacgaacggtgagaaaaggcctagcggacctaaatataaattgcaagttttaagaagggtttttaacaaaatgcacaatcttatctagaacagtccagagtatatgaaaaaagacccagaatcagaaaaaaaaaaatccagcaagaacaatatacagtattcccctttcctaatcaccatgccgtcgcgtagatggcaaatacggggacgatgagctcgagctcgattgacctggtgctccttggccccgccctgccttgatccgtgcgaggcgacgatgcgcctagacgatacgggggaagcgaaggatccgacgacggagttgtagacgacattggagggagcccgctgagatagagagcgccataggggatacctccgcgctggtcctggagcttgacggcccgcgcggggccttgatacgcgcctgctcaccagctagcgctgcctcatatagacgagtagggacggcggcggaggtccacgccgtcgctacatccgcggggatcagctcggctcaacgccaccctgcttgtcgccggcttcctttaccgcctctgcgatcaaccgctcgcatcgtctcctcgatatcctccttgccgcttctgccaccatggccggtcgcaccgccccctcgacccttccgccaccaccgcgacctcacctcatcgccgagccgctcgtcgccggagatcggaggcggagacaacggagttggtggtggcaggacggccggcagtcaacccgatggcggggcctccggctcactcttaacccgctgccgttcgaccacgccacctccgctgcctccgtgatgcatgcagagctggccagcttgaagccttgaacccagtgaccaaagaagccagttacctcttgcatttgcaagcggcctcacccatcagttctttctcagcgcaaatccatgctggaaagtggaaactgaaaagcacaagccacaacaatagtagcgcagtaggtgcagtacagtggagtacgagagaagaagagtgaactgggattgaaagcagaggtgggttctcaaaaaaaaagaaagcagaggtggacgacggggcatatgcatgcatggagcacgtcactgctcccaattcccaatggccacctgctaacttacacgtgccatcaactcctaacaaattttctttttcacccctaataatatttttttattctatacttcactaaatacaaaatattttaaaaaatgcccctaggttagtactcatgtatttatgtttaggaccttagaagttttgacttttcaagacttgtttgtctgtctgagtctgaatcgtctgatgtacaaagagtaacataaacatattatgactctatattgagttgatgataggagtcatttacttaaaaaaatatgcattctaaattttgtaattttcatgtaatttgataaattttgtaaatcctactaatttaaaagacatatcttccaaagtagtatttgttaaaggcatacagatacacttaaagaagttaattatccgttacaaatcttttttaaaaagttgaaatataattattcaccggacaagtactgctagctaaatacgacacataagaattagccaggcataaactaaccatatttactcttattgttgacaatattgttataattgtattctattttatctatgattagctaatcaacctgacaatctctatattgtgagataaatataggtggagggtatatcatatactgaccatataggtaagtaggtggcactaatagtaaacaaccttaagctttcagtcctctaaccatatctaatcataccaattataaatatatgttatttactctgtctaatggaagagaaaaaaggtttgaaagtaaataggcaagtattacaaataaaataaaataaagttttttaaattttttttccgtagtaatgctttaacaaagcttaaaatctttatatgaatagggttactacaggttaattgttcctcaaccttttcaaaagtcattaaatagtttcttctaaatgaacaagtgtatatatttttttctaaaaaaagtaaaatattgcatttgaaactcttaacagcaacaacaataactattataaatatgtaaatatgtactagctataagttggttttccaacgggcacgctgattttcttgaataggaaagcagggaattggaaaagactatagaaggaggatttggggaatgtttaagtttgttgccactttcaatcttaccgaattttggcattgccaaattttggtagtaaacacacttcaactattacgatgttacccaattttggcagttccagaagctctctcttaaaggcatcaaaatgtagtaaaggcatcaaaccaaacaaagcgaatgttaccaaaatttgataataccaaaatgtgttaaaattcgacattactaaaatttgatatggtcaatttttcaaacaaagtgtacaaaccatttatatctatttccgattctaatttttagggtgttcaatgaaaaatgttggactacttattatcgaaaccattcctaagccattatgcattattgggtaagttgaatgtaaaattttgtgattatgtagccttttttatatatatacaaatttagttatgatcaattcgtaattaccaggcttcataattaacagtgtactgggttcatgtaattgagctggcctatgtatactaaggcgtggcaaagccgcggttattttctagtgtatatcagaaattaatctctattgcaaatatctaaaattaagtcgatcacctgtaagtagccgacctcgacggtcttctcctacaattccctgatgtccatcacgccaagcgccacgagggcggcgatggcggagacggtggacgacggcgcgacggtgaggtcatccatcactgtgtacgtcaccttgccggggttaagccgaatagtactagttagagcaaataatagtatagtccactactagctccaatttatctatagtcaatctaatagctaattcatacaatagttgcttactatattattaatatattgtcccacctgtcatacacacattacattttggagttcgtgctgcagctggctacagatctatagcccgctgctcttctctctcatcgtttatctcattaaaatatgtttacagctggctaatagtctgctattgtacctgctcttaagcgggcctgacctatctctccctggataccccaaggcccatatgttcctattcaggccccctttgattcaaaggaaattcataggaattttaaaggattttattcctgtaggaatttttcctatatagccctttgaatcaaaggaatgaatactatggaatcctatgaaattcctatggaataccttttcccatgcaagttttggaggaaatttagcatgaggtagaacctcatattaagaatcctttgagtctttatctctccttaaattcctgtgtttttcttacggttcaatcaaacggtcattcctatgtttttcctgtgttttgtaatcctctgttttacacttatattcctgtgagaatcctatgtttttactattcctctgatttttcattcctgtgattcaaagggtcgattttgttccggaaccggtacagatgattgaagaacatacgatatcaatacgtgacaaactgacaatagaacggcaataattcatagagttcggaactctcactccccggcacataaaacaaagtagcgtttagtgcgtgattaattatggtttagctatttttttcatacatggagtataattttataagtaactttcgtatagaaactttttgtaaaaaaaaaagtaccgtttagcagtttgaaaaagtgcacatgaaaaacgaggaagaagagttgtgaacggctgggaacgaacgcatcctagatcgactgacaaaagcaccaccaacacataagatagctcaatggccggacaaggaacatgaacgttccaacaaaagcaaacgaggctcccgcgcaggcgatcacatcacatcaggccttcctcttcttgccaaggaagacatctgtgagcaccgtcttcgactgcagcgacgccttcagcatcgccaagccctgcaatagtgttgtacaaaattgacaaacagatcggaacagagagatgagagtacgcactgcaagcaatacacattgctcgtagagaaatagtagcactttacctcagtgtagccatctgcacggtcttctcctggagcgaggtgatgtcagtaacaccgaaggtggtgagcagcgtgatgccggagatggtggacatgggcgcgaccctgaggtcatccatgatcgtgtacgtcaccaccccctgcacaaatcccgtgccggcaacagcatatgctggttgcgccgcctcgccgccgctggccgatccggtagctgtagtgctcgtgctcgacaccacaagcttcattgccaccgtcatcttgccagggcatcgagcgatctgacaacgcaagccactcaccgtggaaacatagtcatagcactcgttgtagtcgcacgagctgcagcggtaaagtttcgtggccagcggcgccgccgtctccggcagctggaggagcttgccggtgtcgaagccaccggccggcgcgagcagcacgttcctggcgtcggcggagcggacgtaggtggcgtcgaggtcctcgacgctggcgtacagctcgccgatggagccgaccatggagtccttggagagaaccttgacgacggtgccgacggggagggtgaggagggagaagaggaagtcgacgacgtccttgccggcctccgcgtacagcacgcgctgcgccttgctgtccaccagcagcttcatgctcagcgccttcgagctggttgtctccgtcgccatcgtagcaactagcaagtgcttgtggctagcttggattggcttgctgtgtgagcagtagaatttatagcgagcagagacgagcaggaaggattacggacgagaggagagtaattagccgcccactgtaaattttcttgatcgatcaagcttttttgcatgcaaaaattgcagtcccaatatatgcgcgcatgtagacggtcaaattaataccgatcggttcagctccgccgcacgtagtatcagcacttgaatgaatcacccatttatgcgaggcaaccgaagcatcatgaatgcgactaccggtgcgtagaggaggttaatttgaaaagaaccaataatttgttttttttttgcgagatgtagaagttgaatttaaacttgcatgtttatgaagtgatatatcacatgttaatacgtcttcttttttttttcaaatttatttaagtgacatgcaaataacgagatgatatcctctcgagggataaaaatccactccccgaattatgaaatcacttttcctaataaaaactttaatgactatttaggtgtcacgcccggaatttctatccaaaattccaaacgcttacatgtgtgtgaacccttgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcatcattgtagaactcttcctctaatgaatgattgcaaggtgagtatatgacatactcagcaagccacgcagcaaatatgtaagtgcacatgataacaaaggatggcatagtagggtttcatttgcaaaagcagcatttagcaaacatttgagaatttaataaaacagttaagtattaaacaatatttgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcgcgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaaaagtgaccagtctgacactggtcgcgtcagcaacgggcagccacgatcccacgttgtgcccgtctccgccgggagtggaggtaggtgtgggctgtcccatcgaagtgtcattcgaacagcaaccataccaatctccgtccataaagagaagaaaagtccagtttggaaggaggagggtgcatgtggtatccccttgaagtataaaaggaggaccttgcccatagagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcatctggcgcgccaggtagggggctcagtgtgtgttttctgagctctcatactcttccgtgtgcgccaagtttcccttgttctgcctaatggccgagcaagcaaaggcgcacgacctctctccgagtgtgagcggcgacgacggggagccaaacccgcgccgtcgagctcgtactcccccacctcctccacgccaaagtcctaagcagggggaggcgctcgagagggttgataaatccgcagcatcaccggtcgtgggtgatgcaggagaacggcgagatggggagcgtcgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccaccaccaagacttccggcgccgccaccaccggttccgtgtcatcaaggcggagggcgcggcgagcggcggcggctgcacgtcattcggctgccactccctcgtcgacaccttcgactcgggaggatcagcatgaggagccggatgcccgcctcaacatcgagcgccggcgtaatagccggcgtactccccgtgcaacggagggcgcctcctcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcggggggatgatgaatcccttcgctcgtacattcagcgtttctgccaagtccgcaatactataccttgtatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccactcgaaaggggaggcctgcgtgcgacaaaaagaaagaggctggtactcccagcagggagcgccccgccggcaggtggtgctccgtccacaacacctccctccacgatctcgcggactgtcgcgcagtcaaaaacttggctgagcgaacgaggaagtgggaggaggacaggaggcaggaacgccgtgaggacaagtccgcggcagttccctccggtaaacggcgaagtgaggccagacagaaggcccccgccgttgaccccgatgacggtgatgatgacctaggtttccaagaacctggggccaccatcgccactgtcgacgggggagcgtgtgctcacgtttctcgccggagcttcaaggctatgaagcgagagcttctggccgcggcccctactcatgaggcgacgcgtcgggcgcggtggtcggaggtggccctcacctttgatcagaccgaccacccaccgtgcgttgcccggggagggcagattgcgatggtggtttcccccactatctgcaatgtgaagttggggcgtgtcctcatagatggaggagcggctctcaacatcctttcccccgcggcctttgatgctatcaaggccctggggatggtgctccgaccgtcccagccaattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaatagggagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccagaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaagattaagttgatctatacaaaagaggcatgaaggccttagaagaaagaaaaagaaaaaatcaaagattgacgggggctcgggggctcattccgacgcgcccgggtcgccggcctcgtcgccaccgtcgtcctcaccactggcatcgccctcctcgtcggagctaggggcgaacgcgagccgaggggccgagccctcgaaaccgttgacgatgtggtcggcggcatcccggacgcgcgcgcgcgcgtcgtcctcggtcccgggagggaactcctccagcgccatccatggagagaagttggggtcccgggcctggtagctcgccagcacgagttcgaccgctccctgcgcgaggtccctcgaggatgacttgatggtcttctcaagctcctcggggagttgttcgagaacccaggccatcctgttgaggtgcggagcgaggccttccagattggtggggggcaccgacgtctggcctctccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgccctcgcgtccagctccttttcccgcgcctcgaggtcagcagcccgctgttccagtgcggctctctcggcgcggacgcattcaagattgcggcgcgcctgctcctcctgcgccgcctcgcgaagggacaggctgtccgccagccgtttggtcgtggcctcagcctcctcgagagcccgctcccgctcagcgagtgcgtcctcgcggaggcggagcgcgcactcctcctcggcgcaggcggcctcgtgcgccgccagcgtcgcctcccggagagcagcggcggcctcgcggtccatcaagcccctcaccacggtgccggcgtgttcttccagcgccatggcacgggactcaagggcctcctcgcgccgccgagacgtcgcttcagtctccgttacccgccgctctcgggcagcggcggagtcaaggaccccttgggcggcgtcgagctttttcttcagctccgcctcccagattgcgtgttgaaggcggagggtgtcttgcgcctcgatcatcgcggtggtggcgataagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcaacgcgcgcccatgcggcctcgagctccgctcgttccgcacgcagggcctccacttgggcgttgaacccatccagcactgcggtgtttgcggcggccagggcctgcagaaggggctcggcgctcagcggggcgacagaagatgaggaaaagagccgccttggagaaaatgcgacgcggcttggccccccggaggatgcgctgggctcggggatgtcccccgggcccgtttggtcctgggcgtcgcccggtgaggtaggcccaggcgatgcgccagcggcctcgtcgcgagccgcctcggaggatgtcgcctgagggccgcccgagggagtgggcccaagtgacgcgccagcagcagctgtcgcctcagcctggcgagcccgggcggcctcctcccgggcagcttcttcggcttggcgagcccgggcggcctcccgggcggcctcttcagcttcccgaaggcgatctgcggcttcacgccggtcagcttctcgcctccgctcctctgcggccgccggatcttcggcctcggactggccggacttggggtggcgggaggaatgtgacggggcatcgctgaagcagaataaaaaaccagaagacaaacaagatgggtaagagaaaacttgcttaatgggatagaagaaagacggtcgcaataagaatggggcgaacctgcgagggggtcggttaaatgaccactttggaggggaaatcaggtttccccgggatggttccgtctcccccatcttgcggagccgcttcttcttgcgctccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgtagagggggaggatctcctgaggaatgcgagacgcctccgcggagctaagattcagcaccctttgaaccacgatcttgaagtcctcgggagcccaatcccatctggctccctgatgggtccgcatgtagtcttcaggcccagtgtactcccaggcgctccgggcgcgccgttggagcggcgcaatccggcggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgtttcgttggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggagcaatggcgaaaggaaggaagcaaatccttttctcgatgcttttatacccttgccatcgctgggcctggctcctcgtttctcgcgcccactacctcgctccttcgtatctcgctatctcgctccctcgtttcccgtccccacgcttccactaatcccattcgcccgcttacggcgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggtgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtc

SEQ ID NO: 73495 - DNA, 1559 bp, Oryza sativa
taatgaattatttttgaaaaggaaaaatagatttattgcgtcagcggctagggtttgcggttgaccgggcgcacggcggcggttcacgcgaacggacggccgagatcgatccatccaaaacggacggccgagatcgatcggtccacgaccggctcacgggagacggggacgatgacgtcggcaatgacgtcaccaccggcggcggcggctcggcggctcgacagctcggacggcgcaagctcaccggcgaacggcggcgctagggcacaaacggagggcaccaacgggtagcggacggcacggcgaactcaccggcgaccaaagcgacggcggaagaggaacggacggcaccggcggcgaggttgaagcggcggcggtcttcgggtcgacggcggcaacgtgaaggaaggtttagggttcggaggagagagacgaaaccgattcgatctcgaatccaacgatttccaaaccgatttagccgatgtttccaaaggagaaaaggcggaggagatcccgaggatcatttcccctctatcaattcggccggagaaggaaagaagcggccggatttggaaggaaacgacggcggcgcggcgctagggtttcggacggctgcggcgcgacgaagacgacgacctgacaggcgggacccacctgtcagcgacagcgagggcgcggctgcggactgggccggactgggccgaggagagagagaacggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaaaaattagatcttctcttctaggcttttaaaaataaattctaataattccaattaaacaacaatttatatattaatgattttcagggtgtgacattagataacatacacgacatgaggggatatcccctcgaaatagtatgtgcatgtcacaaattttaacacatttgttaatccatgcaccaaaattcctactttaaacagaaacttcatgctgaaatccctcccactatggctccatcctaatttaatgatccacaccaagaacaaggacaacaaaacaatgctccgttgattcagtccaacaaaaaataattcactgttgcatggcttgaaaccaataaaaaataattttgattagtactttgttagatgatgattatactaggaaaaggggtaaactacattttttttaagacgaatacaggtgctccacaaaattagcgtgaccatatggccaaaatgacttcatgccttcatggacaacaaggtactacaacgttggctacttgtttgctctgtaatctgatcatcttggcctcaaaccagcataggatgacgtcggtgagcagtccgcctcgcaccgaggaagacatcagtgagcactgtctttgaatgcaacgaaggctgcaggaa

SEQ ID NO: 73496 - DNA, 4924 bp, Oryza sativa
agagcttgcctcgccagacggcgccgccggcgacgtcacgactttggcgccggcgccggagacatcgtccggctcaacaagactcacctcggtcgccatcttcttcttgcacaccggacacggcgtgccgttcaccttggtcacgaagttgtagcagcttctcgagcaggcgcagccgctgcaccggtaaagggcgccgccgccgttgtcggcgtccgccggcgagcccaaccggagggcggccgtgggcgcgagcagcgcggccttgacgtcgccgcggcaggcgtagtcggcgccgagcttgtcaacgacgctgccgtagaggttgccgacggagccgaccatgtcgccggcagtgagcagcttggtgaccccggcgagcgggacagcgaggagggagaggaggaagtcgacgacgtccttgctgccctccgcgtacagcacgcgctgcgccttggtgtcgacgagcagcttcatggttagagtggcagctttagatgtttttccggccatctcacggtcacacactcttgcgtacgagagatcagaagcaccaaactagaatggagaaggtttggattgcagcgagatttgaagcaacctcgaaatttaaatggtctttttttatagtggagctgtacgatgcaggcacatcaatgcgaatgacaccgtgcacgtcgcttcgtttcccggccgtgacatggaccggcgcacgaagtcacgaaccgccggaagagggggagagagagagaaacgagaggagactagaaagcagacgatgggacgagaaaagtcgatgatgcatgggtcctacctccatccatatcccttctttctataatataaagttaaggccaaaaactcaaaccacatgcttctacatcatcatcaaatagtgaaccgttggataaatgcattagatcgcttctcagatgttggatagaatgtagcatagagctcaacccattagtcaccgggtgagtctcttcgcctcttcagtgccaaatgtaacccacatgaacacattggcccatctccacacacatctatatgtatctagcccgtcaatctgtataaaagagctttatgactgaatgccccttcagttgacatgtgctacctaaattatctacaaattttggatagagctgctaaaaagaatttattcaagaaagctatttgtttcttctgtttctttttgagattgtacctcatatctaacaatttgatgttaaccaagtctcgcagcaacacgcggggcatcctctagttggtactatggctgtgttcgggaggaggggtcttcctccccggcacgcaaaatgaaacccctcctccatctcatattactcgctttaagtttctgtttgtaacgaaaatgtttgatcattcgttattcactctattatttattttgtttgtgacttactttattattaaaagtgctttaattgaattatctatttttatatttatactaatttttcaaataaaacaaatgattaaacgtcgaagaaaaagtcaaagcgatttttattatcgaagaagatagtacgtcaatagaaatatttttttcaaaccatcaaaagcgtttatttgcattggtttttaaggtgcgggagatgttattggctttgaagatgccggagatgttatttccggttgtgtggtttagaaagacaattcaatgaggaagagtcaaaatagactttttccctccgataacgtgggcattcgtggtgggccgttatgtaaatgggccgagaggagtggtccgatttactacaggctataaaggaagcaaacctactgctcgtgctcatcgtcctcgccgtcgattccctcctcctcctcgccgtcgtcgcaggccggcggctgcggcgggcaggcctgcggcgggcatcaagggcaatccattgtgtgagcgagttcctcaccgtcctccgtgctgtacattctcctctcaccttacagattgctctctatttttgttttccttacgcgcgatgaatctgccctacctgattatttcgtctagtttagggatcctcgtggtggttgtttctccaccttattttcggttggtttttctcctaatatatatatttttatcgtcagccttgcaagcgcttggaggttttggggacggagggttttgagtatgtgggttttgggggagggaggttgtatgagtaaatacagatttcttttcacattttccatattggagactattggagtatggtgcgtgattgtccacaatttattcacacaactatggatgcctcattgattttcataactttttgagtatcgcgtgtgatttgtttctcgaagacgatatggcgtgtgattttccacagtttattcaaacaactacggatgtcccgtattgatagcagaccggagatctagcaatgcaaacgaaatgattatttgtagttgaatattctagtataatggagtttcctagcatgatccaactgtgaattctagcccaaaatataaaggactacccaatttgaatggaagaaataaaaagtaatataagcctgatctttggtatttttagtttgtgtctaacactatgttccactaatctttgtatgtccttacctgcttatgcaacgctgcaagcctgcaacctatgagtttgcctgtaagaacatttataagattgtggtttatccgtttttcctgcttttccaaatgacatgttcagaaaagcagactactgcactgaattcatttttctttcgcgaacgtgtaaaaggattgcatggcatcccatttagacgaaagcaagttgaacccatttttccatatcactatttggaaaatattaacaaactgctctattattaatacttatatgaaatttggaaattatgttatatatgcatgaattgttaccttactccgcaggagaatttgtatgtaggaggtcattttttccccttactttagagcagctatcaaccaatataatctagatgtttcaaactttcaatggaatacaatctggaacatgtttttgctttatctgctttaaattataacgctttctctgaacatttggacgataactgtagttaattgaaaacccatttaattttcttttgctggtgattgcagaagcaatcaatcaactcccaagaaatttaaagaacttcgaataaaaaggatcatggctgccgctgaattgtcgatcaagctcgtgattgataccaaagctcacaaagtctgctttgccgaagctggcagtgacttcgtcgagttcctctccagcctcctttgtctccctgtaagcaatatcatcaacctgcttaccaaggaacatatggttggaagcattgcaaatgtgtttgacagcgtggagaagctggacgccgatcatgtaatctcaaacgaaagcaaggagccttaccttaagccaatggttgcccctggagcgctctgtcctttgcagcagctgatagatgcacagctagacaccgataccagcttcttcacatgtgaagggaaattgaaccattaccacggcattcgtgttgcttgtggatattttacggttatgaaaggcagcatttgccctaagtgcggctacgcaatggagaaggcaatggcacatgtcaaagccactgggtttgtggttgggacagccaggtacactgtcaaggatgatctctcaattgttccagcatccagcgtgtcaaccatcagcttgcttgcacaatgcggtgtcaaggacttgagcacgctgcaggaaaggaccgtgaagattggcaaggaagaggtttgtacatatctatcagaatcactttgagtgaagagaacagtcgtagtcgtttttcttaattggtgtggttgatgattttctgtgttacaatgtaggcactggagatactccttgcatccctgaggactaagaccgtgctgactgatgtatttctcctgaagaaaaaagttagttgcaagagggaggctgctacttagttagtatgatacatgtatgatacatgagcagttttaccaggcatcgcatctgagaaattggaaagttccgtacaagttacagaccttcattgtgagcatggagtaggtttccatttgtcttaaagggaaagcatcactttgtattgctcatttttagattagtcttaaatacacttggaatagtttttttttaatagaaatgttacaacccagccagtgaaatcttactgtcaatttgcgtctcgctataaatatgtttctgcttgccttctagaggtaaatgtaacaggtatgacttcattttttttaaaggattgattgcattcgagggtagaagcaccaccaaggatgaaggttgagatgcagcgagattttcacaatgacggatttaaaaagaaataacaggaggtctgaacaaagtaaacacttcctatctagatagaacaaaaaattttagtaagacctcgtagggcctctcatgattctcatgccgatagtggaggcttagccctctcatggttctcacgccaatagtagaggcttagcccccgtcgtcatcatgagttaatatttccgtctcaaaatataacaactttcggtgtatgaaatttattttaaaatataacaatatctatcgcatacatttttgtcccgatcaataacaatctttcctctcgacgaaagcgatcacaatcttttttcatttaattcaatcaacttttttaataaccttattcaacttccgactgacatcgtgcacgtcggttcgcttcgtttaccgaccgtggctgcgttggggagtgagggttaccaacgctactctctagcacgcaaaacggagcaatgtttagcgcatgattaattaagtattagctaattttttttcttaaaaatagattaatatgatctttttaagcaattttcgtat

SEQ ID NO: 73497 - DNA, 629 bp, Oryza sativa
atgaaactaccgaagcacatgcagcttgaaataatggaattcaagtcaatcttgccactcactgaccttggccatgaaagactgtcaattttgctgtcagtgtaaaccttcactgaacatttgtccaactggagaacattatacaaatagatagttctataagataccacagcttttagagttctatgattcacctccaaataatgagtaggtagttctatcctttcgattcatatcttcctacttaacggggatccatagcaataggtccaatttctatataaagaagacttgtaaacaaaaggacttattgctctttttcggttttccgcttcacctattgttcttatcaattcattttcctccttccttctttcaataagaactatttgaaatgaaacaaattcctattcattctgttacagaaacagggaattataaccagcttcaactgtctacatacttcaataaagatcaacctaattcaattgctttgtcactcttatgtgacgatgatattgatcagagccattaatatttaagatcaagaactccaagattctaatatgcataacaagcatggcgtctaagtgtcacaaaatacaacatcactcaatcacaccattgta

SEQ ID NO: 73498 - DNA, 576 bp, Oryza sativa
cacttatcaaatggaggtagagctcttcctttctaagttattcaggttaccttcatgaaagggaaggcaatatagattaggccaacctcactaaccataccaacaggatagcatactataaaggtgctgtacctgcgaagaaatcagtatgaaaacagtgaagcaattttttttaagataatttactaataagataatgagcaatttttcgaagcttatgctaatacatattgtgatatgtttacaactagaaccaacctaagccataagagccaggaaggtgtaaatccaaatgattcctttatgccaaagaaggaatatctgatgacctgcaaggaattatagtaaattttccacgaagttatgctctgaaatgaagaaaaaaaaatcataatctatgttcgactaaggcaacaacttcaataactaccgtcatttcaagaagcagagttgttgtttaactactgtcatttcaaaaagaagaattgttgtttatcatcttataataaaattgcatctgaaattcatggtctaccaagcgagtaatttggtgactagttttgggggcaacacata

SEQ ID NO: 73499 - DNA, 3305 bp, Oryza sativa
acttggacacaggagtgtgctaacccaacccaaacaaaaattgatcgtgctttctgttgtcctgattgggatgtcctctttgactctgcgcacatgtctgcactctcttcgtcctgctctaaccatgcccctttattcataactggctgtatggaaagagaacaaaataattccttccgctttgaatcttattggctcaagctcccagatttccggcaagtaactgcagagtcctggaataggccactacagactaccaatcctttcgtgcgactccatttaaaattaaaaaggcttgcaagagatcttagaagatggaaatcaaccagaataggagatataagattgcaattggcaattgcaaatgaagtagtctttcaactggatgttgctcaagacgatagagtattatcggaggaagaacagtgcctccggaaactcttaaaatcaacggtgcttggactggcagctttagagagaatacgactaaggcaaagagccaggatcacttggttaaagcatggagacgttaactctaaattcttccaaatcaaagcaaatggtagaaagagaaaaaatcacatacagatccttcgaactccagatggctttgctgtaactaaagatcaaaagcaggaagaattgaagcgttacttcacacaaaaattaggagcctttgctctcagaaatcagagattaaactggctgctctcaatctccctacgcttgatctctcagatctcgatgataacttcactgaagaagaactcaaaaatgcaatctctgacttgccttcggaaaaatctcctggaccagatggatttattggagcctttttcaaacaagcatgggacataataaaaacagatctcatacaagctgtttccttctttggagatatgggatgtgcaagactgcaagaactcaattcggcacatatctgcctcatccctaaaaaggcggatgcaacaaaagcgaaggatttccggccaataagtctaatgcatagttttgcaaaaatagtcaagctaaatcactagcaaacagacttgcaccaaaattagatgagctagtctctcaaagtcaaagtgcattcattaggaaaagagcaatacatgacaatgtcctgtttgttcagaaaaaaaagcctactcttttcctcaaagttgacatatcgaaggctttcgacacagttaattgggcatacttgctagaggtccttcaaatctttggctttggacataaatggtgcaactggatttccaacctactaggtacttcctcttctgcggttcttcttaatggtatcccaggtcaggaaatagaccgtgctagaggtcttcggcagggcgatcccctttcccccatgcttttcatccttgcaatggaacccctgcacaaattattcaagaaagcagaggatcttggccttctctctagtctgcaaagacagcggcgcttcagatgttctctctacgtagatgatgttggtctttttataaagcccattcgagaagaaatgctagtccttcgtggaattctttctgtctttgcagatgccagtggacttcacacaaacatggaaaaaacatagatcttcccgataagctgtaacggagtcaacctagataactgcctttccatcttcccaggtggaatttcaaacttcccatgtaagtacttgggcctgcctttgcacacaagaaaattggggaaattagagcttcaacctctggtggacaaagtgggatcgagaattcctggttggaaaggtcgcttcttcacttcggcaggtagagaggtgctggttaaaaacactctttcctctaccccaatttatcacctaacaattctccagcaaaataaatggctttacaaaaggatcgatcgccttaggcgagctttcctttggaaaggtgacgatcctgaaaacgttagcgggggcagttgtcttttgaattggacagtcgtctgcaagcccaaacctttgggcgggcttggaattctcaatttagagaaattcgctcgggctttaagacttcgatggctctggtacgaatggaaagaggaaaataaaccctggatcaatatggaaattccatgtgatgagatggacagaaatctcttcagagcaagtacacaaatttccctgggaaacgaaaagaaatgcaagttttggtcagacaattggctgcaaggatacgctcctaaagacatagcgccgacattattcagattagcaaagaggaaaacaaactgcgtagcctttgagctgcacaataatcactggatcacttccttaagaacaatcacttcaataaatgagatcaatgagctggtgcacctaggcagtaagctgcatgagatcagattacaccccaattctttggatagtatcacgtggaagtggactaatcatggtgaatactctgcaaaaagcgcttatgaaatgcagtttgtaggatcagttgccaacacaaattttatgccactttggagagctgaagcggaacctaagcatcggttctttggctggttaattttacatcaaagaattctcacagctgaaaacctccttttaagacattggccatgcgattggatttacagcttatgtacagatgcttttgaggacgcaaaccatttggcaaaggagtgcagtttcactaacacggtttggtcccaagtttgtagctggctggacatcatgcagaccccaaatcaactacaggatgcaaacattttagaatggtggacctcaatcatacattcaacttatggaaggagaagaagaaaactgataggggcacttcttataacctggtggcaggtgtggcttgagcgcaatcgaagaattttccatcaaaagcaactaagtgccacccaagtagctttcttagtaaaggaaaatatagatgccattcagattttgcgccatacataaaggcttgtgcttagctctagttgatagcattatgtatgtaaatctctgaaaatgaaaactgaaaatgtcacctagtggtctactctttcttgacctctctaactgcttctccttctaatatatccggcagagctcctgccgtcttttgcttaaaaaaatatatttcatcttttttagttaagttattttaggtcggagaaaatatatatctgacgtgcctatcaacaagacaacaacgtagagttgtcagcattagcttgccacaggtttgacttgcaagttgcatgtgagtgtagcttcgacgcagcaacctggtgacctggattcgtggagagcaaacgaattgggatgtgcgagccga

SEQ ID NO: 73500 - DNA, 2680 bp, Oryza sativa
catcattcatcagtcaacactcaccactcctcttctctttctctgttttatattagtgctttgcatgtacacgttgccatgtccgtgatgctgcatatatgttgtgtttgtgttttgtagggcctggcgatcctgagggcctcgctgcagtccaagaccgttctcagcgacgttttccttgccaggaggcctgcaaagcaagcctgaattctactactacttcaacaacgctggtcgctggcgatgtcaaaatgcaagccatctcgatcgataagtagttaactatacgactgtattggtctttagtgatgcctgtaaattaatgcgtactactagtagtatcttgtgccgtcgtgcactcgtgcgcgccccagatcttttgctagctagtagctgaagtgcagcatgatgaaggttaagcctgaagcaatttgggatgttcaagcaatacccgtatagtagtgtgcgtagaagtcccccttaatctgtgtgaatcaggactctccgctggtaagaatcaccatgtgtactactgtactgctgtttctaatgctaccgctgtttctaatgtgcttgactgttcttgatttgcttgcctctgaaactctcaatttgatccggtgttgtccggttttcctttgctttttggactggaccggtcgaggcttgcatctcttttgctcgagcaatctatgaactctcctcttgctgttgtctttcgccgttcctgtctggttcagttcaagcagcagcaatgctcagaagaactcgaaatttctttctccttaatgaagaatttggactgaattcgaaataatttccacatgagcatgacgtagactacataaattttaaaggcctcctacaagaacgtcgcagaaatcaaccaacgcattatgcttctgtttggtggtaaagttctttcaaaagtaggatctgtttttttgacattaatctgaactgaactagacgtcaaaatcatgtggcatcggcggcgcgctcttctccatctggactgcggcggcggcgtctttcttctcgctcgttgctcgggcgtcgacgttcttgtcgccggatctatggtgcttgtcgccggcacgagccttcttcttcctgttcaggaagacatctgtcaacacggtcttggactgcaacgatgccttcagaatctccaaaccctgcaaattcgcatcaaaacaaagtaagccgagtttagtttcaaactttttctttaaatttctaatttttctatcacatcaaaactttcctacacacatactcccttcgtccttaaaaaaaaagacaaaccctgggtttgcgtgtctaactttaactgtccgtcttatatgaaatttttttataattcgtatttttattgttgttagatgataaaacatgtctttttaatttttttcattatttttttaaataaaacggacagtcaaacattgggcacggaaacagggttcgtcttttttttttttgacggagggagtaacttccaactttccgtcacatcattctaatttcaatcaaacttttaattttgacgtgaactaaacacaccctaagtagtaaattagtatggagaattcgatgaagaatttatctggttaatttatcacctcttggtagccgatcttgaccgtcttttcctcgagcgcggagaggtcctcgacgccgagcttgctgagcagcgcgatgctggagatgctcgacatgggcatgaaggtgaggtcgtccatgacggtgtacgtcaccacgtcccgcacgaaccctttgccagtctgggcggcggcgaggcaggtcgaacagcggcagcccgtgtccgacgacatccccgcgccgaagggcgggaacgccgccttcagagacggcagagacggggtcgtcggccggatggtcgaacactggtaggccgggtggcccggcggcggcggcggaggaggaggaggagcaacgtacggcgcctggacgcgcgggggctggacgagggacgggaagccaccggcggtggcggcgaggcaggggtgcgccggcgccgggttcagcagcgcgtcgcgcgcctccgcgctctgcatgtacgcggcgtccatcctcctcacgctggcgtacacgttcgcgacgccgccgagcgcgttctcgcccgcgagcagcttcaccacggcgccgaccggcatggcgaggagcccgacgaggaagtcgacgacgtccttgccggcctcggcgaagagcacgacctgggcctccttggcgatgagcagcttgatggtcggcgtcgtcgacggcgccgcgtccgccgaagcgcacgacgacggcacggcggcggcgttgcccatgttgttgcctgcttcaaccaagcgccgcgtacgtaaaaccctcgcaggatcagatcgctttgtatagttgttaagtcgagcaaattttcacggaatatatggagcgtgaaaccgattggtgcacgattgccaacaaccgcgatctttccgtatatttgattttgtaattttccattatctctatgtatagttgtattctgcattattttaaggaaaacgatatgataaccatagcgaattcgacggtagatatgataggcaattgctgtgcacgcggatattacgaatctgacgataaatctgtaaaacctagtatggttctaacccggtaatccggtgta

SEQ ID NO: 73501 - DNA, 711 bp, Oryza sativa
ctgcagcccctaacaaggtttgtcccaaaatatagcaacttctccactaacattcacttcccaaccaatcacttttcctaccaagctccacttctcaaccaatcacaaactcttcctatttagttctacttattttcttaataaccgatgtccaactctaaaacttcttatattctgggacggagggagtacttgattatttctggtgatcatgattgctacttatggttctagtggttgtgtcttttatcatgtccccctccttgactatattttgctgtggtgatgacattaaactagttacattttttccctttctagttgtggaagtgaaaccatttgaagatgcttcttttaatcctgtagaggatgagaggaaatattatctattgaaggtttgagattcacacatcacctcttcaatcttcttgttgcttttgcatattttttcttacttctgtttatgcttgttttgggttgcaggtcttttcaactgcgattcctaaagaagaaattgatgtacatgttcgatctaacaaggaagttaaaaggcttggggttatttcatcttatgacacttcattctcctgtaaattggactttgaagaccagtttactctatcacatacttcacaagaagaggatgtggtattctatggatacacacttcgtcacgtacaatatcctttcttttacctttattatcataat

SEQ ID NO: 73502 - DNA, 6686 bp, Oryza sativa
acacgattagccgcgttttttggcgtttcaacgcgagacactcttagtgggaaatttggagttcactgatcttcaggtgttccatcttgcgcaaagtgtgatgtcgggtatgtttagctcggttcagacttcagagtctgaaacttttatgaggtgcatgcgtgtattatccagtgtctagaatttgtctctgacgtgaattatcaagtgtctagaatttaagtcagatcaaggagccaacacccggagatttattaatcaaatggtgcatattagcttttgtcaatcgtgatttctagctttgaactgttgttaacttacacaagaaacgcgtcatgcacttggagaacggtagtggtattgatgcttcttgtcgaatttctcgtatgcatatatgctgagaaatgcgaaagaaaagcacgggtattttgtgtgatttcaatgtcgtagtgtggtctgtatcaatcttcaaatatttgcttgctaaagactgacatgattcattttgatgtaacagaacgggaccactgatcaggtggacaaaattgtgaaaattctgaatgagggacagattgcttctacagatgttgttggtatgtgggactacgttgcagattgattccttttaagtgcgatattttctgtttttatcattcccacgaaatctgtatacaaaaaaactgcatggtaggacatgcttatcaatctggaaccattgtgctgcagaggtggttgtcagcccaccttatgtgttccttcccgtggtcaagagtcagctgcgcccggagatccaagttgctgctcagaattgttgggtgaagaagggcggggctttcaccggtgaggtcaggttagttatcagttctgtttcagttgtacacccaacatgctgtaatgatcaccagaaggttagctacaaacctacttgcagaaagatgcgccattacgctgtttgattaggtctcatatttaacatcacccagaaacaatgccatcttttcaagctagcatgccatcttttcaagctagcctgccttcacttggtattacatgttgcatgttgttatatttgctcagtcacagttagtgttgtatgattggcagtctcaatagccgtcttcgcttttaggcgaggttataagccattcaccattgaactcatcttttgtttaagttggttgttaatctattatttttaatgcagcgctgagatgcttgtcaaccttagtattccctgggttattcttggacactctgaaaggaggagtttgttgggtgaatcaaatgaggtatgatctagtttacattctatgaaatgtgcagatatgaattttgtatagttttagctggaaatagtgcaacaagccaaacctggggataacggtcactggagacaatattgtagctacttagctggcactaaatttgatcctaatccaatatatcaccaacttaattttacaaaggtgatcttgttcgctacaaattggtggatgatctgctgtgaggttttcgtatcataatcatctaatggtttcctgctctttcctgaattgcagtttgttggagacaaagtggcatatgcgctctctcagggcttgaaggtcattgcatgtgttggtgagactctcgagcagcgggaatctggttcgaccatggatgttgttgctgcacaaacaaaagcaatttctggtatctaacctctacttttggtctttttgactctgttgaattccttatccatttgtgtactcgtttgatctaaatggtttgctgttcgcctatatgttcaaatggtatctaggataattttccattcattgaagctttatcttgcgaaagttagttagatctcttttgatgcactactcatttcttgtttggctaaattctacacattctacatcagaaaaaaaaaatcttgctaaaagtcttataagccacttggttatcacatattcactatgtgggagcactctaaaaatgggaacatctggtgatcagatgaatccacaggcagtaatgtaatgtaatagttcaagtgattacttgttcaagtggttaatggtttaatctagaccttaatgtaatgtctcatagttagcatcatttgataaaagattagctcatcacatgagaattcaggctgaaatgactatggactgttttacagaaaggatcaaggattggactaatgtggttgttgcctatgaacctgtgtgggccattggaactggtaaagttgctacaccagatcaagcacaagaagtaagtttcttatattgataagcacacaaagtgttcattcatgaacttctgcacgttccataattgttacctatgctctagataaaatatcttgtttaaacaaccatctggtttgtattattgtatcaggtgcatgatggcctgaggaagtggctcgctgctaatgtcagtgcagaggttgctgaatcaacaaggatcatctatggaggtataaatctacagtatattttcttgaacaaacactttacgattgattgcacaagtgcaccttaggcgacaactgtcctggtgcctggacatgattgtttacatgattttgctacaggttccgtaactggtgcgaactgcaaggagctggcagcaaagcctgatgttgatggttttctcgtcggtggtgcttcattgaaggtaaagaataatacgaacacagtagaacgattgtacagacatgattacccgcctgattcactgaataccgtctccctttctttgttctgtagcctgaattcatcgacatcatcaactccgccaccgtgaagtccgcctaagatcttcaccccattcaccttcggcgtgggaagatgtctgaagaggatcatacctttttctgtgcttatgtaatgctagtagttttgtgctggagcagctactctttttcctccccttcacttccctgaagctacctgcagcttgagcaatgctaataatgcacaccactgaacatactaccataccaataatgtttagctccttttgtcgtgagttattatcatgtgagtgtcagatcagatttcactggtcccttcacctattcttgctggcatatcagtctgatgaatcaggcatcaattctggtttctctgtgttatggtctgcaatgtctagtgaggtttaaggtttttgcatcttttggtccccatgattgattccaagtaacaggctaactgccatagtacctcaaattttggaatatcttgtgttgtgtgctgatctgctcagttggcacaatcctctgaacgcaaccgttgagcaaactttgcacggttgctgccaatcaatttgagaatggaccaatctttcgtcagatgtctggaccttgcatcacactttcgtacgatgatatattctcttgagcagtatacaaacttttaggccgccattattataaggccatgggtttcataacaaaattttaaccagaattggcaaaactcttaatagcatagtactcgatatgtaatttgattctttggccactattagcccatcgaataatttgattatttggtcagataaacaaagttatcgtgtaccaagagtttgggtatttgatctcagaactacaaaagatgaacacaaatttggcaaatttgatttcagaacggattgattatggactatggaggtagatctcagaaccaaaaaaaatgaacacaaatttgagatggatctcagaacggcttaaaaactagtaaaatttagattcagctgtgtttaactcgagttttaactcaagaaattaactggacggtccgctgccgcttcccgccattactgggcagcataaataaatgagttcccgcgagctcatctccctcaaccgcctcgcgagaattcaagccgctcatgcgttgcatcgccgcgcgcttcgcgtcacccccacgggaagcgtgaccccgctcacgccgcgctccaccgccgccgccgccgccgcctcctcctcctctcctgctccctctccaaccagcaaccgagagctcacctgttcttgtttctcccggcaccgaaagtgagaagaaaaaggagaggtataaatgagctcgccgacgccatcacgggccgccgccgcgtcgtcgtaccggaggcgtgggaggtgcacaataagaagggcgcgggtgcggcggtgcaggatgaagctgatgtacttcctgatggacaaggaggagaagcatcggaagcgggcggagctggagctggaggtgtcggagctggaggcggcgctcgacaaggagacgcgcctcggcaggatcctccactgctccctccagggccgcgtcgtctgccattgctgcctctccaccctcgttcctaacaaggtgatcgattgattagtagtagtagtgatcagcctctgttcatctgaattttcttgggttcttcgcattgtgatatttgctggttctttggaaatgatttgcagttatttttcttgaaatttcaaagaagttactgttttgcagataatttttactgtctctgacgaggtaccagaattacattagaaaatgtggttccttctgttacctcgttaaggatagtaaaattactcttttttcgagcccgaaaaacctcaataaatgactctttcgtgtctccatttcattgtcgaggctgttgagactggagaaagtttgatgaaaacatgattgcaagtgattcatcagtggcgtacagtcgaagagagagttgtcatgataagatttgacacctgatactgatactgtccagtttatgcctgctgcttgtctgcaatgagcatggagtagacacaccaggatatccccctatgataattgtgacagatgattgcttcttgggaatttttcgtagtcagggatttcagaaactcagagagtcagtgaatgattcttactgtatctcaggttgaaaaactgtgcccactttggattccttcccccaacgtacaatgttatctggatctctgactcctgacatgaggacaatacaagtactgtttgcccatttcattgcacaatcttgatttgtctacagataatctctcacaccttatctaccagatctgctccccttggatcctggccactcgtacccgttataacttgtcgatcgcttgcaagatggagccatagattcatagtaattctttctattttattcctttttaattcaccttgtggtaacagccaatgtaaaatttctgctgtatttcatactcttctgagtaacctgagcaagtgagcagcacactactctgatcaattatcggtgcatgtctgtccatttcgattatcagagaatgcgaaaagtatatcactataagccatcatatcacttgaaacactttggtaagtcaataattcattctttccattgttgcagatcaggggcctccttgcagagctagcaattgtggaggatgagatattctacctggagaagaaggtggacgacttacggctgcggcttcaccgggagcgcaagtggactgatcagtgcatttttcagcagcagcagcagaattggccgcaaaatcgccatcagaggcactccatctgcagccttggtggaaggagggagcttcaaggagctgagttgctaccaaggctaccttgtcctggcagtgatgaagctcttgaatgtgaaagcaaggcttctgttggatctgtctctagcaaaggtacacaaatttcatcattcatatgcactccaaagttctaggtctaaaaatgttctgttggttgttgagttcttgctcaagtattcagagtcatcaggacacataaaattcagtctgtcaactttttgttcatcttcgcagagagaattttagtacacaggcttctttgcagattcctcttttatattatacagcacaaacgaacatcttgctgcatctatctatcagagaaggatagaaaacattttgattcatgattctttttttgttgagtaggtgaggaagttgagcaaatacgaagaagcagccactcatttgagaatttgaagctccctgaaaggaaaatctgcttgagtggcccaaataagctctctgaggagctgatcagactgacagtgaacatcttccacaagctgaataaaacaacgaatgcagcagagctggagatgagcagcacatcaaagctcaacatctcctgcattggccccagaagtcttgttcctaagtcgtctgcgatcaccggcgcagccattagcactctcaagaaccgcagaatgtcacagggcggcgacggagcagagaaggagattgggtgccacaagagatttgttgaatttacgaagagctcgtttgatgtaagccgcatatcgtcgtgtcttgtagacatcaagaacttgaggtgagctataacccctttttttgttgcagtacagtaatcaaagtaaaactcgattctgatgtcacttgttttgcttccacagaatcttgatgcagaggctttgcaatgttgatccaagttttctgacgaacaagcagaagctggcgttctggattaacatctacaacttctgcataatgcatgtacagtaagctgccctgatcaacaaaacacactggtgatgaaataagcactgcttcattcattgctaatgcaagaaactgtactttacaatggttttaggcatgtcttcagcatggg

SEQ ID NO: 73503 - DNA, 5593 bp, Oryza sativa
tcgctctctcgctggacggtgggccccacgacttcgggtaggtggtcccgggatggcggcgacactacgtataatgcgtgcgtgcgggtttcttttgtgtgactcgaaggagatggagagggggctgcctgggagatcgggcccacatggaagtgacccaagtactctctccatggctccgtcccacaactctaggtctctcgctcccgcttcagctccacctctcctcgagttggagctcggccaaacagtttcagctctttgaataactaggcttatcatatcctattctatattcatttattttagatgaaaggagtgtcgactggcattggtatttttatgctttgagccaaattatcagtttaaatgggagcggaactgggtggagctctctcacaaaaatgagctaagatgtggagttggattagtcagctccacaactccactccaaaccaaactcttgaagctaaaattaggagttggaactctaccaaacagaccctaacttaggatacgatattacagtacctattagaatgaatctgaaccctgaacggttgggtctatcacatcctattctatattcgtttattttaggatgaagggagtgtcgattggcattggtattcttatgctttgggcccatttaccagttaaaggctttaagtgctattcgactatgtagagtagttttctttggagcattcttacacatacttaaaatagctttgccaagaaaacttataggactcgcacaaacaaagtttctcatcatttaatttaatctactgggagaagaattggatgtacatatagctttgtccattttcattttgtcaaaattatgcgcaacatagcagtgacaaagcattgacaaaaataaggtgtagttgacagtatcattttgtcaagaattaggttatatgttctcgagtcgataatgttgtcgtattctattagtcaatgttatagtagcaaaacagataatattgttgtgttctatttctatgtcaaaacaaacataaatatatggttatttttctgttgatatatataatgtgagcagaatatgagaaaaaaatgctttcttatcttttgctgaaataagtgttattttgtcgaaatgatggaagcatatcgtggactttctgcccattttcaatataagcaacttatggcctgtagatatgtgttaaaaatcgccataaccatcttaagatacgttgtgcgagtgaaaatgatctgaatgaattatcatacatccggtggtggaaaaaggcaaccatccgacttattttagtgatacgagcgattctgttggggtacttaattacttactgtcaattcacaaatgtactttcttagcttagaaaaaaaggaaggtagtaaaaacactcatacaacgtataaatgttaatgatgtcgataaaaatggcatatcttgtcgatgtaaatgaataaatggtacacaaaacaaattaaatggagggaaacagtgtcagagacccatgttctcaaaatttcggtaaattattttgaatttcagataacctcacgtcctctccaactgaatatagtttcgtttattcacaagtatcaaatccttggctccaaaaaaagaagatgttgacttcttcatccagaaaggaaaaggagagagagatcaaagagagaaatattcagatgttgctttcaaagtttgtactactggtttggaggatttatgagaagaagaagaagcagagaccaagcttccgaaaaccggttcttgacttgtttatcctgaccatgacaatttttgattaaggttgtgtgtagattcaaaatttagatccaaacttaagtcatttctcatcacatcaacctgtcatacatacataacttttcagtcacaccatctccaattttaaccaaaatccaaactttggattcaactaaacacagcctaagaaataacaagaccatcgggtcagtatgtcacgacgtggacatactcaggtaacgacgacgctatcacattgtggacacaccatggacgacaatgtgctcggcgataattaagattttaatacggtattttactgctcgataatgacacaggtaacaacatactattaacctatccctgtcacgattcacacacgacgtgcctgtccgaaatagtggccgatctagcttaaccaatgatctccagaagattcatctagataattgggaggattagccaatgatatccaggaaattcattagtacttcctcgttcccaaattatcatcatataataaaatctaaaatttctcaaattaaccatcatataaccgcatggatacggatttcatcataatacaattaatataacaaggaagaataagcgcatgctaaggtgtataattggcatgatgttttaattggtgcatgtactgtgagagagtgtgtacatggtgtcttaattaatgcgatttaaattattcttatccttggtgtataaacatatatgacgatcaatttgggatggagcgagtattacattacgaggggattaatatgcgcctaaaacacataggtggctagctacttagctatactctctctgttaaaaaaaagccaacctagatgacgatttgacaccaactagaactatagatctggataactaaatacaattaaaattatttcctctgttctaacacataaacatatagaaatgtaagatttttttataagataatgtaagattgaatgtgacatattctatctaataaagataatgaaattttgattgtgacatacttatgataggtatatatgtactacttggaatttaagttattcaagagtcctcacaactgatcacagtcacaggttgccgaccaaaatctagctgtcaatgaagtaattatcacgacatgttggtgttgtttaaaggtaatgaagattaagattaagcaagggcacgctaaataaaaaagctattaggatataattaattaagctttaatattacaaattttaaataaataaatttatttcttattttaaagtaacttttatattaaatttttcgtacggaacatacggtttagtagtttaattttttttccgacgtagaatctgcatattcattagaaaagaacgggctagttgttgagtccactatagactcttaaataggccatgttagagaaaaacgatagttctgtaaaggccggctttctgatcgtctctctactagtaatacgcaataattaaattcttgtagcaagtgccatgattttctacattttggatctaaatacgtgacttttcttgtagatggactatacaacggccgttgcttatctcgtctgctcttgtttttctcgttgtgagccggtgtcaggctgatggcatgcaaaacatccctgcatgcatcttccttcttggttctttctcttccacatcatcaaatttgtttacataataataaatagagcgcatcttccttctttgtttctttctcttccacatcatcaaatttatttacttaacaataaatagagcccattgattaatacctttgtacatgcccttacgcgggaaggaatcgacgacaatggtgcgcatggaccaacgtggctatacatcagcgacgacaactcacaaccgcgaagcaatgtaaacgcagtagcatctaaataggtaacgacaaagatgttcactaatctccaatttgtagtttgtagctagtagcatatcatcccagacgggcatatcgcggttataaataaccagcgatggtccaattagtttgtccaattactttcacgagttaatcccgatcattccaggattaatatatagcaggtgcacaatacacatcggtctcaaacggccttccttttagacaactaattatacaagagatatgtaattaattaggtgaacccatcgatcaaaagcatcacgaccttacctatagagctaaagcctccaatggcgagagagttggtgagtaaagagcagatgacacagaacgcatatgtacacatgattgtttcttctagacgatggtctttcctggcttgaataatgatgttttatagtagtattccactaataattaataaatatccctagttggtcatcttcccgacgactaagcggtcacctaagcactcaacagctactagtactaatgaatgtcgatctgcatgtgcttcctgatgtgacactaatgattgattaatttaagactatatgatgttgaagattgaaccacccaaattctctacccatttatatttattccctaatacaatgaagcatgcatttatttctagactagagacatttaattattttgccactcttaaatgtggtaagtaaccatttaccatgtatacccacatgtcatagacacgtaaggatccaaatgttaacacataggtgtcagatagttaaacgtctaacctaaaagtaacaaatatttaaatatcccttatatctatgattgaaaggaaaaaagtctaagtacaattgtcgagatatggcaggtttggtaggtctctaacttctcaacttaactcaaataattaagtttagagtggaattatggagcaccttgaatccagattcatctctctaatttgttttaatagcactgctctactcccttttagatggaattgaaatcgtttggttggacttcatccctaacctccataagaggtgaaattggagctagaagtatgtcaaacatggccatataatctaagaacagcttatcgagatatccaacaaaaaataatcgttctcctatttcagtgagtaaaaacctgatggtccaaacgagttgggctgaaaatgggacagtgtttcggtgagacgggcccagcaagaacataggcctggttgggcccctattccccctacgttttctcggcccacccaccgttgggctcggctcgggcctaccatcgggcggagaggaggcccaactcgggaaaaaggagaaacagaaaagaggccgaaaaggcgaaagggatcgatgaggtggggaccaccggaccagcgagagatgcgcatcccgatgcagcacgatgccgcggcgccctctgttccgctccgcgccgcggccacgaaaaccacgacgccgccgggatcatctgcgtccgccttaccagtggccgtcgctgctatggatgacttaagcagttttttttatgtgtataaataaaacagggtagttaacgagtcatactttggttctggaagagaatatctttttaggaaaaaagcaataggtcatcttactctttgctacaggtgcaataatttgcccggacaatagacctgagtatagtttatttagttctaaacaatgcatcagaatatggaggaaaaagatggccttagtataggatcaattgagatgtacagttaaacaaaaaagtagatatggatttacaaaattgatgcggaatattatatccatgtagtagctcccatgtactagtttcttttgcttgaaaaaataaaagaagcagataatttctagagaagtccagagaataaaaagattggtggtgggagtgggacccacctgtcattg

SEQ ID NO: 73504 - DNA, 17218 bp, Oryza sativa
agaggggaggggaggaggaagaggattggatctgagaagagcaagagaggggatgttccaatcttatctaaatatctgtctgggatttaaccgatgggatgtgggagataaatatttactcccggttgataactccaactgggactaaagatcaatctttagtcccggttggtaataccaaccgggagtaaagatcactcgatctttagtcccggttggtgataccaatcgggactaaagtggtaatctttagtcccggttggtagtatcaaccgggactaaagatcctcgaccccctgacatacatctgacaggggatgaaccgggactacaaatcatctttagtcccggttggtgtagatcaaaattttttaaaccgggactacaaatcgtttttagtcccggtttttaatggaaccgggactattgtgaaatttggtcgaccgaccaaagatggtttctccaccagtgttacggcaccgggagcagcagagggggttggccatgctaggctccgccggaggctttggacaacctggagcggaggatcctcgacgacatgaagcaggctcatgaaaaatatcctcggtgtggagcctgccattgcagagagcaaacctcggtcgttttggaggtctctatttctcttcatctgtcgctgtgcagtgggattggcaatgtttggagtctttggagatttcgcgctcgcagcactcaagagatgggccttcgatttccttcagagtccggaggtgactcagatcctcaaaaccttcatcaacaacagatattacggatatgtgactaaattggttataaacatgtagttttgttagaccaaatcttaaatatgtatttttttttataaaattaatattaaatccgtagttttgtgatacatccagttaaatttttagttttacgataatttaatcacaatatccgtgaaatttactcttagattatagactaaccatgcatacggtaacaagtactccctccgtctcaaaaaaaagacaaaccctggtttccgtgcccaatgtttgaccgttcgtcttatttgaaaaaattatcaaaaaaattaaaaagacaagtcacgcttaaaatattaatcatgttttatcatctaacaacaataaaaatacgaattataaaaaaatttcatataagacggaccgtcaaagttggacacggaaacccagggtttgcctttttttggggacggagggagtatactcctatattagtgcctgatcgatgatcaaagtatatatcacgatcctattggtctgtttagttggtgaaatgaaaatttttaaatgtcacatcggacgtttgattggatgtcggaagaggttttcggacacgaatgaaaaaactaatttcataactcacttggaaaccgcgagacaaatcttttgagcctaattaattcgtcattagcatatgtgggttacagtagcacttatggtaatcatggactaattagattcaaaagattcatctcgcgatttacatacaaactgtgcaattaatttttctttttatctatatttaatgttttatacatgtgtccaaagatttgatgtgatgtttttgggaaaagtttttgaagaactaaacagcccctataatatactccactttggaatactccttgtgatcatgcgagttttcttttgtgcgctctgaagacaaaaaggagggcaacgtagcgaccgtgtggatgctgcctacaaaggctgccagcttactcgtatccggtctactcgtagctctactgctggggcggaggatttgtccaaacatgaattcggcaataataaaagggggtagcgcacgaaacctaaaagtggatggatgcggagacaaaagatttagacaggttcaggccctctcaatgagaggtaataccctactcctgtttggggatttgaatccgcagggtgtagtatagatcttatgtgctcataccccctagagggcctcctgcccaccttatataggatggagggcaggattacaagatagaaaccttaaccattacggtatcggtttcctaaatctactttacaatattatcaaactaggactttaggccattccgtaatataaaagaaacgtaatacccaagtcatgatctgttacatattccatagatataagttatcacatataactagtcggataaccacgccgtgtgggtatggggtacccataatctccacagtagcccctgagaccttcgcagtcgaaaagataatcttctctcgaactaaattactccaaagccgagtgcttcaatcatctttgccatggtctcccgagtacttttaccaaatctgaagactgtgaagggctgaaaaataaactcaggtgcatcgactagatgcacctaataggtgtagccctcaactatatggttaattgaacaaaccaagcatatagtcaaggaataaataatccaaccaaccgagtggcttcgataattatagtcaaccaagcgacttgatattaatatgtagcatatgcggtgtgaatccctaaataacatgatccgagtgatataccgactgttttgtacaatatgatgagtgtaacctaaagttggctacatcattgaaaattcacatagcaaaacagctataaagaagcttatatgttgtgaataaagaaatttctaaagtattgggcatacgccatgcgcacactgctttaacagatgtgcttaagtccctagaagacacatggttccaccacacctggaaatatatggcatatgtggtataaaatccgagtaaataaactcataaaggattcaccaaccgcctggaaaatgaccaaaatatataatcagcctaagccataatattggtcaataaaagtgcacacttacgtggcaaaaagcaatgatattgtatccaatcaattgctttatgaacccaaacaacgccttgacttatataaaaaagtcagcggggagctatataaagcattactgtttggcaccttttaaaatgcattgtaccaactcctaaaaagttgagtaactgcggtataaaaggattttaaggtatagggcacataatcacgcgcgcttttgcctaagcaaaaagatgcctaagtccctaaaagaacgtgacatgccacacctgaaaatatgggctgcagacatattaggcctaggccaaaaaatatgccttcgacaccctttaaaggatgacgcatgtaacatgctcccgagtaataaatctttcgggtgatatagacaaagtgtaactcatatgaatagcttctgatctgagtgattatcctttatgggatactccaaaatagatataacaattgaattccgactggcgcaagtattcggttgataacccttacggggaataataaatagtccagtctttgagcatagaaaatagacccatgatcatcaaattcatgttgcatgtatccggaacaagtccaaattgaaggtatgatacttgtgtttgaggtagtgagcccctgagtatatagcttgtccttctgtcgtagtcacaattgtccattgatggtagctgacgcggttggcatagagacaagaagaccaatatagagataatattgcccaccagaggtggcaaaaatattggtagtagtgaagatagtgataccaatcaaaagtgatgaagttgcccagcgataaagttgtgtagccatggcagtgaaataatcattcggtgacagacgatgcagctggtgaagaagatgaagatgcccattagtggtgacataagctatccatgaaggcgaggataccggtcggtggtgacgaaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacagtaatccatcaaattggtgttatagctgttgcagatgcttcacttggaggaaagtagatgatgttgtccaactcgtcgaaactgagctgattggttgataactctgctataaagcaaagacgaagataatgactcctagaattgactcgttggctgattaattgattgcttcagcttgtcgaattttgaaagtcttgtatttgtgtagcccccgactctttggttagttgggaaacaactgaacatagagtcgagaactgtaacttcttgtcgtcgagtagtcattgcttgagtgaagataaatattgaagattggaacaccacttgttgtaataaaataacacggcatcatatttggtgacgtatgccgaggtgtcgaaactcttgtagtcgtcatggttggtgaagtagcaaagcttgcgaagtagaggcaatagagtttgccgatgccgaagataataaaaatgaagttgctccaccatggtgacaaagttgcatatccgtgatgaagtgaacacgagtcggcggcaacagaagcaaaccggtagtgaagacgcgcaattgtgaagataaaagcaccagtcggcggcggcataaccagtcggcgacggaagacgatgatgtccatcagtagtggtagctgtataaaccagacgtagaggcgagggcactagtcagcagcagacgagatgaccagcgatgaagacgataaggccaatcaacactagcagaatcatgcagccatggaagtgaagaaactagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcagcggcggatgaggcggccggtcggtgaagcggccggtcggtgaagacgtagacgccaaacaacggcggcataataggccagccgtgcaggcggaaacaccagtcggtggcggacgaggcggccggtcggtgaagacgtaaacgtccaacaacggcggcataataggccaaccgtgcaggcagaaacaccagtcggcggcggacgaggcggccggtcggtgaagatgtagacgcccaacaacggtgacataataggccagccgtgcaggcagaaacaccagttggcggcggatgaggcggccggttggtgaagacgtagacgcccagcaacggtgacataataggcagccgtgcaggcggaaacaccaatcggcggtggacgaggcaagtcggtggtgatgttctaactgatccattcatggagcgtaagagataagcttaaagccataaatcccttttatgcatatctggatctggatcctgcagaacaaacatataggatgactagtatctgatataaatataatacttgagaaaaattcaagtattttaaaatatttataaatatgtatttcatctcttgtcaattttgatttccccgagcagatgactcattacgtttaaacactctgcccgactagtcataaccaccaagcaccgggagtcggcctaagcacttcccaaacatgcatatgagtgacatgagttcgtcattaatggaacaaagtttcacgggtcggagtttactactcgggtacttttgcaattattaagagcagaaaataaattatcttatctctatgcttttgatttattccaaataatacttagcaccttgcgttattcagtccatccaacaagcccccaggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactagtcaacgacgaaccagttgatgtagtgaggcaaaggaaaaggcaaaatatcatataaagaataaaataaatgatgacttagctttgtcgtattccctcggtgacagcaaaagtagccgatgtgggaacgaagcaatccatcaatggtgacaaaaacaccagtcgacgccagtggaaccaagccagtggtgtagatgatgaagtccattaacggcggcgaagtccgccaaccgtataggcgaaaacactagtcagtagcggcagaggcaggtcggcggtgaagtcgtagacgcccaacagcggcggcataataggccagccgtgcaggcggaaacaccagtcggcggcggcgaaggacagcctgtcggtgaagacgtagacgcccatgtacggtggtgtgaccaaccaaccgtataggcgaggacaccagtcgacggacgcccaacaatggcagcatataataggctagccgtgaaggcggaaacaccagtcggcggcgacgaaggcaagccggtcggtgaagatgtggatgcccaacaacggcggcataataggctagccgtgtaggcggagacaccagtcggcggcggcgaaggcaggccggcggtgaagtcgtagatgcccaacagcggtggcataataggccagccgtgcaggcggagacaccagtcggcggcgacgaaggcaagccggcggtgaagtcgtagatgcccaacagcggcggcataataggctagccgtgcaggcggagacaccagtcggcggcgacgaaggcaagccggttggtgaagacgtggatgcccaacaacggcggcataataggccagccgtgtaggcggagacaccagtcggcggcggcgaaggcaggccggcggtgaagtcgtagatgcccaacagcggtggcataataggccagccgtgcaggcggtgacaccagtcggcggcaacgaaggcaagccggtcggtgaagacgtagacgcccaacaatggcggcgtgaccaaccaaccgtataggcgaggctgatttgcatgtagattcgtctctctgattttgttgacatgatgggcttggtgcagctaaacggccttagaggttgcgtgtggcatgagcaaacgctacattggtagtcgagccacgcactatgtcctggtgtacccctcttggcaacatggtagcagtgggaagcattgcaccgacggccgtacatgcaataaaaaatcgtgagaagattagtgtacgttagtaattaatctaaatatataaattacaaggaggttaggaaccggcagcacagccaaatcccatcactcattaaggaacgattttttgatctcgattgccatcctgtgcatgtgaccaaccatcgctccagtatacatgcaaaacaaacagatatagtttgattagccttaaaatattacacgcttaattgtgtaatgcatatatcaagctagggtttgatattaagccgtgcatatcagttgatcaacacatgcacgtgaagcactcagtcgctgttgatcccatggacatgaattgtccccgtgtcgtatgaaggttacgccggcacctgtacagatcgtaccaggcgacgagcagacacaccgggacttcgtctcgatctcagccggtgcgtgaaaacaagaaaaagaaaagtaataggagattagtctgcagttagagaataatctaactagtgaaaacgacaaagccaatgatattaattggagatcgaatcgatgaaattgccaagattgatcccttcgactggattgaatccgagacgaaaaagacatgcttgatgaatccggcgatgtcagagattggttccatcacacttgtgataggaaactcgacgaacccctacctggcgcgccaactgtcgaaacatgaattcggcaataataaaagggggtagcgcacgagacctaaaagtggatggatgcggagacaaaagatttagacaggttcagaccctctcaatgagaggtaataccctactcctgtttggggatttgaatccgccgggtgtagtatagatctgacgatcatatgtgctcataccccctagagggcctcctgtccaccttatataggatagagggcaggattacaagatagaaaccttaaccaatacggtatcggtttcctaaatctactttacaatattatcaaactaggactttaggccgttccataatataaaggaaacgtaatacccaagtcatgatctgttacatattccatagatataagttatcccctataactagtcggataaccacgccgtgtgggtatgaggtatccataatctccacaggattatataaagagtaggacttaattattaaagtatgaacttctggaacgaattttaataaaaaattagtaaatttcttggtattttttctgccaggtgtcacctggctcctccccaccaacagctagcggtgcagcaagctcgagcaagcagaggcgaatcatccatagcattaactagttctcacatcacattaatttaatattaatgattggtcctgtatagatttcagaacttgaaaaacaccaaatcaattcaaacaaatattttcctttttttttcaaacacgttaaaggatcgaatgttaatactatatcgtatgaaagcaacaatcagcagcgcatatcgcccatcagctgaaaagaacattattgcagagacaagcgacgggaagctgagatagcatcggtcgtcagtcttaacaaaaactagtgactaccccgcgcgttgccgcgacacttttatatgataaaagaaaacttttagatgcaacatatatctagcctgatgtattcctacgttggcactattctaaatttatacattacttcaagcgtagggtacacttgattgttgtgattaaaatacaccttgcaactattaaaaaacttacaaaaattcaacaattaatagcaagatagagttatgcattttctgatgcttgcttcaactgagtcaaggtcgttggaaaggaagattgttcattcatccatgctaacgaacttaggctgacatgcatcattccgatactaacagagatataggcctcctatgaaatagcaagtgaactttaattagtacccgagaataaacttaaagaaccattgccgtatgaatgaatatcatagaaaaaatagtggtctgatagggagcttagttgatcattgccatgaagcaacatcatcaggatcaatgtccatagaagcagtagaaaaactgaagaacttcagatcgcggtgagcaaaaacagataaacaaagaacacatgagaaagaaaatagtaacatacgagtaaaataaaaataataatttaaattgtaggccgaggaaagaaacacaccacaaaccatgaaggaatgactgtagcatggcaatgacagcatgacatcaaaaaaaccatcaataatttaaagagatcacagccattgcatccactggtttcacaaagaatctgttttgatcctatacgatggctaagacatgccattgtggagaggcatataaatagtgaggtgagaggataggtgaaaggaaaggtcgagtcaagaaaaatgcaatcgatgaatatatgcatgtaactgtttagtttattgatggtagtaattaagatagaaaattaagcgatatgcatgcaacacaattatcatgggagttgggccggtctcctcgatcgatcccgcataggtttaatccaccatcagctgcgcgcaattagccccgctcgctcgcttcctggcctcaggatctgtttcgattcatctcgcgctctccccacccgacccagattagagagcacaatttggggaaaaagtttcaatcgaagtttctcttttctctactcaattgcttcatggcctgcctgatgttaacttaccttgtctctgcatgcatgcatataatattgtctattatactcccttcgtttcataacgtaagtcattctaacatttccccacgttcatatggatgttagtgaatctagacatatatacatccatatgaatgtgggaaatgctagaattacttacattatgaaacggagggagtaaattgctggcttggtaagctaaatatttaggcccggtttagtttccaactttttcttcaaacttccaacttttccaccacatcaaaactttcctacacacacaagcttccaacttttccgtcacatcgttccaatttcaatcaaacttccaattttgacgtgaactaaacacacccttagggcatgtacaatggtgtctaataacgggctctcttcattgtcatgtaagtaaatttagtgacgtggaagaaagagatggaaggaatgggttgctacgcgagtcgactcttagcatttattaatggaaaatttgttgcatgagggctctcttcattgtcatgcaagtaaatttagtgacgtggaagaaagagaaggaaggaatgggttgctacgcgagtcgatccttagcatttattaatggaaaatttgttgcatgaggatggagaaaaggaaataagtatgataaaaaattgcaaaatttgttgcatgaggatggagaataggaaataagtataataaaaaattgtttggtgcattaatggtttagaaatcttattgtctctactattgtaggaggatagtctttagtgatattaattagtatatagagctcatattagactctatcattgtacatgcccatatattattaagtgtgcatggatagaatcgtgcaaagaattagtgtccctctatatatctacatactggtagtatgtaacagctaggcaagtgcaagatgcaccagttcagggtatgtgcaactgactaaatgaaatgagcgactagttatgctagcccttcatctgctggctgggggcatttttcttgaatcaacagctgtttgtttgcacttggcaatgcctagcaatctgattctgtttcttccttcatgtggaaccatagggcacagcatctcccaagactacaactcctactggcaagggccgtgcctctactcttgaagaggacaacatcaggtttcttgctgaattggctaaacgacatgcggatgaagcaagatattacaggatcgtggcgctgtctgctgtttctgcctctggtgttgtgttcttcaccctgttaacccttcgcaatcatttgaatcacctgtctgaatgttagctttaccatatctgcgttagcccttcgaatcatgtgattcacctgtctgaatgttagctttaccatatccttgatggttatgtattttgtggtaccaagtctaagcaccttttatctatgagacgatgcaaacctgtggctttgtattgatatggcatgcatttggataatgtgtaacgtatgcactcttatgtatttcaaccttatatatatcgttctgtgtgcaattagatgctaaggtgaggttcattcttggatgaatttggagcgttcactgtttatatgtagagactaatacggatagctgttatggtggaatcatgagtcatgacgagggttgcaaaggaaggaattagttggggtcgcttctttgccatgccatatgcttctgttctgttttggatcattattcatcttttctccttgcacttcttgttcgttagtgtatatgaatcagtcgatgtggattacaatgaaaatatatagagagaagcatccaaatcaattataagtagtggtggtcttgcaagttgctactactagctagtgaagaacacaagatatgtaattcaaaataattgattgcccgtcggccagggccagtgcgagttgttcaaaatataagcagttgaaaatcatctcatggtgtagtgtggcaccgatcgattatcgaaacctcttggttgttgttgggaggaatattgatcgataattcgatatggtgcatctagggtttcgatcgttcggtttctttcttaaattttttttttgggagctggctggccaaaatctatacctattcctacttacaaaatacgagggacgtcgggtccagggccccaatcgccgtctccccaaacccaagtgccacctccgcaaacaccctcaccgtctacctctccaaatggctctccttcgccatattcagggtgtgtttagttcacgctaaaattgaaagtttggttgaaattgaaacgatgtgacggaaaaattaaaaatttatgtgtgtaggaaagttttgatgtgatggaaaaaattaaaagtttgaagaaaaagtttggaactaaacaaggcatcagagaagtagaaatttgggcagggtaagttctttcaaacattttttttttttgcttttccacctttcctgtttctgagtagtatttcttgaaagtagtacagggcatgcttactatttttgacagaaaaataaattaaatcaaacataaaaagtttgatctttcacaatttttgttcattagttatactaagcctgatcaaacagagattccaaaccaaacaatgcaaagttcttacaaaataaatgttggcagaattcctttcaagcaaaacatagtattctactgcaacctccaatgactttcggtctcatcttttcgcttatgcttattagccaaaatttaaattttcaatcttaaattttcccaggaatcaatccggaaaactctgcagatcaaacttcaaattcaaatttatcctcaaaatttgggctttccaactctgcaggtatttaattaactaaacattaaattaaagacacagtaaatgcaattaagtaactggatttcaccctgaagatgcaatgcaggctccagcaagtcgaatccttcccacatctcactgcttaattaactaaacattaaattaaagactaaataaatgcatttcagtaactggatttcaccaccctgaagatgcaatgcaggctccacgctccagcaagtcgaatccttcccacatctcactgcttcttgtttccttgagctccagctgggacgatagcaacggggctcttcttgtcacgggcaccggcacccttgctgctccagaacaggctcttgatcatctgacggaggcttctggccgtgaagatatccttaacagctgcatcccaaacctccgcggcgacaaccctcctcagctcacaagcttccggctcgcgtgagaactccagcagctggttctgggcctcatcctgatggcgcctcaacacagcaaacagctcagggcagtcaaggaagtccaaaaacctcatcctgaaaagcttcatgagagcagcagcaagcaaggctagacgccaatgtgagcgccttgtctgctcaatcaacaacttttggttgccaacccaacacttggtgatgcgctctcctagtgcttcttccatcttgttcaaatgggcggcgataaccttggcgatagccttctcctgatcatcccaggcctccggcggagcctggcatggccagcaccgtcgggtgacgtaggaccgaaccccctcggtgatggcggcggccttcttcttcaccagagatggcgccgccttgccctccaacgccagcttcttggcagcagggccggccatggaggtaggcgcgaagagcagggccttgggcttgggcaccaggtgtagtgacgatccccccgcggctccggcgtacggaaagcccgaggctttggccggagatcccgactgtggtggcgccttgggcaccggcgggtcgacggtgaccagagcgcgttcccgggctccggcggtgcacggagcacccggtggcgcgaacagcagcgccttgggcaccaggtcgagcgtgaccaaagcgcgttcccgggctccggcggtgcacggaaagcccgatgatttctccgtggcgaggccacgggcggtttgggcgaccagtgccctcgcggcggccgtcgtccggccttgcttcgcggcgttgaggaggaggagggccatcggctggttggtggcggcgccggcggcggggaggaggaggtgagggggcttagggttttgagacgaggaggacgagactaggctaggctactagctttctctctctacttcttggttcttgcttgccttgcccctctctcctctttttactccggtagaggaaggaggaggaggagtgggtgccagcctttcaatcccacccggatggccgacacgtccacagccctatcaatccaacggctcccggctcctgacgcacgctgacatctgagagccgagccatatactactatctaggagtaaataataataactttcacataataattctttcttgaaaaggataaacgaacacaaagtatacgttttcctcgatccattgatagcttttcaattcctaaccctccctataattaaataatgagagtattttaagtgctttattttgtgtagcgagatccttcaattctccagtggcggctcgtctcacacatatctggccatatatatactcattgaaatgagaaattcaaacaaattaacgccgttgataaggcctcatttcaacaagtgacattgaacacgctaatttatctacaaaatgacattataatccagtatttctttccctaaacgcccaacaataatactacccgttagcgttgtagagtagtactccatccgttaagtcgttttgactttggtcaaaatcaaagctgcttcaagtttaatcaacaaaagtaatacgtaacatttttaactcaaagacaaatttattatagaaatatattcaattattaattttgacgaaactaatttggtatcataaatattactatatttgtctataaatttaaagtagtttgacttggcatgtaatccctccgtccctaaatatttgatgctgttgacttttttcttattcaaaaacttttatgaaatatgtaaaactatattatacataaaagtatatttaataatgaatgaaatgataggaaaagaatagataattgctgttggggggatggctccggatgacggagccaccctccgtcagtaggaagactcagctcgaagccatccaccacgagagaatgatcgaaggctgtagctaccatgatggttgactccgataaggggcttcagaatcaattaggagctcacgaatcatctcggagccgaccacgggtaccggagtgggccaacgactccggagcgagtcacgggcccgcagctaaccaatggcttcggagccaatcaaaggctccggagtgcccggggaactagagtgctcatcaagcatggaggaatggtccacgggtgtagaggggcgccattaatacgcactacgcatctgtcaaccacctctgacatcctgacagtggcaagaggcatccgctattatccggaagcatgcctttgcccaaataatagcccacaccctcggaaagcgtcaccacctccttaatggctagggattttaccagtagccctacgactggctcactggccagtcactccacatctgtttttagctagggtaaagatgtaacttccccttgtaccccttatatataaggaaaaagtacgaattaccccctgaactattgggtgagtacgaattaccccataaacccgaaaaccggatatttttcaccctcaactatcaataccggatgaaaaacccccctagcagctttgcaagcggttttggtatacgtggcagtctagtcagcaattcttttttttttaaatcagcggggcccacttgtcagtctccaaaactactatcccatagactagcgtggcactggcacaactggcgagcgacgggtacagcctgtcgactgatgaaccgctggcggaggagcacacggaggcgacgaagcggccactcgacgacggcgtggtcgagatcatcaacctcacggacgcgtccctcccgtcgtggagtgcgacgtcgccatcgtcggctcagactgcggcgggggcgtggcagccgcggtgctcgccggggccggccacaaggtggtggtcatcgagaagggcaactacttcacgtcgcgggactacacatccttcgagggtctgtcgatgaaccagctctacgagtctggtgggttcgtcaccacgatgaacggcggcgggctgctcctggccggatccacggtcggcctgcctcaagacgcccgagttcgtgctcagggagtgggcggccgcgcacgggctcccgctgcacaggcggggacgggcgaggcgagcgtggcggggacggccagctgtggcggtggaggcggaggtgcccgggcggttggtggcggcagcggaggcggaccgggcggcgggtgacggtggcggaggcggacagggctgcggcggcggcgtcgatggacacggtggacatgatgagactgaggcggggtcggccagaagcgtcggcgaagcgggcggcctccatctccgtcgccgaccgcctgctctgcctccatctctgtcgccggccacccgagctcgccctgcctccgtctcctccacctgcgcggatctcgccccccagctgctgttgcggccgccgccttcctcccgccgcagcgccgcgccccgccacagcctcccgcgacgccactggtcacccgagctcgcctccgccaccaccgcccgcctccctagcggccaaccgagtgggcagactccgcctaagatgacgccgatgcctaagagcggccggccgagcaagacagagaaagcaaagggattggggaggggagagggatgacatgtgggtctaggtgtttttttaattttatttgctgactggattgccacgttggcgccacgtgtgcaaattcaagtcgaaaacagctaaaaacagtgctgagggtttgtatagttgaaggtgaaagatgtccggttttatggttcaggaggtaatttggtcgaccacgatagttcaaaggtgtaattcgtactttttcctatatataaatatgtaaacattgtccacggttgggacacattcaatacagaacacatattaagcacactagttggattttgttccaacaattatttaaattttttttaataaaacgaacggtcaaacatattttaaaaaacgatctcaaatatttagggtcggagggagtaatataaaatggaaggaataataaacacgataaatcgaccaggtcgaaggagggaggcggtgtgaggtgcaccacagaagaggcggagggctttcggctcgacggcggccgggttccaaacttccaatcctagacagataggcaacgcaaacgtgccagccgccgtggaaggcaagacgatcggcggcggcattttg

SEQ ID NO: 73505 - DNA, 11956 bp, Oryza sativa
attttcctattcgttgtggagttattttttttaattttttgtgtgggttgatttggttctgatgtcgtttgcttgtcatgtctggtacgattttgcagaccggatgacacgccgtgggatggaggtgagtccatttgacttttccccttattttgttctgatcaagatatctagttactagtgattgtgataatttggtgtttggtgaatgaaaaattaatgttatgcggatttgcaagttatcagatactgcgcgtaaaggttccattttgttcatctgatttcacgtgtaaaaaagaggaaacaccgaaacagcaacctccctacttaaactcaactttgtgcttcgttttgtttacgtcttggttcgcttctgatacaggaagcttataattaagccatttgtgactgtgatgcattcttgtttactgaaaagttagagcttgatcttctgatgcgtttgatttgtgctttattgacaaggctttcactaggtaatgaaaaagcatatgattggcatgtttatgaaattacaggctgtatgcatttttacccaacaaatgcggacactctaacaagtaaacgacactttagagtagaaaatgagtagctctttctcatacagcgtggcatgctaacaataacaagcacacacattagagctcttataagaactttctccataccacttggaattataaatcgaagaacatacccataacgttctcatcggagttactttatctgcagtactcagagcatgttatgatcaggtttggttattgtgctgctctgtgaaatgtggttgtttacaagaatctttactgatccataggattacttttgttatggcaaaaaggaaagtgtttccaacctagtttttgtggtgaaaagtagggaaaagcttttgaaaagccatcacagagccaagtatgagccttaatagaattctgctcatctcttgcttaatcatactcttagacttatagagtccaggaaggctaatgggtgatcagtcgcgcgcgccttcccccgcttgactcgacacgtgtcgtgcggggagggggcacgggcggcggcacggcgcgcagtttcttttttttttctttcccctcctcccccgcacgttcctttcttttagttttttctgttttttttccgcagtttttttgtttgttttttgcgcacggttttttaatacgtacgtgtacaaactttgtatacacgttacaaagttcatatatgtgtatacaaagttcgtatatgtgtttttttaatatgtacatatacaaactttgtatacgtcgtatacaaactttgtatatatcgtatacaaacttttgtatatgtgtatatattttttatacataaaaaatgtatacatattaatattaatacacacacacacaatatatgtactttgtatagacgtatataaagtttatacgtatatatataaaaagtattttatacgtatgtatataaagtatatacatacgtatatacatgcactgtagaggagagagtcagagagactaaagacgttagaactgaccgtgcgcgactgatcgccaatcagccaccccctatagagtctgttagtcttaaatttgaaaatatattttttttcataatttgcgtatacacgggcgctgaggaatagcagaaatattcctattccgcgagctggagatgcgggagcgcgacgatactgcaggctggcggcgcaggggcacggtaccgtagcacgggagtgcgggaccggctcggtcgcgcagaccgggggtgcagaaccgagtcggtcccgcgcggcggctgtgcgcgttgctgtagcccacgggaccgcctgccagcccggccgatcgcgcagaacggtggcgcgggtccaaagcggtctcgcatgaccaagctgcggcaccgagccggtctcgtagggctccggtgctgctttcctaaagcgcgggagcgcactctcttcgcatccccattaagctgcaccgcactgaaagttgtttgtcccctggctccatgtgacatgcctagcgagaaacggcaccgcaccgaaagttgtttgtcccctgccgtcagctccatgtgacatgctcagccaggaacaaatgggagagcgattgtcttctctcttagcttttttcatatggcgtccgccgaaagttttttgtcgtctggttagagagcttactcgtcgagtgcctatagaagggaacgttacgaaatgaaagaagcagactcaagtatagcatataactcatatttgtagactttatcattggtgtaagcttcaatatgttagtgcgcttggcgaattcgcatgccctatcttgtggtatgaactgagcacacgataatttatggtgcgtattgggggcttacaataagataatgccgtgaatttgctaagcgttcaaacccactgaagtgttgtgtgaaggtaaatatttgtaagtgttcgtgaaggaaagacatgcaaatattttgaatttatttatttagaaatgtagctgacatattagaaagttttaacacacaacattacatattaattagaataagaaaaatataaaatcgttctactcattagcctcatcatcgaaatttcaggatgtgctagtgtcctttttctttccctttcttctagcaccagctggaggtctgcgtcttgacaaaaataatctttcaggtgaatgtcgctcgcgaacagacctacgtgccacctaaataccgttgaaatcaacgtgcctgtagtcttgggtcagctgagttattggaggcggttcatcaatctgcgacggtcctatctcgtgttgtgctgttgacgaccccccaccgtagctacatggttctctgtaggactgtgtgctgccggcatatcccattatttattgggggtgtacattcctacaaaacattgaatccaaagttgtagcgcacacacatactggaactaaaatattttatagtaaattacaatttgtacccgttgtttgtggttgcatgataggtgcttaggagttatgccatgtagctaatttagctatcatattagcaagaatagggatacctcgtttaaaatggagccattctatttgtgaacattggagtaagaaattgtagacttaatttttggaagctctttaagtatagccgattgttatcatttatcaatcatcaggacaaaataaagtagttcttttgggtgcggttagaccatgtcaccatgactaaatcttcattgtttaactttgatattttttagcaatagtgtgatgggaccatagcaattagatggcagcttcatttgatggcctatttattgtttgaaatcaactacaaaagagtgatagaatgtataggaaaaatcaccggatggaaactctttttagtatttggtgaccacattttttgcatatggtacctccaatcttatggccttcaaataattgatgaaatgcttttgacatacacaattggtaacatgatcactccctttgtctttgtatgtcaggattgcaaatttgcaacctcatgtaatcctttaaaatcacatcgattgaaatgaagtatgttttgtggtgttattacttatgaacattatttcatgtttaagttagtactaataagtgattttgtcacataggcacgttcaagctgacactacaatttacagaagattatcccaacaaaccaccagttgttcggtttgtctcaaggatgtttcacccaaatagtatgtctcataacttgataatttgaccacttcattatctttgcaagctactacattattcccaagagattgaattattgaagatatacacaactaattgtttttgttatccgttcagtttatgcagatggaagtatctgcttggatatcctacaaaatcaatggagccctatatatgatgttgctgcgatattgacctctatccaggtatcatttgaaccttcgcagagtgtcctaacaatcacatcgatagcttcacttggtttaatgctttcccctggttgtagctcacttgattacaatcatttatatatgatagaaaatacacgcatattctgtatttttgtcatgtcattggtgtagaggtaattccaatattgaggaaatcctttcctcctactatagttgcatacaccaaagtcattattgacagtcgttattgttttccaaacaacctgctatatgggtaatgtgacaccgataaattagttatcaatagcatctgcagcctgattctaggatgattagagcctttcatccatgtcatgttgctgtacgggttattgacctacatttgctgacaaataatggcttgggggaccatagttgatgtcttcctgcctgtaatcctcagttccacattgagcttagctgtttctgttttgccttttatctgcagtccctgctctgtgatccaaacccaaactcccctgcaaactccgaagcagccagactgttcagcgagaacaagcgcgagtacaaccgcaaagtccgcgagattgtggagcagagctggacggccgactaagccaaggacatgattgagttgcagtttctgcaacaagcttctcctaaagatatgcaattctggctttcccggtctgtatcacctactaaaaacataaaaaatcttcagttgttgtaattcctgagcttgatcccctgccttcccctacttgttttcccaatgtagtggctacctatttgatgaatttataaggtattgatgcttatgtaaagaattatactccctagccaagaagttgctgttgctgctaggttgcagaagcctcttgaatcctccgtgctttctcgctgtaccagcgttcagtcacgagaaggttggtgatgctgtaattggcagcaaccgcagctgtttttataattatcacggaactctgaccgttggtagtagaaactattccagctttaatattgacagaacgatacaggggcttgcacagcacaacattatttgtacgcctaaaaagcacatattattgtacgcctaaagacaaaaaagaaagaaaagaagaaaaaacaaatgaaggcgtttctgagatttaaaggattcagtgagcaaacacgatcaggaaaggggaaggttgtgtgcatcaagacagaagcacaacccggaggatcagttccatcaatatctttcatcttcagcttgcctcctgcctgtctcaaaatttccatcttctgttgcagcctgcagccacactgatccacgagctgacgaatcctcacattctttttcccgcccagccctgtaagaacaagctgaactttagaatccttcaaaacaaaggcaaaagctcttcctcatttcatccatacacaccaatccaacaataacctatcaacactacaaatctaacaaatcaatcttggtttggaaatgtgaatgtgatggtcacttgatcagaggatacttgattgatttggatgtatggcacacctggtttgctcattctggaatctggaggatttcgtgatccgggacgacgacgacaccattgaaccgtcgctgctccggttatctccttcccagtcgtcctgcacctgtgcagcgaactgcaggttccagaggacgtcctcgatggacggccgctgcacagcctccttggccaggcacctcaggcagatctgcatgatcgtcctcagcgactcgtcagagcatcccttgctcacctcctggtcggcaaagctcctcctcctcaccaaatcctcgtcggcgactgcccatagcatctgaaaaaaggagtaaagattcagagattgtgctgtgcattgctaggtggaaattcagaggttggcatttttcatgtgaaacaatggttttcaggtgatggtcatgtctcataccagttctttcattatctcaacctcatataaggatgtgattggctttccagacacgatctcaagaaggatcaccccgaaatcgaagatgtcggttttatcgttgagcagtgggctgcaaaataacacatgcagaattcagtgggttttttttcactagattgtactgattgaaactaccagatcataggcatatgtacggatcaagtcctgataagtacctttcagtatggtgcttgcctccaggtcctcccttcttggattgacaaacatcataacatttctagtcagcaacagccagaaaaacaaattaccaaggactgttaaaaatgactgatctacctcagatttcatggcctctcctaggattgggatattgtagctgctgatcttcgcgacatgattctgatcgagaagaatgttgttgatcttcagattgtttccaaacaggccaggcatcatcccagcatgcaagaactgaatgccgttggcgatgccgatggcagctgatattctctgtgcccatgtaagcttccttccttcagttccttctggtgaaaatcagtacaggatgcagtgcaaagcaacagtcagtgactgaatactgcaaacaactgaaaagaaaaacaatgaaggagaacagctgacaatttaacatacgcgaaatcctgctccgtaggttcccgttttgcacgtattcgaacacgaggtacagctgagtgacagtagaatcatcaagatcatactcgaagcagtgcccgagagcgctgaccaagttccggtgtctgagcctagaaattgtttcaatgtggcgactgaagcttagggaagactgattcctcttaaccttcaggctcctgatggccactagtgtgccattgcctagtctccccctgtacatctgacaaacaaacaaagatctgatctcagctcccaagcttttcaaaatgcaggacttattcatcacactcatataagcccgtgaggttaatttgaacagaatacagtgaatttcatgcatcaattagttgtaggttgctcaatgggtaattttaccatccttaaaaatgtactgagagataccacattttgtattgtaaatttgataacttcaggtgctaggtatcttgagtatctaaactttaacttgcttagggaccataaaatttctcttgctcaatagagtctgaactgatcaatggagaagattggcatacctcgccgaaagaatcttgccccagtagcaaagagttctcaaagttgtcagtggcagcttcaagctcaaccaaagaaaatgttctgtatggtggaattcccagagctcccagcttcactgtctgtgatatgtagcctgttttgattttgtcgcagacaccagtaggaaatcaaatcttagtgaattttgacatcaaatttggtgaaattttagataaaattcagtgatgagtgagagacaaatcaaatcatacgtgcatcggcgaacatcttggatgggtagccactcgtgcttgaagaattgtcttctcccaacatcgccggtggcctcaccattacgcctttcttgttcttcctcctcacggcgacgacggcgacgacggcgatggccgacgcggcggcgagagccgccattgcaatgccggcgaggaagccggcgtgatgtgtgagcttcttcctcaccttgccgccgtgagttatccccacggccaaggcttggttctggcagaacggcgacgggtgctgcgacgcgtcgccgccggtggcctcgaggcaattggcattgacgagcaccaccgtcgccggcttcttgtccggcctcaggcaggccggctcgctgccggtgaggaggttggaggacaggtcgacgaactggagattgtcgccgcaggcaaccttgtcggagagcacgccggtgaacctgttgccggcgacgttgaggtagcggatggccggcagggacagcagcgccggcatgaacgggccgacgaagcggttccacgacacgtcgagccgctcgagcaggtagaaggaggtgatctcgccggggaggccgccggtgaacctgttccggctgagcaccaccgtgaccaccttccgccccagcgccgggaacgccgggccgagccagttgtcgccgacgtcgatcacctggaggttggtgaggccgctcatgtccggcaggttccccgtcaggttgttcgacgcgagcaccagcgacctcagcgactccatgcgacccacggacgccggcacggcgccgcccagcgagttgttccgcaggctcagcacggccagctgcggcagctcgccgatccacgccgggagctcgccggcgagcaggttgtcgtcgaggatcagcgtctggaggccggtgagctgggacagcccgccggggacgccgccgtagaggtagttgccgctcatgttgacgatctccagcgcggcgaggcggccgatcttgtccggcagggggccccagagcccgagcccggacagcgtgagcaccttgaggtcggggagcctcgacagcgccatgacgagcgcgccgatggagaagttcatcgggagcggcggcgcgccgcggacgccggcgatgtgcagctgcgtcaccgtgtcgccgtagcacaccacggccgccgacggcgccgccgtgccgccgccgccgcagaagtcggtggtccggcgccagtggctcagcaccggcgggtggttcagcatctgctggatcttgaacagcgtccatgtctgcgagtactgcagctgcgagcttcccgggagcaacgcgagcagcgctgccaagaagacgaccaggtgatggcttgcacccgccattggagaagctctcatcaaatgcttcttgatcagcaagaaccagcagagaagcagagcaaatcaatctgtactgcaagaaattaatctctgtactctgatgattccttcaccttctccttctactacgatcaaggacagtgtgtacaagcaacagaggaatcaaggctttgatgtgtgttgatagtaccagaaagtaaccaaatcatcatcaggaagaggaagtgatcatcaaagatcacatttcttgccagcttgctccattcttgaactgacagtaacaagacaaaaaaaaacaatcatgttaactgaagaacactcatgcacatcactactaccatttcacaagaaccaaacaacaaatctaatcaactgcaccttacctagcttaggcagtcaccgactggaatagcaaagaaaatcttgctcagatgactgacgaactcaagaacagaacggataataaacaacaagagaaccttattacagtatactgaccagtgaggcctagtgcaagtatatatcctctgattctactgtaacttgtactagtacaattgctggcttgccctgcgctgcacatcactcacgggtggctggcagaagcatgaggtagctgcaggcatcaacggacaggtgtgtctccaacgattcagctggaaacggggagcaggcaaaagaccaaggactagcagtcccagcgttcactttttctcactgttgagtcttcagaaaaaagaaatatacacacacaccagtgccctgctcctctgctttcttgggatcacactctgattggtgcttgttaggcttagaataatgtgctgctttacgccttaagtttgattagtaattctactgattaattaggagttatgaaatcagtttgacaggccttagttttacttcagaatgttgcttctgatctactgttccaccaattgctttaggatcaaaactgaaacttcgatgataagccagtcctgaagcagtaattagacgttaggacatatgctggtactgctgcacatttttgcacagtaacaatctggcagtgttaaatgatgctttactctccaaatgaacttttttcccttggtgagtaccacatatcacatatggcccttagttcagcaccactgttagcaagtgtggtgaacattgcccttttttctttcagtgcttttccttcttttcttggattcttttattttttttccttttagcacttttacacctgatgatgcctctcctccttgctttgcataaagccaaggtagaggaagcatcaaagcacccagcaatcctggcattggaagatgcacataaattgcaagagacactgcaagtaattgtttgcactgaatctttgaactctgaaaacttcagataactgtttgcactgagtctttgaactctggaaacttcagatggagtaattgtttgcactgaatctttgagctctgggaagttcagataatcgtttgcactgaatctttgaactctgaaaacttcgtataattgttttgaaatgctctggagtttgtgagatttcatccatgcaggtgatggatgaaacattatgaaatgaatgccaccttctccacctaacttgagcagcgcactagctgtgccagtacactgtcctgcttagagcagagcacacgaaagtaattccattttggacagaatgaatgtcatgggcaagtgattttttggaacagattatgtacctaacacacatccatcgacttcacacaaaaccgtggccctaaaattcaatgccgtggagcaacgtgcatgtgcgtgttaatgttgtacaagtacggcgatggaactaacatgctagtagtatttcaacttgtaatcagggtcctaggaaaagtatgagacatcaattaccttttgttgtaggacacaaaagaattacgatgacaccaggaagtacatttgttcgtacaccatgggtggatgaatgtagtattcgtccagatttaaaccctaacattcacaattatttccttggagttagttaagtccaaatcttagttatgaaaatgccagaaatgtaattggctgaaatttattactgaaaaaaatatgtgacctttggtatatatgcatttgttgcacatatttgctgatacaacgagagataagctactcaaatgtatcctcaccctgaaaccaacggttactcttgaggtaccttaatttttgtgacaaaaaatgtctaataataaccctaattactgttgtcccgtcgtatgagtatgataggacaattgatcaaaagcatacggcacgagccactagcatgtactgcgtctactgcttcaaaagcaagagagaccgcaacttttacagactcatcactcatcaattaggacgtacggattactcgtactagtacattagtgctacaagaaatgcattctttttataggacgtaggtagtgtagtacaattgataattactttacagcagcctcggagaaaagaaattaacggtgttcgattagctgaagcaagaaatgcactcctttttttagaactaagaaatgcacccttgatataatttgaaacaaaaccttattgctctccttcttaatgtatttaaggcagaactactgccagagtgctagttacttaaaaaaaaggaatattacattatttgaaaaagtacctaaattttatactaaaattgttaataccttaagatacttaatatctagaggtattaaattttatattaaaaatatggtacgtctcagtacattatcaaatatagtaaaattaaaaaaaaaagctgtaggattctcctctcgttatatacagacgcgcatcagttaatccctgcaggtacagtacaggtatatcatgcgagttgagctacagtaacgcgcagaattcattactaccggaatacacagatcaagataaggagcgagcaattaatgtctctctactacagggtttaacataatgacccaaactgcaactacatcaaccgaatcgtttccagaaaaccatacagagaatttgtaccaccgaagattgtgaagcaagcgaacgtcccggcgacgaacaagccagtaattcgtgcccaacttctatctctcaatcctcacgcacgtgtcggggtccagtagcttcgctagcgttacacaggtgctgtttggatccgaagggctgctattaaatagccctccagaatcttgctatttaggagtattaaac
